United States Patent 10,407,724 (METHODS AND COMPOSITIONS FOR SCREENING AND TREATING DEVELOPMENTAL DISORDERS) - sequence listing, part 58

SEQ ID NO: 1572 - DNA, 49439 bp, Homo sapiens
gggttggttggttatttacttatttatttacttaatacacttcattttttagagcagctttagggttacagaaaaattgagcaaaaagtacagagaattctcatataaacctttaaccctcccatcctccacaggctccccaattattaacatcttgcatcattatggttcatttgttacaattgatgagccaatagtggtacactgttattaactgaagtccagagttgacactagggtttactctgtgttttccgttcactgttttccattctctgcattttgacaaattacagtaccctacagagtactttcactgtcctaaaaatcacctacctgccatccctcctttcccctcaactctcagcaaccactggtcctttgactcgctcgatagttttgcctctcccagaatgtcatataattgcaatcatacaacatagaaagccttttcagattggttttcacttaacaataagcatttagggttcctatatgtcttttaatgacttgatgtctaattcttttttatcatatacctgaggactacattctacaaccctgctataattgcttattaatgtcagcaggtttttgttatttagaattttctacaaagacaatcatgttatttgagaacaaagacagttgtatttcctccttccaaatttatgtgcattttatttcctttttttttggtatcactgcattagatagcacttccagtacaatgctgaaaagcagtggtgttccttgccatgttcctgatcttagtaggaaagcatttagttggaaacatcaaggatgatgctagatgtagggttttttgtagtagttctttatcaaattgagtaagttctcctgtattccttctgtgttgagaggttttatcatgaatggatattggattttgtcaaatgctttttctgtacctattgatatgatcatatttaatctttgaactgctaatgcatgcaatggattgcactgaatatcaaatgttgaacaaggcttgcattcctgatttgctaacattttaaggatttctgcatctgtgttcactggaaatattgatctgtagttttcctttcttgtaatgtttttgcctggctttggtattagggtaatcctggcctcacaaaatgatttgggaagtgttatccctgcttttattttctgaaagagacagtacagacttggtatcatttctaccttaagtatctcgaaaaatgcacatcagtgaatccatttggtcccggcactttttttggaaggttttattattattaattttattgagatggagtctcactctgtcacccaggctggagtacagtggcacaatcttggctcactgcaacctccacctcccaggttcaagtgattcttctgcctcagcctcctgagtagcttggactatacacgcatgccaccacgcccggctaactttttgtatttttagccaccgcgcctggtcttggaaggttattaattactgcttcaatttatttaatagatatatatgcctactgagatctaccttttatgagctttgagagaatgcatcttgcaaggaattgatccattttagctaagttatcaaatttatggacagagttgtccatatttctttctaatccttttggtgaccataggatcagctatgatggcctctttcacttttggtattagcagtatttgtcttctgttttttcttaatctagctagaggtttatcaattttacccaccttttcaaagaacagttttgggttttattgattttctcttttcaatttcactgatttttactctaatttttttccaggttactttggatttaatttgctcttctttttctagttttccaaagtggaagcttagattacttgtgtaatctagggtcaccagactgtaaaatcttagattatttgtatgatctgatcatgtaatgtagtgtacaatcttcacactgtcaataaaagccccatgccagcttgattctggctcttctccagcctcaaccctcctcttcatattctcaaaagtctctgaaggcccagatccctgtctgggtacaatgagcaatgaaatgacagtccaacagccctgggcagcaactgggctgtatgtgtgggcctctttccagggccctgtcttggagagcagctgcttaaagaaaatttggactatcacttacgctgaaggctggagtgttcacatatgtaccccaggcagttcatggcatgggatgagccacaggtagtaagagaaagggagtaacatggaggcaggcctagatcttcacacgtacaggatagattttttttcagataatctgttattttgatttataacttttaaatggataaacattagctctgtgggtctctatttaaattgtttcaggacacgacaaacacctgggatgggcctgatgaagtaaccactactaaattaggatacctacttcctattcacaattacgttaaataccattatgcatatgaaacacacgatttatatcacataccacttgtacatatgtaagtcctatgaacttcagggataattcacagatgtgcttaatgctgttgccctgattattcaatttatctatgctttacaaaaagcttcatagtcaagtggatgccagggacagggatgcagaaagggtgtggttattaatacaacaagggaactacttgaggctaaatcctgattcctttgtaatcctgaaacagtacagatctcagactccttttccattctgtaaactaattgtgttgatggttactcaaatgtaaaagtaccagtttgttataaccacacacacacacatacacgtacacacacagagtgcacgcaaaccatagcaaaatctgagtaagtctgcatctactagcaaggtaacatcgatttcttggacttgaccatatactatgattatatattatccttagaggaagcttggtgaagggtacacgggaattctctgtactcattacaacttcttgtgaggttattttaattattacttcttaaaaaattcttaaagctttacattccacaatgtacatctataaattattgttagataccttaaaaactattatggcatcaaactcaaaacagaacttgtcatattttatttctaagcaaaattttcactttagatttcttaaattgacaattttctcctcagtgtaaatgctaacataatcctatttgtagttttgccaaaaactttcacaaattcaaaaaaatctgtgaggttttatgccagtattaaccatctgatattcaacagaatatcacttcctaacaaaagccatcctatagttgttgtagtctatgggtttatcccctactgttactttggagtaacataaggcgagtttgtggatagttattgaacattcaggatgtcaacaggcccttctccacagtgtgaagactctgaggcattatggaggctgacttgtggctggaaatttctaatatccaattcattcataaggtttttctcctatgtgtgttctctgatgtacaatgagatttgacttttgagagaaggttttcctgcatgtgttacattcatagggcttttcccctgtatgtgatctctgatgtttagcaaggtctgatttacggtaaaagatttttccacattcattacactgacaagatttctctcctgtgtgagccctgtgatgtactgtgagtgatgatttgtgactgaaggatttcccacattcattgcattcatagggtttctcccccgtgtgctttctctcatgtaaaataagtcctgacttcacacagaaagattttccacattcgttacatttataaggcttttcttgtgtatgggttctctgatgtacaattagagctgacttatggcagaaagcttttccacactcattacattcatagggtttctcccctatgtgaattctctgatgctgagtgagttgtgacttctggcagaaggtttttccacattcattacattcatagggtttctcccctgtatgtgttctattatgttttgttaggtatgatttattgtaaaagatttttccacattcatgacattcatagggtttctcccccgtgtgtgttctataatgttgagagagggttgacttatggctaaagaatttcccacattcaggacatgcaaagggtttctcccctgtgtgcgttctctgatgtattgtgaggtctgacttcaagcagaaggttttcccacattcataacattcataaggtttcaaccctgtatgaattatctgatgcctggtgagtactgacttgtggtagaaagttttcccacatgcattacattcataaggtttatctcctatgtgagttctctgatgctgtgtaagatgtgacttttgacaaaaggatttcccacactcaagacattcaaaaggtttctcacctgtgtgagttctctggtgtactgtaaggtgtgaattcatacagaaggattttccacattcataacattcatagggtttctgccctgtgtgtgttctctgatgtttagtgaggtcagatttctggtaaaaagttttcccacatgcattacactgatagggtttctcccctgtatgtgttctctggtgtaatgtgagggctgacttatggctaaaggctttcccacattcattgcattcaaaaggtttctcccctgtgtgtgatctctgatgtttagtgaggtttgacttctcccagaaagtttttccacattgattacattgaaagtgtttctctcctgtgtgcaccctctgatgtcgagtgagatgtgacttctcccagaaagctttcccacattcattacattcaaagtgtttctctcctttatcacctttctgaagctgtgacagacacaatttcctcctgaaattattcccactttcaccacaatcatagtgtttcacaggtaccccatcatgtttagaaagggtggacttcacacataagaacttctcacaatcactaaattcatagtgactgtcctttgatggaggtatctgatggaacaagagggatgaactatcacagaaagttctcccaaattcattatagtcacagttattctcttctgcattctctctcttccgtgtattgaatactgccttttcaaggagggtttcctgacatatactgtattcaaaattgtggtctaaagtttgaatcttctcatgctgcaaagtgttctcacgatgactcagagtgttcctatttttcaaaacttcatttttctctcgagtatgagtttcatcatgcttaatattgagtaacaatttcccacatgcattaaattcgtcagacttttttcctaaatagtttatcttactgataaccaattctgaaacagtgttgaaactcattccacgtgagtcatactgacagaacatttttctggaaggaaaagaacttacgtccatgttaaatggtattcctattacattaccttgttccttagtcagcatttcattattgatgaatacaacttcccacaaatgtttagattgattttcttggctcctctctttcaggtgatcagctgtccagacttctacaaacaaacaaaattaatcttaccatataaataccaaaacatctcttagggaatgaaatctctacacaaatgccctatgttgtagctgactctggttttttggccaatttccagagatgaacataattgcaagtgcatatttttttgtatttcatgagtttggagtgaaaaaacaaaaacaaaaaccagaaacaaaaggcctaggctagtggaaaaacagagaggaaattaactatctgaatgcacacacttggtttctaatgtaagaagaataatagcaactgcttacatctgcatttccccatgcatctccccaagaactataaaggtcagcataagtggagcaaataatattatctataacaacccatgactttagcataactaggagatggagaatattactcatttcaaatcaccactatgcaatagatattcaaatacagcaaaaagtgacagcccatgcctacaaagagagtcagccagagactgtggtgatcacatggaatagaggagacagacagcccagagaggatgaaacacaaaactactcccagaaagggaaagttttactatgagtgagaaaatgctcagaagatgtctgaattcacatagattaaagctcaggctactgggaaatccaagagaagagacttggattgtatgtaaactaaagaggcaaagggtaatcaaactcaggaatgaagttgtaaagaggacagagtaatcacagaaaataagacttgtaattcaagtcttattaaagacttattaaagacattccttattaaggaatctgtcatggactaaactgtgccccccaaaaatgtgtatgttaaaaccccaacctccagtgtgactgtatttgaagatggggactttaaggagattaactaaggtttaatggggtcataagggtaagactaatacaatggcattcatgtccttataagaagaggaggagactggaaagcacatgcatgaactctctttctccccctgcccaccacacccgaccactggtcatatgcacagagaaaaggctgtgtaaggacaccagaagaaaatgccatctgcaaaccaaggagtgagaactcaccagaaaccaacgctgttgtcaccttgactttagaattacagcttccacaattgtgagaaaatttatttaagctacccagtctgttgaattttgttacagcagcctgagtaaagtaaaaaagagccaaaggggaaactacacttgactgaaacttgaataaacagcattgtaaaggagaatgaaacagaaaaaagagaagaaacaataattttaaaagagtaagaaaaaagaaaattggatcagaaagaaagttctggataaagctggtctacaattaaataaataaaattataatatagtatatatgttattgcagtccttaaagaagaaaaaagaaaacaatggaataaatctaatattagaaagtataatctaagaaaactgtccaaaactaaaagacctgatccatgatggttcctattcaaaagaaccatcatgaacctgggaaaactgttcagcaacagttttctctaaaacatatcttaataaaactactagatgttaaaattgaagaaaaagtactctggacaaaaagaccaagtctcagcaaacttttactttgataatgagtcttgaaatcaggtaatgttatacatatgactcagcttttatttttcaaagttttagttattgtagttcctgtgtatttccacataaggtttagaattacatactcaattactacaagaaatcctgctaattactacatggaattatattattttaaatctataagtcattttaatgacaaaacatgtcagcaatattgagctttctgacataagcagggagttccacttgtttaggtcttcaatttctctctgcagtggattattgtttctagtgtggtctttcacatcttttgccagacatagctgtaaaaaaaaatttttgatactattgcaaatagaacttttaaaaattgcaatttccaattgatcatttcttatagaagattcatttttacatatttttctcctgtcacctagctacacttaataattctagtcattctttttcccatatcttgggagactccattagatttcctacgtagataatcatatcttttgtgaataaagacatttctacttcttttccactctagtctcctttctttttcttccttggttatactagatagcatatattatactatcaggtatgagtgtacatccttgtcatgtttctgatattggaaagaaatcattccatttttcacaattatatacaatgtcaattgtacattttctatagatgacttttattaaagaaagttatcttctattcttcatttgagagttttaatcagaaatggatgctaaattttgtcaaatgctttctcgcatatgttgaaatggtcatacgggtttgactttttttctctttttttcattttaatacagggcagagatgactacataattgatggggccagtgcaaaataaaaatgtgaggtcagttactcagaatgtataaaaagaagtatagtaaaaagtaaaataaattatgcttttttcctttaacatattttactacttgtaaaatgtaataggtataatagtaacataaaacaacataaatttacaaatcacaaaaaacagttttgttgtaataaactttaaataatacaataattactaatagtttgttaatatgataccttgattgatcataagattttctggcactctttttgcaaattcatttattaagtcatcgaaatttatatttttagcaacttcattttcaatatataattgaaagtaacatgtattcttggcaaatgcaagataagtaatttttgctaatttttaattttgagaaggttgatttttcagctgatgcaatcattagggacctgttggttctttatacattgtgacaatatgggctaaatttctgatttctgatatattactgcacaataaaagttaaaaaaatacaagttttggtatatatagacaaagactggagtagcacttctctgcaattaattcttcatgaatgttagttttgtacaaaactgaattcaattttacatataaatttatacaatggcattttaatgtttcctctgacatttcctacatcttgtacaagaaaccaaaaatggcttcatgatttgcatataattggaaacacctgtttatgcagtatattgctgtattttcaaatgcaaaaaaaaccctatttttaaagttgacttctttgttaatacttgattcatccaaaattttaaatgaaaataatgttctctcccatcaaatgaaattcctatttctaagcctgtggatatttgctttgcaatgttgcagcagttcttaacaccagagaatctacactccaaagaattctagtaactgcctagtgtgccttaacacaatgtccacaagtatgcttttattttctaatactttactgaccatgatgactgcctgaaagctggaggttactgtcccagtactcagcccagaaaattagtatttcctaagaatggcagagggacagacttaggggagagacaaaccagcctcacgctgtgggtcctctctgggttgcaaatgttcatgagtttgctgctgctgcaaccaatgcagacaaaggtcatggccttggccacccacacacaattccagaacactcccaggccatactacacagaccaacagcttagtagggcactgcctctcaagtatcctgtctacttgcacacatagtccagtgtccatcagacttcacatacaaatcacgagttcaaagataaaactgtgaagaacttcaagatggcaacagcagggcattaagtgaagtacaggatcccttcttacaagagtgtagcaacgtgtgactgcacaggtcacctagccatgaagttggccgagatacagggaattacactgactgcttttcaaatgttgaaaaagcctgccagggattaaccacacttggtcatgaggtattaataaccttgttatataccactggtttctaatcactagtgtttttgaatttatgttcatgaaggacactggtctacagctttctttccttgcaatgtctctgtctggttttgttattagggcaatgctggactcaaagaatgatttaggaagtattccctcttcttgaattttctggaaaagtctttataaattggtactattaattgtttgctggaattcactactgaagcatctagggacctggggttttctttgtggaaaggttatctatttgttttggagcaagccgtaatagctgtttatttgaatgaaactgttcatttcatcaaaatcgtcaaactgataatttacaggtatagtattccctcacttccttcataatatctatagaatcttcagtgatacatcattcttatttttgatattgataatctgttccacctagaagtttatccattttatcgatcttctcaatgaaacagcttttggtttcaccgattttctcaactgtttttctggttctacagattatattgttctccattttgttttttattatttcctttcttctactattatatggatttgtcttcttttctacattctcaaagtggaattagctaagaccattgatttagacctttcttcttatccaacacaagttaaacttcatacatgtgtatattacatatatacatatgtatattacatatatacatatgtataaatgcatacacatgaaattccctctatgtgaaatttacacattatatatttaatatatattacacataatacattatatcccatatatgacaaacgtcatatatgcatttacatattgtggaaacttcatatatgcatttacatatggtggatatatatgcacacaatacaaacacacacaatgcttatttgtgtcgcataagaaagatctcaaatcaatgacctcaggtgcttctaccttaaaaagctacaaaaaagcaaattaaacccaaaagtaagtagcaaaaaggactaaggatcaaaatggaaaacaatgaaatcaatgagtattgtatgtattttatatttcctatgaatttcctatatgtaaatttcccataaattccattttcattaacccaaagttcaaaacactttctaatttcctcttcgaattcttctttgaagcatccattacatagacttatattcagtttccaactattagggatttaatagatacttctgttattgatgtttaatttaactaaatttaaaccccttatggtgggagaaaatactctatatgacttcaatccttttatatttattaagatttgctttacaatcaggatgtgatttacctttgttaatatattcgttcatctgcccttgaaaagaatgtatattccactgttttatttggggaggagtgtgcagaagaatattttataaatgtcaattaagttatttagggttaagtctattatatctttgctccttttccatttcctgttttattaattattaaaaggatgctaaagcctctgattataactgtggatctatttctccttccagatctatcagattttgcttcaaatattttgcaaatctgttactaagtttaggattgttaaatcctcttgatgaaatgatctctatcaatatgaaaaaaaatctttatcactggtattcctggctctgaaagctacttcatctggctgtcacagcactgcagccttgtgaataattttaccattctacatcttttcccattctttttgtttatctatttgtctttgaatctaacatgtttcctttataggcagcatgattggatcttatttttatttatcttatccagaaatctctgcctttaaatggggtgttatataccatttatattttctgtgatcatcaatgtttataaaagctttaatcagtgtacttttcagtaacagtatatatatgaatcttccaatagtatatactttacttctttttcatagccttttcaggctgtgattgtcatgtattttcaatatatgttataaaccccacaatacatttgatgttatttttgtataaagtcaatatcctttttagagacttacataaagaaaaatatcttgtatacatatccaagtagtcaacatttcctgttcttcatccccctgagtagatccagatttccatcagacatcagaacatgtcttgtgatgcaggtctgctggagaggaaatctttcagctttgtttaactggaatgtccttatttcttcactgtttcttatagctatttttaccaagtatataactctacattgagatttttgcttttaaaaccaaaaataatgttctactattttctctgttgcctcatttaaggagaaatctgttatcatccttgcctttgttcctccataaaacatgtcctttatctctggctgctttgaggacttcattttaacactgatttagagcattctggttatgattcatgtggcttggtgtagttttcttcatgcctcttgtgctcagggtttgacgagcttcttagatcggtaggttcccaacacatttggaaattttttcattattctcaaaatactgttttctgttcttttcccactttccttttagagactccaattccatgtgtgttaagagactacctgaagtcctgaagttctcctaaagctcacatgggcttgtttttttttttttttttttttttttgagacacagtctcactgtcaccaggctggagtgcagtggtgcaatctcagcctcactgcaacttctgcctcccatgttcaggtgattctcctgcctcagcctcctgagtagctgggactacaggtgcctgccaccacacccggctaatttttgtatttttagtagagacagggttttgccacgttcgccaagatagtctggatcccttgatctcgtgatccacccaccttggcttctcaaagtgctgggattacaggcatgagccactgcaactggcccaagggcttgcttatttttcaaatatgctttttctctgtttcatttgtatggcttctattactgtgtttttaagttcaataatcttattcttctgcaatctttgaactgccattaattcttgctctatgtgatattcttttttttttttttttttttttggggggagacagggtctcactccatcacccaggctgcagtgcagaggtgcaatcttggctcactgaaacacccacctcccaaggctcaagtgatcctcccacctcagcctcccaagtagctaggacaacaggcatgcaccaccacacccagctaatttttttgttgtttcatttttggtacagatgaggtttcatcatgttgcccaggctggtctcgaactcctgagctcaggagatccacctgccttggcctcccaaagtgctggcattacaggtgtgagacaccaatgactggccatgtatttttcatctcaagcattatagttttcatttctggaaatctgatttctatcttttctgttacactgaattttgatttgtttttttttttttaatcttctgtgtctctacttaagttttagaacatatggaaccaaattatagcactgttttcaatgaacctgtcagttaattctaatatctatggcaattctgagtccatttcaatttcctggttagtctctttgagaaagctcatgttttcccatatgtctgtaagtctggaaatatttcaatggatggaagactgagagttttacttggttggatgctgggtacttttggcttcctataagtatttttgtgctttgttctaggatgcacttaagtcacttggaaacaatgtgacactttcaggtcttgcttttatgatttcttaggcaaatctggagcagtgctcagtttggggcacattactcctcaccacggagaaaagacctttctgaacactctacccaatactctgaattatgagtttttccacgctggctggcaggatcagtccttctccaggccctatgtgagtactgtgtactgttccctctgattcttttcaaaagttatttcactcatttcctcatatacatgagctgattagtactttgctgaacattcatggaggcccctttacagatctccaggcctctctctgtgtgcatctatctcctgcaagccaccagtgctcctcaacccccacagcttcaaattctaggaaagaactgccaaaaggccttgagccagcttcctccaccaccccaattaaaatatccagcccagtcatggcagtctgagaatagtggagtacaatgcctacctaggtcattgagaagagattccaaaagaaaccaagaagaccagagactactgccccaatccagatccctgatcataaagcacagtatcacccacccagagaaaagcaaaacactgctgtagcctccagatcccgaataatggagcaggactctcacctagggccagctgtaaggacagagagttccaaaactctcctccagaaaactcactttgttcagaacagagtttgggtgagtgcaagcctaagatcaccctcaaaaagaatggaaattcaatgataaccaattaagaagagggtagcagttctatgacagcaacaagctaaaccacagaccaactgaaagtttactggagagagcaagggaaagagatgcctaagaagagacatccagggcaattagatgtcttcctatctaccagaaacactcatacaaatacatacacagattttccacagtcatgatttttaaatttatgttttctaggaggtgactttcagaatggcaacataaaaagcaaactcaaagcctcaaagacagccctctagaaggaacccaaatttaacaagagcaaactaagagcaacatatggtccaggacagtgttgaaaacaatagagcaatatgtcagcaatcagtagcggctatcagcaaagtgtaacagcaacagaggcagacaggctaacacagcaatcacagaaagattcactcaaagagagcactgttaacaccactgccatgctaaagatagtgtgcatttctaaggcagggccctctgacaagcatcatcagtgagaacccaatgggagtgaaaaagcttctctcaaatagtagtcaagttgcctaaataaataagaaacaacaacaagccctagagagaatagaggaatcagtatctagagaaagtacaaagtattctctacaatgtctattcttcaacaaaaaaattacaacacatacaaagaaacaggagactgtcatctatatacaggaaaaatggcaggcaacagcaactgcccttgagaagatccagatatcagacttagctgacctcaaagcacttattttaaatatgttcaggccaggtgcagtggctcacgcctgtaatcccaatactttgggaggttgaggcaggtggatcacctgaggtcaggagttcaagaccaacctggccaacatggtaaaaccctgtctctactaaaaatacaaaaattagctgggtgtggtggccagcacttgtaatcccagctactctggaggctgaggcaagagaatggcttgaacctgggaggcagaggttgcagtgagctgacatcatgcctctgaactccagcctgggtgacacagcaagactgtatcaaaattaaaaataaaaataaaaataaatatgttcataaggaaacactatttagaaaagggaggtatgatgatgtctcatcaaacagaaaaatattagtaagaagacagaaaagaatacaatgaaaattctggattcaaaaattataactgcaatggaaaactcactagaatgactcaacaaaagacttggccaggtggggtggctcacgcctgtaatcccagcactctgggaggccaaggcaagcaaatcacctgacgtctaggagttcgagaccagcctgaccaacatggtgaaaccccggggtctctactaaaaatacaaaaaagttagctgagtgtggtagtgcacatacctataatcccagctactctggaggctgaggcaggagaatcgcttgaccccatgaggcagaggttgcagcgagatgagatagtgccactgcactccagcttgggcaacaagagtgaaatttcatctcaaaaaaaaaaaaagaaagaaaagagaggttgtagctggcaaaataatcagtaaacttgaagatggatcaatagagattaagtaatctgaagaacagagagaaataagagtgaggaaaaatgaagaaaccctcaaaaaatgaggaataccattaactacaccaatatattcataatagaagtaccagaaggaggggaaaaatatcaagtagcagaaaaaatattcaaacgaatggctatgctcaccttgcaacacatacactaaaactggaacaataccaagaagattagcacagtagctacacaagaaagacagagaagttcatgaagtgctgcattaaatttaaaaaaaaaaaaaaaaaaagaggccaaaaacttgcaaatctgttgacgaagagaaaatcctgaaagcatcaagagaaatacaactcctcacatgaagggaatgtcctaagattaacatatgacttctcttcagagacagtagaggccagaaggaggcaggatgacatattcagtgtactgaaaaaaaatttttgttaataacttgtcacctaaaatagcagaactatttgcaaaacagagggtgaaaatttaaaatcctcaaattaaaaaacaaatagaaaccaaaaaaacttgagaatccattgctagtagactaacaataaaagaaagaaaagaagttctttagggtgaaaacaagtgactccaaacactagatcaaatccacaattattgtgggtaaaggcaatgatacgagagagtaaaaaaggcacactttttctcctttcttttcctacccaatttaataagcaaatatgtataagtcaatgtttataattgtattgttggacctataacatatagaaatgcaatatatttaacaataaggcaggctaggcatggtggctcacgccagtaatcccaacactttgggaggctgaagcaggagaatcacttaaacccaggagttcaagatcagcttaggcaacatactgagaccctatctctaaaaaaaaatgtgtttaattacccgggcatagtggcacacacctatagtctcagctactcaggaggctgaggtgggagtattgtttgagtccaggaggttgaggctgcaatgagctgcgattctaccactgcactccagcctcaaggactcagagagaccctgtttcaaaaaaaagaaatacattgataaacaaggaaacaaataataaagcaaaaaaaaaaaaagaataaagcaaaaaaaataagcagagcagctgggtgtggtggctcatgcctgtaatcccagcacttcgggaggccaaggcgggcagatcatctgtggtcaggggttcgtgaccagcctagctaacatgatgaaaccccatctctactaaaaacacaaaaattagctgggtgtggtggcgcatgcctgtaatcctagcaactcgggaggctgagacagaagaatcacttgaacccaggagacaggggttacagtgagcccagatcgtgccactgcactccagcctgggcaacaaagcgagactccatctcagggggaaaaaaaataggtacagatctgtactggagtaaggaaattacactagatgttaagtctgaatccacacaaacaaatgaattaaagcagaaatgaagaataaggttagtataccaaactctacaaatagatacttcctatctttctttcagcttctttaaaagacatcaacacatgaacacagggaggggaacaacacacactggggcctattgaggggttgggggcaaggggaagaaacttaagaggatgggtcaaccaccatggcacacatatacctatgtaacaaacctccatgttctgcacatgtatcacagaacttaaagtaaaaaaaaaaaaaaaagacatcaaatgacataaagttacaattacaggttgagtatctcttatctgaaatgcttggcatcaaaagtgtttctgactttagagttttttccaaattttggaatatttacattatacttactggttgagcttcccaaatccagaaatctaaaatctgaaatgctccaacaagcatttcctttgagcatgttgagcatgttggcactcagtttcagattttggagcatttgagattttcagatttgggatgctcagcctgtataacaatgtattgttgggttttaaatatatatgcaatatatataaaaataacaaatggagaagaggaaatagagctatatataggtaatgtttctgtattttactagagttaaggtagtagaaatctgaagtagattttgataaggtaagatttattaggtaagttctagagcaaccactaggtaaataaattttcaaagagacatagtaattttaaaaattaaaacgttatactaaaatatattcatttcacgttgtgtacacataaacaaacatagagagtggaatgagagacactggagacttggaggggtggggaggtgggtgaaggataagaaattacctgatgggtgcaatgtatactattatgctgatggccacactaaaagcccagacttcatctctatgtgatatgtctgggtaacaaaactgcacttgtaccctcaaaacctataaaaataataaaatatattcatgtcatgtaaaagaaagcagaaataaaaggaatagagtatcaaaaaagcacgagaccgaaaacaaaaatggcagaggtaaatccaactacagatgctccttgacttatgatcaagttacatcctgataatagtcaaattagttgaaaatattgtttttccacttaaaatgggaacacattctagtaaagtcagaaaaaatagttaagttgaacctttgtaaatcctgaaaatacaaaggggtttcaaacccaataaacccattgaaaagttaaaaaatcataagtcaaaccattgtaagtcaggaaccatctgtatagcaataacgacaggaaaaagggaatgatttgaaaatccaatcaaaaagcaacaattctcaggttgttgaaagtgtgaaagtccaaacatgtgctatctataagagatagatacaaacaggttgaaaatttgaaaacagaaaaagatatatcaggcacatggcaccaataaggctggagtagctatcctaatatcacacaaaatacactttaacacaaaaattttactaaggataaagaggggaattttattaatataacaataaaagggtcaatcgataaaggagacataacaattctaagcatatatactactaacagagcctcaaagtacgcgtagcaaaaactgacagaattaaaagaaaaaatacacaagtctatgatactaattgcaaactgtaataacccattttcaataatggttaggacaactgggcacaatataaacatggaaacagaagatatagatgacactctaaagcaaccagatctaagagatatagacagaacattccacttgaaaacagtggaacaggtattctttaaaagtacacatgaaacattccccagaataaatttaaaacgattctctgaccacagtggaaattacaaatcagtaagacaaaggaattttgagaatgcacaaacatgcacaaattatataatacattccaaagttaaaaaaaaagtcaaagaagcaataagaaggcaaattagaaaaaatgctatgaggtaaaaatgaagacatactcaaacttatggaacacagataaagcaatgcttagagagagatttgtagctgtaataaccatattaaaaaagatctcaaatcaataaactaattttccaccttaaaacactggacaggagcagcaatacaaactcaaagcaagaagaaggcaggaaggaaagcagaaagattatagagtaaaaattagtgaactagagaacagaaaaatagcagattcctggaaaagatcaacaaaatatacaaacctctaattagactgacaatggaaaaaaaaaaaaagaagattcaaattactaaatgtagggattaacgatgtattactagtactcttacagaaataaaaataattacaaagaatggtatgaacaatgtatgtcaacaaattatttaacttcaacaaaatggaaaaatccataaaacaaaaacgactaaaaccaactcaagaagaaaaagaaaaatctgaaatgacctacacaagtaaaaagattgaagttgtaaatttaaaactcgccattacaggtgggatgcagtggctcatgcctgtaatcctacaactttgggaggccaaggcaggcagatcacttgaactcaggagtttgagaccagcccaggcaacatggtgaaaccccctctctataaaaaaattacaaaaaattagctgcatgtggtggcatatgcctgtagtcccagctacttgggaggctgaggtgggaaaattgcctgagcctgggaagtcaggctgcagtgagccatgactgcaccactgcactccagcctgggcaatatagtgaggctctgtctcaaaaaagacaaaaaacaaacaagaaaacttcccattacaaaaacaaaaacaaaacccaggtccatatggttcactggagaattttatcaaacatttaaaaagaagtatcaattactcaaaaactccaagaaaataagaagaaacacttgccagctcattctatgatcccattactaccctggtaccaaaatcagacatgaaaaaactacaaatgcatgtgtcatgattacagacctataaatcctcaacaaaatactagcaaatttcatctagtagtatataaaaaggattacatacaatgatcaaaggggatttatactagtaaggcaagtttggtttatcatttgaaaatcaactaatacatcacataagcagaaaagaaacaataaccacatgatcatctcagtatacagagaaaaagcatttaacacaatccaatgcccatcttctctataaaaacaatcaacaaaccaggaatacagttaaacttcctgagcctgattaaaggcatctacaaaaagtccaccactaacatcatactaaataatgaaaggtacaatgattttactctaagaacaaaaacaagataagaatgccttcttgccagttacacatcacacagcagattgtagtcaacacaagcaaggggaaggggaattcagattgaaaaaaaaaagtggaactatatgtatttgcagttgactgctcatgcatatagagaatcttaaagaatctactaaaacactattaaaactaataaaagagttcaacaatgttgtagggtgcaagttcactaacaacaaacaaatcataaatgaaattttaaaaagaattccggccaggcataatggctcaagcctgtaatcccagcactttggaatgccgaggtggctggatcacctgatgtcaggaggttgagaccagcccggccaacatggtgaaaccctgtctctactaaaaatacaaaaaagttagccaggcatgatggcatgtgcctgtagtcctagctacttgggaggctgagacagcagaatcgcttgaatcccagaagcagaggttgcagtgagccaagatcgcgccattgcactccaccctgggcaataagagcaaaactctgtttcaataaataaataaataagtaaattccatttacaatagcatcaaaaagaataaaatacttgtaactttaatcaaggaaatacagagcttgtagtctgaaaaccacaaaacaatgatggaagtaattaaagacagcctaaataaatggaaaggcactgaattgcattcatatggttaagatggcaataactgccaaattaatatctaaattcaacacaatccttaccaaaatcccatctgcctttttgaggaaactaacaagctggtctaaaatttcatgtggaaatttagggagctgaatataatcaaaacaatctttaaaaagaagtagaaagttagaagacatacacttctcaatttgaaaatttgctacaaaattacaataatcaagatggcatgatagtggcatagaggtaaacatgtgaaataaaattgagaattcataaataaacactacaatatattatgttcagttaattttcaacaatgatgccaagaaaacttaatgctgaaaaatcccctttttggctggtcgtggtagctcacgcctgtaatcctagcaatttgggaggctgaggcaggcagatcacaaggtcaggagttcgagcctggccaatatggtgaaatcccatctctactaaaaatacaaaaaaaattagccaagtgtggtggcacatgcctgtaatcctagctacttgggaggctgaggcaggagaaatgcttgaacctggggggcagaagttgcagtgagccaagatcatgccactgcactccagcctgggtgacggagtgagactccgtctcaaaaaaaaaagagaaaaaagaaaaatcaccttttcaagaaatgatgctgagacaactgaatatttgtatgaaaaacaaccaaaattattcctttcctcacaccatatacaaaaactaactgaaaatggatcacaggtctacatttaaaagccattacttaaagaaaatataggagtggatcttcatgccctagggatagacaaagcccttttagataaagtaccaaaaatacaagcaacaaaagaaaaaacaaattagacttcatggaatgaaaaactcttttgctaccaagtacaaagtaaagacaacaaaatgccaacccacaaatgggagaaaaatactggctaataatatatgtaattagcaacttgtacacagaatatgtaaaacactcttacaactcaacaataaaaggacacataacacaactacataatgaaaaaaggaattgatttttctctattaagcttctatcctccaacttggctataaagacttaacagttttgggagttctttagaattttctccttaggcaatcatgcctgtacaaacacagaaagttttatttcttcctttcccatctgtatgcctcttattttgttgtcttatggcattacctacaatttccaatgagatgttgagtaagagtgaagagacaggacatcttgtttccttatcttagggagaaagtatccagtgtctcaccactaagtatgatcttagcagtaggtttcctgcagattttttttttttatcaagttgaggaagttcttctctattcctagtttgctgagttttatcatgaatgggtgttgaatgcttcttgtccatcaattgacatgatacagttttcttctgtagcctgttgacgtggcaggttacagaagttgattttttttttttttttttttgagacagagtcttgctctgtcaccaagtctgaagtgcagtgatgcaatctcagctcactgcaacctctgcgttccaggttctaagcgattctcctgcctcagccttcagaggagctgggaatacaggcgtgcttcaccacgcccagcttatttggtatttttaatagagacagggttttaccacgttggccaggctggtctcgaactcctcacatcaggtgatccattcacctcagcatcccaaagtgctgggattacaggcgtaatccactgcacccagccagattaattgattttcaaactctgaccagccttgagtggtcatggcatctaattatttttataagatgttgtattctacttggatttttgcatctacattcataagggatattagtgtgcggtttttcttcttcacaaggtcttcatatgcttttaggattagagaaaaaatagccttttaaaaaagtgttaggaaggttccctttgcatctcttttctgaaagacactgtagagaactggtatatttcttccttaaatattgcacagaaatcaccaatgaaaccaaaagagtctgataatttattttctttctttcttttctgaaagctttatggattcaatttatttaactgatattggtccatttgaatggtttatttcttctgtgtaagtcttggcagtttgtgtatttcaaggaattacccatttcacctaagtcatgggttaagaagaagccaggaataaaggcatcctgtaccaaaaccatctaattgcattacaaatgcaaaaaatagtatcaatgaaggacccccttcaatgcaggaggaagtcttgaccttaattgctttggaaagagatagaagtctgtgagactaaaggcaggtctgcacataagtactatattttagttgataaaattataaaattattttccacatgggtatgattaacaattctggcagtgctatacatgtatacagggaaagaataatgaaggtaaatggaaggccaggcatggtggctctcacctttaatcccagcactttgggaggccgaggtgggtggactacctaaaagatcaggagttcgtgaccagcctgtacaacatggcaaaatcccatctctactaaaaacacaaaaattggctgggcatggtggtaagcacctgtagccccagctacttgggaagctgaagcaggagaaatacctgaacccaggaggcagaagttgccatgagccaagatcacaccactgcactccaacctgggtgacagagcgagactctctctcaaaaaaaaaaaaaaggaaagaaactaaatagatgatggatagttagagccagatttcttactgttgggtatggcaatttacactgaagcaagggaagaaagctaaaatgatccatgtggtaataaagagttgaaggtttaagtataaacacatgtttagcttaagagagatacagatggttacatgtagaactatataagtaagtatattacatggtttatgcacatgtgtgtttccctgttctgtcagctgagacagccacaccctactgctgtaagcacaccattagcccctatcttggtttctaataccattctcaaataaaaggaaacagggttacctgaagaaatggtgactgatttcagaaaggaaatatataagataagcctggaccatcttgcagtgacagaaagaaagtgctctaaaaaacaacagcaacaaaattcataaatctccacttcttacgtgtgagttgtgcagagtaacattgttccgatgtgtacaatatggaaaataggaagaagatgtaactttatagtggacaaactgtatgtttgccaagacatttaaggccaacatcaaaagtcataaaacatggtgacagtatgcatgcttgatataatgtgacaaaaaaggtactttactactgtggcctttttccccaaaatctataattccagtcttatcttgagaaaaacattagatacattccaataagtggaatttatatatacctcaccaggattcctccaaactgtcaaggtcatccaaaacaaggaaagtctgggaaaccaccatagccaagaggagcctaaagagacataacaactaaatgtaatatggtgccctggaagggatcctggaacaaagaaggacattaggtaaaaatcagcagacactaaataaaaatatggactttagtcaataatcatgtaccaatgttggttcaacagctgttgcaaacataccaccctaatatgttaataacagcagaaactgggttaatggcaattctctctactacctccccaatttttctgtaagtcatgaaataaagtgaatgttttaaatagacaaaggagatacataaatagccaacaggtgcataaaaagatgttcaacatcagtccgggagcagtggctcacacctgtaatcccagcactttaggaggccaaggcgggtggatcatgaggtcaggagttcaagaccagcctggccaacatggtgaaaccccatctccacaaaaaatacaaaaattagccaggcgtggtggtgggcacctgtaatcccagctactcaggaggctgaggcagagaattgcttgaacccaggagacagaggctgcagtgagctgagatcgtgccactgtaccccagcctgggcaacagagcgagattccatctcaaaaagaaaaaaaaaaagacattcaacatcattagccattaggaaatgcaaaaaaccacaatgagatacctctttacaactactggattggtataataaataataacaataatattaataaaaagtgttggcaaactggagaaactggaaaattcatgcattgctggcaggactgtaaagtactgtggctactatgagaaacaatcaggcagttcccaagaaagttaaacacagagacaccatataaccagcattctacttctaagtatatatctgaaatgactgaaaatacatgtccatgtgaaaacttatacatgaacaattacagcagaattattcataatagtcaagaagtagaactaaaaccaaatgtccatccactgacaaatggatacataaaatgtagtatacctatataccatgttatatggtaataaaaaacaagtgaaatattgatacatgctacaacatggatgaaccttgaatatgttatgctaagaaaaagcagccaggcagaaaaggtcacatgcagtcccatttttatgaaacatccagattaggcaaatccacacagacagaaaattcaattttggttgccaagggctacaggaaaggggaaagagaaagtaattgctaatggatattggctttgtttcagggatgatgacaatgttctaagaaacattgtcggctgggtgcagtgcctcacgcctataatcctggcactttgagaggcctatgcaggcagatcacttgaggtcaggagttccagaccagcctggccaacacagtgaaaccctgtctctactaaaaatacaaaaaattatctgggcatagtggtgcatgcctgcaatcccagctactcgggaggctgtggcaggagaatcgcttgaacccaggaggtggaagctgcagtgagccgagatcacgccactgcactccagcctgagagacaagagtaagattctgcctcaaaaaaacaattgtcggctgggtgcggtggcttacgcctgtaatctcagcactttgggaggctgaggtgcgtggataatctgaggtcaggagttttgagaccagcctggccaacatggtgaaaatataaaatcagctgggtgtgggggcatgcaactgtaatcccagctactcaggaggctgtgtaatcccagctactcaggagactaaggcaggagaattggcttgaatccgggaggcagaggttgcagtgagctgagaccatgccactgcactccagcctgggtgacagagtgaaactccatattaaaaaaaaataaaaaaatttgtcaggaaggttgcacaatcctgcaaatacactaacagtgattgatttatacacataaaattggtgaagagtacagtatgtgaattatatctcatataattctccagaaaattgtttcttatatacctgttttgtggtgtataaataacacaactgatatgcattgttcttacagccaaccacctcactaatttttttagtaatttaaatcacttctatgtaacatttacttttgcttgtacagataatcaaatcgtctgcacacaaaatgaaaatttgacttcccaacctttatgttttattatttttttcttgtctgtgtaatggacagtagatcctctatgtgattctgtaaaactggtgatacaagagatccagcatctctcatatagaaagtgtgctatgatttttcaacaaatagtgtacaatatgtttttgtccattacatttattttattttttgagatggagtctcgctctgtcgccaggctggagtgtcgtggcaccatttcggctcactgcaacctccgcctcccggattcaagcaattctcctgcctcagcctcctgagtagctgggactacaggtgcgcaccatcatgcccggctaattttttgtattttagtagagacggggtttcaccatgttggccaggatggtctccatctcctgacctcgtgatctgcacacctcagcctcccaaagtgctgggattacaggcatgaaccaacgcacccagcctgtctattatctttattaaagattaagaagctgaattatttatagttggtaagcaatttacaaaactttttatttgaagaaaattgttcattttttctctttttttttttttttttttttttttttttgaggcaaggtctcactctgtcacccaggctggagtcaaatggtgccatcacagcttactgcagccttgacctcctgggcttaagcgatcctcccacctcagcttcccaagtagctgggaccacaggcacgcaccaccacacctggctaatgtctttactttttgtagagatggggtttcaccatgttgcccaggttggtctcaaactcctgagctcaagtgatccacccaccttggcctcccaaagtgttgaaattacaggcatttgccaccgcacccagcctggaggcaattcttgaattgacatgcagctggaagaaataatgagaagattctgtatacccctcacccagttttctccatggtaacaatttgcagaactacagtccaatatcaaccaaaaactgacattgattcattcaatcaatcttattcagatttcacaagtttcacatgcattagttgtgtatatttagttctataaattttgccacaggtatagatttttgtgaaaatcacaacactggggatacagaacagtcccatcaccaggatcccacacatggtaactacagccatctcccaccctctctgccttcctaacgctggcaaccacgaatctgttctccatctctatgctgtcatttcaaaactgttacacaaataacagatcatgaggtattatgataaacagcctaactgcatttgtgataattggctaatagatttcaaatcccacccatctcccctcttaccctacatttgggcaagccaataataaagcctaggtggtccctccctcaatgccagtaggaaactgaaaccacacaaactccatcctttttgtgtgtgctcaccctaccccaaattcctaatgacaagcagccattcttctcccttctttctcaatccacatttagacctgcttaggagccttctctggtctccctagaaacctgtgtgtataagtaataaactcttttttacactcttgatatcattaccagttttgatacctaaaccaagcgtagggggcaggagggttcatcccaactctatggggtggaccagaacaaacatgtaaatttttgagattgggttttttaaaactcagcttaatctcttgagattcatccataatgttacatgtattagtcattcattccattttaatactgggtaacacttcatggtatggacacactacacattatttatccattcaagaacatctggattattcgggtttgggctatgacccataaaactgctataaaatttttttgatggaacattaagtttttatttctcaaggataaatgtctaacagtgtaactagtggttcacatgctaagtttgtttttagttttaaatggaactgacaaactattttctagaatgactgtagcattttacttaccatcaaaaatgtatgaataattcagtttctctaaatcttcaccagcacttgtattatcacttttataaggcaggtcaaataagagcatgataaaaacatctttcattatgacgtgtctgggtataagtctctttgcatttatcctcctatgagtttgctgagcttcttggatgaatatattagttttcttcaacaaattatgggcgtttctgcgaattcttcaaaaaatttttctttccctttctattctctcatattgatactcccgtttgtgtatgctggtgcacctaatgatatccgtttcccaaggttttgttcatttttcattattttactggctcttcctcaaattacacaatatacattgatctgcaccagacaacccagtttctgccaactaaaatggcagttattattgtgttgcctattgatagtcctgtgcatgggtcacatttttcctgtttctttgcatatctcattttgttgttgttctcgaatggacaactggtccattcacttaacagtgttgagtgacataatcaaatggtggagtacacagctcccaactgtccccacacagaaacaccaaaaaaaaaaaaagaactataaaaaccaaccttgttagaactctggaaaataattaaaggtttacagtaaccaagtgaatgctaaatcaggaaaaaggcgacttcaaatggtgggaaagttttgtggcatttttactttacaagagaccctcattaatatcaggagctcatatctccgcagaaatcaattgaaggcctgaagacagatggatgacatatataaattcctgaaagaaaaacactatcatctgagaattctctagctggtaaaactgtccttcaaaatgaaagagaaatgaagataatcccagataaacaaatgctgagtttgttactactaggcctgctatacagggaacactaaaaggtgtctttcaagatgaaataaaaagaaactagactcaaatctggaggaaaaaataaagacttccaataaagttaactatatagacaaatataaaagccagggtcattatgtttgctttgtaactccatttttttacttcctgcaggacttaaaagacaaatggataagaactaaatataaatttacattatgggcacacaatgtataaagacataatctgtgacaacataaaggggatgagtaaggtgctaggtagaagcaaggttttcatatgatattgaagttatgagggaatcaatttaaactagattgtcatgaatttagaaagtgaaagtaatcctcatgtttaattacaaagacaatatcttaaaaatgtacacagaaggaaatgagaagggaataatatataatataaaataataaaaatataaaaatcaggccaggtgtggtcggctcatgcctgtaatctcaagcactttgggaggccgaaatgggtggatcacttgaagccaggagttcaagacgagcctggccaacatggcaaaacaccatctctactaaagacacaaaaattagctgggtgtggtggcacgtgcctgtagtcccagctacttgggaggctgcggcatgagaattgcttgaacccaggaggaggaggttgcagtgaaccaagatcataccactacactctggcctgggcaacagagcaagactttggtcttgaaaaaaaaaaaaaaaaatgaaacacaaagaaggcagtaataaagggaatatgggaccaaagaaggtatacaatatacagaaaacaaaatgcaatatggcagaagtgtttccttgttggtgattactttaaatgataattgcttgaactcaccaatcagaagacagaggctggcagaatggatttgattgatttatttattttttagacagggtcttgctctgtcacccaggctggagtgcagtgacacaaacaggactcaatgcacccttgacttcctgggctcaagggatcctcctgcctcagcctcccaagtagctggaaccacagcgcacaccaccacacccaactatttttttttttttaattttttttgtagaaacggagtctcactttgtagaccaggctggtctccaaggcctgggctcaagagatcctcccaaagtgctgggattacaggtgtcaaccacccagcttcagaatagatttttttaaaatatgatcaaactacacattgtctaaaacaaactgacttaaaatccaaagacacaaataaattaaaactgaaaggctgataaaagatattccatgaaaatagccaccaaaagagaactggggtggctatactaatttcactcaaaatagattaagtcataagctgttacaagagacaaagaaggatactatatatgaataaagggtcgttccatcaataagatataaaaattataactatatatgtaccaagcagcatcctgaaacatgtaaagcaaacacagaatgcaagggagaaactgacagttcttacagttaatagttttagactgaggctgggcatggtagatagcacctgtaatcccagaggtttgggaagccaaggtggatcacttgatgccaggagtccaagaccagcatgagcaacatagtgagaccctgtttccaccaaaaaaaaaaaaaaaaaagatagctgggcatagtgggcatggtggtatacagctatagccccctcaggaggatgagtggggaggatcacttgagcctgggagttcgaggctacagtgagccataattgtgccactgcactccagtctgggcaacagagtgagactcttttaaaaaaaaaatacaaatgcaaatgaataaatgaatgaatgaatgatgcgtatgaatacagatacaaagctacacaaacacatacacacacacacaaataccagtaaaatatatttaatggtatattaagaggagtatacaccatgaccaagtgaccaagggggacttatcctggaaatgcctgtgtggttcaacataagaaaatcaatgtttttaaaaaaaaaaagaaaagaaaatgaatgtaatacacttcattaataaaacaagtaaaaaaaggacacgatcatctcagttgatgcagtaaaggcagttgacaaaatccaacccctttcaggacaaatacattcagaaaacacaaaacagaatagaacttcttcaacatgataaagggcacatatagaaaattcacagctttacatcatattcactgatgaaagaaagctttcctcttaacatcaggaagaagacaaaaatacccacttttgccagtgctatttaacactgcagtagaagttccagccaaacaagaaaaagaaagagaggcatccattgcaaaggaagacataaaactatgcctactcacaggtgacataatcctaaagatagatcataaagaaactacaagaaagatactatagctaatgaatgaattctgcaaagttgcaggatacatcaacacacaaaaatccgttgtgttgctacacacctgcaaagaacaatctgaaaagaaaattaagaaaacaattctacctatagcaccatctaaaagaataaaatactatctagaaataaagttaaccaagaaggtgcaagacttgtatactaaaaactacaaaatactgatgaaaaatattaaagaaggcataaataaaggaaacagtatctcatgttcacagtttgagagatgtcatatttttaaaaggctaataccatccaaaatgatctacagatttaacacaatccctatcaaaattccatcagcatttttaccaaaataaaaagctgatccttaaagtcacgtggaattataagggccctgaatagcgaaaacaatttttaaaaagaagaacaaagtcagaggactcaaaacgtccaatttcacaacttattagaaagctacaataatccaaacagtgggtcatgtcataggtgtagacatacagacaaacggaatacaagtgagagcccaaaaatacactgcctatggtcaactgatttttgacaagggcgtcaattctattcactgggagaaagaaaagccttttctttcagttaatgcaggccaaatattgtcacgctactgacatgagatacaacagtcatactcacagacaaaatagattagaggttaccacaggctggtgggaatgggaatgagtagttactgcttaatggtgatagagtttctgtttgaaatgatgacaaatgaccaaaaaaatgatgctgggttaactggatttccacatgaaaataaagttagaaaataaagttagatccctactttgactatacacaaaaatgaactgaaaataagagctaaaacaataaaatgtttagaagaaatgttcagaagaaaacataaggaaaactttgggtttggtgatggattcttaactatgacataaaatggataagcaacaaaagaaagagtaggtacggccgggtgcggtggctcacgcctgtaatcccagcactttgggaggtcaaggtgggtgatcacctgaggtcaggagttcaagacaagcctggccaacatggtgaaaccccgtctctactaaagccacaaaaattagctgggcactgtggcatgcgcctgtagtcccagctactcgggaagctgaggcaggagaatcacttgaacacaggaggcagaggctgtggtgagccgagatcgtgccactgcactctggcctgggtgacggtgagactctgtctcaaaaacaaatatctgtgtatatatacacattaaaaataattcagtggtaccccaaaaagctaaaagaaatacactttgataaaacaattctactcctaggtttatatccaaaagaaatgaaaacaggaactttgagcagataatgatataccagtgttcactgaagcattattcacaacagccaaaaggtgtacgacccaagtgtacatcaacagatgaatggattaaacagccagaaaagaaagtcttgatacttgttacaatacagatgaaagctgaaagcatcatgctaagtgaaataaggcagacacaaaaggccaaatgttgtcacactactgacatgaaatattcacaacattcaaaactcacagagacaaactagataagaggttaccataggctgttgggaggggggaatgagtagttactgcttaatggcaatacagtttctgtttgaaataatgcaaatgttttagaaattgtggttatggctatacaacattgtgagtgtaatgccactagactgtacacttaaaaactgttaaaatggcaaatttcatgttatatatattttactacacacaaaacaatatattgtcaaaatgctccagcatcatttgctgaatacctgactgaatttcttttgcatttttgtcaacagtttgtcaaatgtcttagcttcagctgccataacaaaataccagacagtatggcttaaacaacagaagtttatttcctcacggttccaaatgctggaagtctgagatcaggatgccagcatggccagggcctggtgagggcctcttcccagcttgcagttggccactgcatgttcacatcgcctttcctctacgcacatggagagtgaggaagctctcacttcctcttcctgtaaggcactaacctcatcgtgagggccccaccctcatgacctaatctaaccctaattacctcccaagggctccacatctccaaacaccaccacactagggttgagggctccaacatatgaattttggggagacatgaacatacagtctataacagcataatcaatgttgaagttttctattcttttccattgttctatgtgtatgttctatcaatgtgtatattcaaccaacatcctgtcctcttgattattatagctattaatatatacatacagtagtcactccttatccaagggcgatacattccaagacgcccagtggaagcctgaagcctcagatagtattgagccctataaatactgttttttcctaaatatacaaacctaagataaagtttaatttataacttagggacagggagagattaacaacatcataaaatagaaaagttataacaatatgctggcatcgctactcttgcactttagggccattattaagtaaaataagggttacttggacacatatagtgacagtaaataatcaagacaattactaagtaattaactcatgggtagcatatacagcctgggtatgctggacacagggttgattcatgtcctggaacaggacagtgcaaaatttcatcatgctactcacaacagtgtgcaatttaaaacttaggcattacttatttctgaagtttcctatttaatatttttgaaccacagttgacctcaggtaacagaaactgcagaaagcaaaaccacagaaaaggggagactaatgtaataagccttaacactggatacaataattcctcctactattctttttctcaaaacttctgagaaaaaatttctcaaaattgtttcatattttatatatatatatatatatatatggttcctttgaccatttatggaaattttggaataagcttatttaaagctgagaaaaaccttactggaatcttgacaggaatgccattaaactgtaggtcaatttggagagaactggcctacttacaaagttgagtttcccaatctatcaagagaccacgtatcttcatttatttcagtgttcttttatttctttcatcagaattttgtaattttcagcacaaaggtcctatacatattttgttcaatttataacaaagtatttaattttctatggaataagtggtattatgtttttaatttagatttgtatatgttcattgttagtggaaagaaattgattatatgtgttcatcttggatcctgaaactttttggaaatcattcattcattctgggaggttttcattttgttttcttttctttttttttgtttttgagacggagtttcactcttgttgcccaggctggcgtgcaatggtgtgagctcggctcatcacaatctccgcctcctgggttcaagcaattctcctgcctcccaagtagctgggattactggcatgcgccaccacacccagctaattttgtatttttagtagagatggggtttctccatattggtcaggctgctcttaaactcctgacctcaggtgatccactcgccacggcctcccaaagtactgggattataggcatgagccaccaggcctggcctgaggtttttattttctaagattccttgtaatattctacatatacagtcatgtcatgtgtaaatgtaaacagttttatttcttctctatgtgtatgccttctctttcattttcttgcctcattgtgcttgaaagaagttacagtactacaatgaataagagtggtgagagcaaacatccttgccttgttcccagttttacagagaaaacatttcatcttaccagcaaatatatctgctatagatattttgtgcatgttcatttatcaaactgaggaagatcctcttaatgtcttgtatagagattttttatcatggatgcatactgcattttgtcaaatgctttctctatattaactgatgttatatcatttttcttctttagcctatggtgggttaattacattgattgatttctgaatgttgaaccaggcttgcttgtataactcaagtaaatcccacttgtttatagtgtatactttttacatgactattttctatttgctagtgttttggtaaagatttttgctactaaatgtatggggagtataggtctgtagttttattatttttgtactgtctgtatggttttgacatcaaaataattttttaaatgtgttaagaaatgttccctcttggccaggcgcagtggctcatgcctgtaatcccagcacttcgggaggctgaggtgggcggaccacaaggtcaggagtttgaaaccagcctggccaataaggtgaaacaccgtctttactaaaaatacaaaaattagccgagcatggtcgcatgcgcctgtagtcacagctactcaggaagctgaagcaggataatcacttgaacctgggaggcagaggttgcagtgagccgagattgcaccactgcactccagcctgggtgacaaaacaagactccatctaaataaataaataaataaataaataaataaataaataaaataaagaaatgttcctgcttctattttttgaggacattgtgtaaaatcatcattaattcttgtgtaaatgtttggtagaattctctagtgagaacaactctctagtacacagaaattggttttttggaggttttttatttaaaatttaaagtatttgattcaaattaagtcaacttttatgaaaacctatgggtcattcaaattatctatatcaccctaattgagttgtaatagtttttggtttctgaaaaactgctacatttcttctatgttgtcatttttctttttttttttggagacagagttttgctctgttgcccaggctagaatgcaatggtgcaatctcagctcactgcaacctcccactccctgggttcaagccattctcctgcctcagcctcctgagtagctgggattacaggcgtgcaccaccacaccaggctaatttttgtatttttagaagagacggagtttcaccatgttggccagggtggttgcaaactcttgacctcaggtgatccgcctgccttggcctcccaaagccctgggataacaggcatgagccaccacacctggcctatgttgtcatatttatgaacataaagttgttgacaagattcccttattatactgttaaatggatggtggagtgatattccctgtttcattccagatattgatgatttgtcatctcattttatatttttaatcaatattgctagatgtttaccaattttattcttttccacagaaccctatgtttcattagttttctctactttttcctattttcaattttactgatttctgcttccagtgttattttcttccttctacttaacagaggttttattttgctctttgctagtttcttaaggtagaaagtcaattatgggtttgcaacctatcatcttctctaatgttagcatttggcactataaatttctctatcagcactgctttagctacctcccacatatattgatatggtatggtctcattttcattaagtctatgcatttctactattaaatttgaggccccttcttcactccagatgttatttagaagtctgatgtttaatttctaaattattatatatttccctattgtcattctattactgatttgtagtttggtttcattatggccagaaaacatacatactcagaatgatttcaattcttttaaatctgccaaggcttatttatggcccaggatatggtctatctttctgaatattccatggacacttgagaaaaaaattgtattttgctgttgttgggcactattctttttccttttttttgagacagaatctcactctgtaacccaagttacagtgtagtagcacaatcttggctcactggaacctttgcctcccagttcaagagattctcctgcctcagtttcctaagtaggtgggactacaggcatgcgccaccatgcctggctaatttttgtatttttagtagagacaggatttcaccatattatccaggctactcttgaactcctgacctcaagcaatctgcccgcctcggcttctcaaagtgctggaattacaggcgtgagacaccgcacctggccttgttgagcactattctataatgatgcttcagtcctgttggctgatgttgctgtcctgttcttctatatctgctagtaatcatatggctagtaattctatcaattgctaagagggaagtgatgaattttccaactacaattaaaatgtgcttttctcttttcaactcaatcagttttgttttgtgtactttgaggtttgctagagacacatttaggatcattgcatttttgttggattgatccttttatcattatataatgttctttttgtctaatagttttctttgctctttgctctagagtctactgtattttgtttttgattaatgtttgtacagtttatctttttatatactttatcaacctatgttgttcactatgagtttcctaagaaaacatttttaggatgggtggagcaagatggtggaatagagaacgccaccgatcatacacactcccccgcaggaagactaacattggcaactatctacacaaaataagcagtttcacaggaaccaaaagtcaggtgagcacttacagagcatggttttcacttcatatggctgaaagagaacagtttggaagttcctgaaaaaactaaaagtagagctatcatataatccagcaatcccactcctagatatatacccaaaagaaaagaaatcagaacatcaatgagatatctctgctcccatgtttactgcagcactgttcacaagagctaagatttggaatcaactgaagtgtccattcacagataaatagataaagaaaatgtggtacatatacacaatggagtaccattcacccataaaaaagaatgagagatcctgtcatatgcaacaacctagacagaaatggaggcacagaatgttaaaattttgcatgttctcacttatttgtgaaaggtaaaaattaaaacaactgaactcatggagatgaggtagaaagtaaaaggacagtaactagaggctgggaaaggtggtggggtggggttgggggaaggtgaggatggttaaagggtacaaaaaaatagttagaaagaatgaataagacctaatatttgctagcccaacagggtgactacagtcaaaaataatttaattgtacattttaaagtgactaaaagagtgtaactggattgtttataacacaaaagataaatacttgagggaatagatacccaatttaccctaatgtgattattacacgttgtgtgcctgtatcaaaacatctcctgtaccccaaaaataaatacacctactatgtactcacaaaaattaaaaattttagatcatgttttatgttttttccactctgccaatttatattttaattagtgtactttgattatttacatttaaggtaaatattgctctgttaggctgctatttgttttcttttctgttttctattcatctgttccttttttcttattttctgattagttacctaaatattattttagattccatctgggtttatttatagtgtttctaagtgtaccacattttatagttttctcagtagttgttctaggtattaaaatgtacatatgtaagttatcacagtctatcaagcattttaccacttcaagtgaaatgtaccaagtttcattccacttaggcccctttaccctccccacttttaaaatataattgtcttaagtgtttcccctacatacagagcattttgctccaaccatcaaaaatgattctagaaactcacgagaaaaatatatttatccccatttttgccaacctccaatcttctttctttcctgcatcccaagccttcttgttatttcctttctatttagagaacttttagtcaatttttaaaggtaggtttgctagcaacattttctcttagcttccctatctaataatgcctttagttcccctttattcatgaatatagtttcaaaagatacagaatttttatttaatagtgctttcccctcagtacttgagaaaatatactacttcctgcctgccaccacagtttcagaagagaaacccacagtcattccctgcagggaatgtgttgtttctctctggctactttgaaattttttttgtctttagttttcaaaaatttaattatagtgtgagtttgccatggacttaacttattggatgttacttcagactcgggaatgtgcagttttatatcttttgctaaatttgagaaggaccagccattacttcttcatatactttaaacacctccttcacttccttctgatgttacaaatgttagttcttttgttattgccccactttccaaatactgaaagaatcaaacctcatcccattccctcctgccttccggctttgtctaagctaccacaatcactcataaggaaaactaccacaggactttaatgagctctctatgccctatgccctgcccaatattttctctacagaggtgagaaagatcttacagagatataaatcagatgttgctcatctgctgaaaatctaccactaaacagattttaaccaaataaggcttatgataggctcacctttggactctagctgcctccctcacctcacctcctgcccttcctccaatcaagccctcccttcagccactgtgactttttggtcattcctgaaaaccaccaagcacattcctgtccaaggctagcagctgctattacccctgctgaaaagaggcagaatcctcatggctcacacagtcatttcattcaaatttctactctaatgttgacctcagtaaggtttcccctgactgttccttaaagtaatctaaacttgctttaatttctttcatagtctttaaaaccacagaacacttaatatacataaacataagtatacataatatacttagagacataattttgttttttttttatatttatttacttatttttgagacagagtctcgctctgtcgcccaggctagagtgcagtggtgcaatctcagctcactgcaacctctgccttctgggttcaagtgattctcctgcctcagcctcccaagtagctgggattacaggcacctgccaccacgcccagctaattttgtatttttagtacagatggagtttcaccatgttggctaggctgttctcaaactcctgacctcaagtgatctgctcacctcgacctgtgctgggattacaggtgtgagctaccatgcctggcctaatttttttcattatcatatcctcagcacacaccaagtgctcaaaaattatttgctgagtttaaaaatgagtgaataaaaaattctgacagaagaataaacacaaaacaatggaggttaaggtgggacactgaaagtgctttgagaaaaataaccaagaaaaacaacagtaaagttgaggtgggcaaagactgaactattggcaggtgtaagaatggtaaaccttcaaaaaatgattctaaaaggaaaaattttttgtgagtagtatctggaggtttgatttagcaatcagtattctccatcacttccagaggttaggacccctatggagatgttcttgaaaaatgttccaaagttgccaaaccctgaattaactactgggaaacaacaaatcccctgatgtgaatctgtgcagtacatattaacccacctggaaagctctggcttgggaattcttcctccagtctccatggttcttctccttgttccagcctgaagatcacctctggtttgtgagcacaataccctgttaacaggaaataatttaggatttggaccaagcagtctagacttcaggcctttgaagcaggaagaagcttctggggctgcttcaagttgccagtggaacattttcactggagaggtgaacacaagtatcttctggtgctcaatcaacactgactcctgaagcctaacctaagcctaaataatgtcattaaactagacagactgcctatatgttttataatcaaaataaacgaatgctatttagaatgatacagtgaacagaccttacccactgagacaaggttgctgtagttctccagcatcacatctctatacagagccctctgactagggtccaggtgctgccactcctcctgggtgaagcccacagtcacatctttaaatgatactgacccctggaacttctgatctacctgaaatgttcagaattaggtggcatgaaaaaagaagtatgggctaatccttaccatgattattattcacagaatatttgttttgctttatacttttagggaaaaaagaaatcataacagaaatattctgccattaatgcattaagatattaattcatgcaaaaaaattatcaagttcccacaatgtacctggaactatcatcactcctggcaacactaagattaataaaaatcttcctgtgttcaaagaacacacagagtggtaagaaaatatacatggtaacatgttgcaagtactaaggtgaaagtacaaacccaacagactaacgttaggagcaaagttagctctgctttgagtttcactgaggaagtatagctgttggttgaattatgaagaacactctattacgtccttcataagcacggggccatgatacaagcaaaggtgagggcctccaacacactgcagacatcaacaaaagggcagacagcacaggaaatggcctgctgctgtcttgagaagaaaagccaaggaaatgggttacagagtaattttacaccaatggtctctaaagtatttgatcatttaccattttcaagaatattactgagaactacagatttatatttacaaatcacagaaataaattgtcagtacatttattatgaattctaatttaattctcatttagatttaaaaatgtagaaagcctgacattttcttcatcgcagtacatattctgggttctaatcctttaattcaaagacaataatagggatgtgtagaaaatggaaagatcttggaactattatacttgaaacctctgtggagtacataggagaagacatccagttggattgttctggatatcctctagggcacatcttttagggatcactgctgtgaaaaagggagagccaaagatgagatgtgagcatatactgcaattatgtgaccaggttttgtttacagaaccaattctattgagaacagcaaaggacaaaacaacatttacataaactactgtagaagaaaccaggatgcaaatagggcatgaataataggagacagagcatcaaaatgtggtcactaattcattaagaaaaaaaatgtttcctctggctatccccatgaacagctgctcagatactagggccacaatgtaaaccaggaaagttagggcaaaataggttggacacggtattctagcaagaaatgtcctaaatatattaaatttgaagcacaggctgggtgcagtgcctcacgcctgtaatctcagcactttgggaggccgaggcgggtggatcacctgaggacaggagttcgagaccagcctgaccaaaatggtgaaacctcatctctactaaaaatacaaaaaattagccaggcgtggtggcaggcacctgtaatcccagctactcaggaggctgagacaggagaatccctttaacctgggaggcagacattgcagtcagccgaggtcggcaccactgcactccagcctgggtaacaagagcaaaactccatctcaaaaaaaaaaaaaatgaagcataatatgaagatcaagaatgaaacaaggactacagagacatttataatacagtggtgctcaaagccatcaagagaaaatcagaaggatgtcagaaaactggggaaagaaaataatcaagaatggaatcagaggctaagcacagtggctcacatctgtaatcctagtactttgggaggtaaaggcaggcagctcacttgaggtcaggagttcaagactagcctggccaacatggagaagccctgtctctactaaaaatacaaaaaaattagccaggcgtgggggcaggtgcctgtaatcccagttgctggagaggctgagacaggagaatcactcgaacccaggaggtggaggttgcagtgagctaagatcgcaccactgcactgcagcctgggcaactctgtctcaaaaaaaaaggtaagaaattcctcccaaatttatatataggttcaattcaaccccaaagaaagtctcagcaagttattttaagaatactaacaatatttgtatggaaatgcaaggaactaggaagagccaggatttgctgaagaaaaaatgtgttaaacccactactagacactaagatgtttcaccaagtgaggtactggcacaaccaaccaacagaacacagtccaaaaaaacacacagacatatatgtacacataattgatgaaaatatcacaatgtaaaactggggaaaggatggtgttttcaaaaataattctacactaactgtatgaaaaacaggaatctgacatccacctcatacaaaagtagacacccattccaatgaaagagaggtaaatgtgaatgccaaaacaataaatattttaaaagataacaaaagagattatcttcatgacctcaaagtaggtaaagtcatctaaaatagcacacaccatcaacaaataaacttaataaactaatctagggattggtaaactttttctgtaaaaaatcagacattaaatatttagccaggcatggtggctcacacctgtaatcccagcattttgggaagccaaggcaggcgaatcacttgaggccaggagtttgagaccagcctggccaagtgaaaccccatctctattaaaatacaaaattagccaggtgtgatggcatgtgcctgtaatttcagctactggggaggcttagccaggagaatccctggagccctgaaggcagaggctgcagtgagccaagatcgcaccactgcactctagcctgagtgacagagtgagacattctccaaaaaaaaaaaaaaaaatcagacatcattatatttggggctttgcaggccaaaaggttcctgtcacaattagtcaactctgccactgaagccacagattaaatgtaaatgagtgaatgagcagggaggtgtcaggattgtgagggggacaagacggcagctgcaggagggctggcaatgttttttttgacgtatgtattcattatttgcgccatggatttgtaataattcattaagttctatatttaaaatgtaggggtttttccatctatctgctacacatgtagaaataagattcattaaaaattaaaatatgtaatcccagcactttgggaggccgaggcaggcagatcatgaagtcaggagactgagaccagcctggccaacatggtgaaaccctgtctctactaaaaatacaaaaattagctgggcatggtggcgcatgcctataattccagctacttgggaggctgaggcaggagaatcacttgaaccagggaatcggaggttgcagtgagccgagattgcatcactgtgctacagcctggcgacagagcaagactctgtatccaaaaaaaaaaaaaaaaattaaaatacactttaatttattggccgggcacagtggctcacgcctgtaatcccagcactttgggaggccgaggagggcagatcacgacgtcaagatatcgagatcatcctggccaacatggtgaaaccccgtctctactaaatctacaaaaattagccaggtatggtggtgcacgcctgtagtcccagctactcgggaggctgaggcaagagaattgcttgaacccaggaggcagaagtttcagtgagccaagatcgtgccactgtactccagccaggcaacagagcgagactctgtctcaaaaaaataaaaaaataaaaaatttaaaattaaaatacattttaacttactgatcaaacagtacatccaaaagaaaattggaacctgtataaaataaaaattaaaaaagcagtttgactcaataggctgcactcatttcagggctaacactggaaggttattcactatgggtccctatgttataaccaaaaaaggtatctgccaggaagtctttgtgtcttcagaggagtcagtttgtctgtatccatatccagtgtcttcctttctgccatggttgttggaaacataagaaacacatgaagctcaacttattgactctaacttggccctgctattgatctgttactttatattttctgggaagttcaatttttatctattactaatttctcatcttaacatattgactcttggccaggcacggtggctcacacttgtaatcccaacactttgggaggccgaggcgggcggattgcctgagctcaggagtttgcgaccagccagggcaacacggtgaacacatctctattaaaatgcaaaaaattagccaggcgtggcggcctgcgcctgtagtcccagccaatcgggaggctgaggcaggtgaattgcttgaacccaggaggcagaggttgcaaggttgcagtgaacagagatggagacactgcgctccagcctgggcgacagagcgagactccatgtcacaaacaaaacaaaacaaaaaaaccatactgactcttacaaatctcacaaagtccaccgcaaaataaagtagggaattaataaacaacttaccttgttcattttgttctgttcttggaaagacggagacaactctgaagatacagctgagttggaaaaagaggaatggggtcatgaaagatttggcctgcctggcaactcccggattcttctgccctaagaagccatacacacccactaggtaaaatgctccgtctgggagaatatcaatgtcctctgacacttcggaatagggggtagaaatggtgaaagaacaccctaatacaactccaacataaccatgtagctcttgggcacaagatttttcatcaggtgaaagtaaatatttgcttcctaaggatttcaatctccctcagtcttcacaaaaaatgtataatgacaatattggccaaacaagttaacaatacatttaatgaaaaaacattaacactaaaaccattgtaaagaataggactaggctatcgattttcccagtaatgttacttaacctctgatgagttagtccacagaaaaccataagcgtcagtgcttcaaagaaaaaatccgttttaatttcttcatctaactttgttgctatttctcaaaaggatgttttaaacttgctttgatgtgtgtagaaaagtagtactggcttaggggtcaggagaagtgacttttagttctccctactaacaaactttgatcctgaacaagtcagtaaccttgacaaacaaaaaacaaaaaaattattttttcttctaacaaatgaggcaaaattaggtaattctggttttttgtttgtttgtttgtttttgagacggagtttcgttcttgttgcccagtctggagtgcaatggtgcaatctcagctacctgcaacctccgcctcccgggttcaagcatttctctgcctcagtagctgggattacagtcataggccaccacgcatggctacttttagtatttttagtagagacggggatttgccatgttggtcaggctggtctcgaattcctgacctcaggtgatccaccctcctcggcctcccaaagtgcaggattacaggagagagccaccgcgctaggccaaaattatgtaattcttgaagatccttcctgagtgcaagatcaagttaggacagaggaacagcaaataacaagatggggtgatggacatgactggagggcagttcgaaacctaaagaggatgaacgcagaacgggcaacagagtccgtatgtcgggcgggcgactgcacccgccctttcctacccaggtagggccgcgccctagcacatgggcgtaaacacgctcaaccagagaactgcccctcccgcaaggctcagcgctcggaccgcgcaagcgcacatgccctcctccgcggcccctacaaacagggcaacgcacagggcgtagcccgctccctacagaggctgcgccttagaggaactggcgtagcgtcctggtagacatgctgcagccccgccgtccccggcttctccgtgaggtccccgggactcctcgccaccacctggcactggcccccggctgcctgctcctggagtcgcgcggggccccctctccgtccctgcccaacccgcggaggcttacctcactctctcttcgggttgcattcgccataagagagccggtagacccctgaaatcccgggaccgcctccc

SEQ ID NO: 1573 - DNA, 340476 bp, Homo sapiens
catggggctgcagcccctggagttcagcgactgctacctcgacagcccgtggttccgggagaggatccgcgctcacgaagcggaactcgagaggaccaacaagttcatcaaagagctcattaaggacgggaagaacctcatcgctgcgacgaaaagtaagcggggacgcgggcgcggacgggctgcggcgtggcgaggcggctgggggagcctctctcggcaggagacggagggtcttgtgtccggggccagcagccagaggaacggggaattcattccggaccagcccagctctctcggaaccccggggggtccctggaatcattcctcctcgaggcagcgcggcgagtccccattcccgcccctgcggctctgcggcggcgggaaccagctgccagcgggccccgcctgggccccgcctggccccggccgaacacccctcgctgaatgcgcgctccgctggaccgaccctaggcactcctggcccggagtcaggtttcattgctgcctaaagctactcacaatctcttacaaaaccgaggcatctgtttgcctagttttgttttgtgacttctcaaaagaaatttcttggggattctttgaaaccctgcgggagtgttgagttttccagagtccccttaagcttcaccttttccctctcattgtctgatcttccccgacagtcctgttccaggtccttcacgtgccaaaccagaaagtccacctggctttatgctgcttccgcacattcctcccctgccgtgctgaggagggttcaaagattggggtttggaagggtgagcggacagcctgccctctagcctaggcgggcactgcttgcaaatagggaattccaccccggttaggcttggtgccttcctcccctgaacttctgtctcttaaactcggaagaagacacgagatacaggagagataactgtattttagtgtagttgaggagagtctttctaggagagaaggggccaaaattcatgcagaaatactgagttagtgatgctactggaaaatggggcggaattagccccagtgaggagctgggcagcctgaccatcccttggatccataaccccttcggaggatggcggtgaatgtcccctttccccctttaaaagacctgtccatacagcagacagggacttgggcagtatccagccttgaggggctgggttcttagggccttcatcactcacctagattctcagttcagtaattctcagccttaggtattcgtcccttgtacatttgtttgtagataccacctctggggaaaatcccccatctcactgttctcccgaccgcgccccgccccatttttcagtaagggcgattaaaacatattgattatactgtctcgggcacccagcatggtgcctggtacagtaaatatgcatttaatgaataagttgaagtacatttctgtgggaagaatttagtgagccatccctgtaattttggaggcaagtcactcaacttctctggatgatctccaaggttccttttggttctctgacctctttggtgttgcaaaatcaggactgggactcacttagggtttttttgttttgtttttaagtctctgctgcttgaatcagaaatgggactctgggacatgtgacaagtgggcttatttggttgagggctctccaggcccttggcatctggtatgtgtgttgggtgggaagtaggggggcgcctatacatatggaggagtgagcatagaaaggaggagttgggagcgggggtgcagagtgaacacgagagaatgaggactgaggactctttctgtaacttgatgttaaccagagtcagtggccgggagaatgtaccttctctctcattggttgtagtagttccctctggagctagagaggtgtggagagaggcagagggcaaagccagtttggccactggtagaaagctatttctgtgacagcatattagctttcctgccatcaggacacatgcgttaggttccagcagcagccagtgcatctggggggccagatgtcagctttcctccagactgtagactttcttgaatttgtgaattagtatcttactcattttgattctcgtcctttagcataagaaacataacttgtaatcatgctttgagagtaattgggaagtgtctttttttctcgttatgttcattaagaatttatgtttaaattctttcccagaaggtgacaggaacacagctgtagctcacatgccttttcccgcttgctccataaagtttacttctagttcctatcaaagactaagagccttggactaaagtcaggggacctgaatttaattcttcttcactggttagggcgtggctataggaaaattgagcaggtcttattcttttgcgtccaacttcccctgtctacctcttaggggaactaataaggttctgcagcatttgaaaatggcttgatgaggttatttgaaactgcagtctaggtaaatggttcatctaaccagttgagcttttgtataacatcagagagtcaagggatgacattgggtggaggatctacagaaagaataaaacccactaggtcagattatttatatttccagatattttatattttattttacaaaaatgaccttttgagcatttcgagaagtgtgtatttaagtgatttctatttttaattgccctgcacggtgtctcctgtttgcattacattcttggaagatttcaatatgtaattttgatggcttgatgctttgaagtcttccataaatatttagagttttgaggcctatgcgacctgaaggcttactgctgaattcaattaggtagcaatctgcaaatatttagcacctataatttgctaaatactggaattagatacggatttataatggggtagaggcccttgcccttgagtttactgtcctgtagttgaaattacttcaatctaaggaacatttttgaactccttcctgcactgtgctaaattcttgaagaaacaaaggatatagacacatacctgtgacaaggttaaacatttagtgacaagtattctaacttttccagggacaagggtttgtatgttagagtggaggaggtttgtgaaagttttggaactcactggtgataaggagtagaaccttatcatattggaaaccagaagaaaccagaacactcgagtgtttgaagagactagtttggctggaatggtggtttttcagggagtagtagactgggatggatggagaggtcagttttagattatggagggccataaaaacaaggttaggaatgtggactttatcttgtggagagttactgaaggcttttcagcagaaggctgacataatagcaaagagatggtttagagacagtatcgcacatttgtgtgtagggtgaagttggggatagcgctaggggtggggaggaactccagagagaagagccagtcattttagtggtggatttggagattattcactcaattcaatgaattctttgttcaaatggcttttttagttttctttttaaagtactttcttttcttaaaataaccagtgtcttctttaaatgcagtttaaacttttgtaagccttcgtgatgtctatgtagtttcagttgcttatgattcatacaggtagatagcacagttgccagaaacagcaataaaccatatatgcttttctcataaattttacgttaggcagtcttgagaaaatgtatcttgttctttagagaaaattttttaaaactaacagtccttacagttattaagcactaatacagtgatataaaatgctctgtagtgaacttaaattgtctagctgtgtgtgtgtgtgtgtgtgtgtgtgtgtgtgtgaagctaaaggggccctcattaatgagtctgctgttactaaacatgcatggaaaaggatgtaaagggccttgttagtggcagagcctggacaagaatttaggtcttccgacttggttttggtacttctagccttggcattttaatggtttttgctttgttcctcttaggaaaaacataaaagttctctttggctgtctttatgtttactgtttcagagaaatattcttttggggaaatttcttaagttgccattacattaaacccactgagatttggaagactaaaaataattttcctattttgtaaacttgagccttggtttcctttttttttgtaaaatgggactgatacagaaagccttgaggaataaataaaatggtgtgaaagtgttttgaaacacaaatgtaaaatggttgtgtagacactactgctggttcagccaacattccttttcccctctgacaatccagatttcattcaagtgtctgcatccttttcagatgactcaggggaaggcatttcagggtaattctgattaatctaactcagtggttctcaatcgtagctgctcaataaaatcacctgggggaactgttaaagcagtcagggttaagaaactataagtccgttatgataaacccattttctgggttggtaattattagaagaatgaggttgtatcccagttctgaccaaggagacgtgacaggaagtctgggtactgcagggggaggcttccttttgtcataggagacgcgaagaaggatggttttctacttttctgtattctctcatgatgcctgggactgctacccactatcttgggcctgagggtaagtggcatagcgcgctaactgaatctgggttcttgatgctgttgggagacctgtgggattttctatgctttgaatgtcttgttaaatgacataagacagttttgagttgggttttctgctacttaatgccctaggttttttatttattattatttttagatttttaaaattttatttgagatgtgagtctcgccctgttgcctaggctagaatgcagtggtgcaatcttggctcagggcaacctccgtctcccgggttcaagtgattcttgtgccttagcctcccaagtagctgggattacgggcacgcgccaccatgcccagctaatttttgtactttttttttttttttttgtaaagacagggtttcactgtggttggtcttgaactcctggcctcatgtgatccgtccacctcggcctcccaaagtgctgggattacaggtgtcagccactgcgcctggccttaatggcctaattttgataaagtggtgtaattgtaaattttgtgattatgctcccatcaagtggaatttagagagatacagaaaataaaatgctattttaaaaagttaataaattgcagggtaattttttcccgaatggaaaggaatactcatctacactctttgccttgaagaagttaccatagagcccctacaatttggggcatcacctgggataagtccaactgtcacttggggctttattacagtggctggtctccagtgtgaatgtagaccggctgtgaaaataattacaatcagacttgagccagggtggggacccagacaggcttgaaaagcttgaaatgctttactcactgcaggtggtctttgactccatttagagttgttcctatttagagcttcccaccaggccaccagctgagccatggttatttagaacagattttttactagccagtcagcaatctaatgttctcagtgtctttttgtcacattgcctttctctgtcctcccatctgctggggttcctttgaccagctccttgtcgctgtgttgttgttgttttttttttttttgaggggactagggtacattgtagacttttggataaagaatacagagaggagggtatttttgtgtttaatctttaaaatagctgatggaatataatatagaagattaagagcataagctgaggtactagcctggctgggttcatacccaagctcaaccacctgctaacaggggatccttgctcaagctgcttagcttttctatatctgtgttctcgtcagtaaaatagaaattgtagggctgggcgcggtggctcacggctataatcccagcactttgggaggccgaggcgggcggatcacgaggtcaggagatcgagaccatcctggctaacacggtgaaaccccatctctactaaaaataaaaaataaattagccgggcgtagtggagggcacctgtagtcccagctactcgggaggctgaggcaggagaatggcgtggacccaggaggtggagctttcagcgagcagagatcgcgtcactgcactccagcctgggcaactgagtgagactctgtctcccccccccaaaaaaaattataatacgacctactatattggattaaaagtaggatttgttaatacatgtaaagcatttagtataagtgctcaaaggttaacaattatgatgacataactaaattacaggcatatattttattatcaaggccctgttcttgcctcaaaatagctgttctgcaccctagaccaggtatctaaccttttagtgtttattacccctaacagtatatttctccaaagcaccattaccagtgaccaagaagagagacaaaattgtcaaaccctggaaaggcttccaaattttgattgtagttcgggatgctggaaaatcttgaaaacacattggtggctgggctcagtggctcacgtctgtaatcctagcactttgggaggccgaggcgggtggatcacttgaggttaggagctcaagactagtctggagaacatggtgaaaccccatctctactaaaaatacaaaaaaaaattagccgggtctggtggcaggcgcctgtaatcctagcttctcgggaggccgaggcaggagagttgcttgaatccaggagacggaggttgcagtgagctgagatcacgccattgcactccagcctgggcaacagagcgagactctgtctcaaaaaaaaaaaaaaaaagaaaagaaaatacattggcaaatcagagctcagtggtatcttgggaaaatattttctagaatttatttttgattcacaaagatttgaagataaagtagaatgtgttgctaaggtcattgcaaaactagtaagcaatctatagtcgaggttcaggcagtcagcagcaggcctttcctccaagtgactgataaggaagagttgatgacagagttcatctcaaggtattgacatgacaatataagtgactgcagccttcaaatacttcaaattacagagatactttttgaggacgtgaactcaaaattagggtttctagcgtctgacatgctggaaatcctaacagcttgtatttgctatggtaaattcacaataaaagaagacgaccagagacatccctaagagggattttcctaagagctgttaggtaatcctgttctctacagtggaatactcaaaagtgctctggacaaattcccaaagaagctgttttgaattctgtgacttcaatagctgtttgtcaccttatatcttgggcttttttttttttttttgacggagtttcgcttttgttgcccaggctggagtgcaatggcatgatcttggttcactgcaacctccgcctcccaggttcaagcgattctcccgcctcagcctcccaagtagctgggattacaggcgcctgccaccacacccggctaatttttgtattttttgtagagatggggtttcaccacattggccaggctggtctcgaactcctgacatcaggtgatccagctgcctcggcctccaaaagtcctgggattacaggtgtgagccactgcgtctggccttactgggttactttttttttttttttttttgagacagagtcttgctctgttgcccaggctggagtgcagtggtgtgatcttggctcactgcaacctccgcctcccaggttcaagcaagtttcctgcctcagcctcagctgcacaccctgtagctagtattataggtgtgtgccaccaggcctggctacgttttgtattttttgtagagatggagtttcaccatgttggccaggctggtcctgaactcctgacctcagtgaattcagagagattagtagcttgtctaaatcacaatttgtcattgatggagctggaatgtgaacctaggtttgtcttcactccaaaaccctgaaccacagtaatgagctgtctctgtaaaggggtgtaaccgtggtcttctgctagggaagtgataatcgatcttgattatctagagtgtgtgtacatttgatctagttaggatattctttttacattagtatgatgactgatttaaattttgttaaattttaagacccctctggggccattattataatttaaactgattgctaatttgtattatgagtacagtatagacattccaaggtcgggttgatttagtatccattacaagacacagacctccactctgtctctctcaatctccaccttcctcttttcctccccattccttgtcctacccttcagtagagtaacttttaacttattcttttagtattaggcttgtttttcctttgaaaagtttgagatactttagaaatataaaaagatagtctcacaataaacattcatttatttttccccctccccccagcttaatgaaagcatcttgtatacccattcttttccccaaggggtaggacctatctcagatctggtgtttattgttcctaggcattttgatacagttgggcacatccataaacaatatataatgtgtttgcatgtgtttaaactttatataatggtttcatcctatacttttttccctctgaatatatttgtgagattcatccaattggatgtatgtaactttatttcatttagttcaacctttttttcctacaagtgacatttaaaaggactttgttaattgatgttctatgatgatgtaccttctacctatgcattttttggatgataaaactaaatatatttagggaatattcatgatgaaagccttattgaaatttgttttataaatttaggatactagctttcaaaacagtcagtaattaataaatccatgaatcttaaagacatttaacccattttctttttggtattttgttaccagcccagcatggataatcagagtaagccagttcatgtctcaggactatatgagaactggtttgagtcagaaacaaaaaatctttaaaagccattttgcttcattgaaattagacttctgattagaaagagaaaaatgatgtttgtataaacacaatgtacatggagaattctggtaactgtcaagctagttggggcagatgaacatgattttcaggcagggactggatggtatcttgtggtaagccccaaagcaaacactggcaggtctgcttcccttacttatcctaacacaggaatgtaattgccagggggatgcttttgtattgagaaggccttgatattgttctctttataaacacatacacacacacacagagaaaaacaccagacactttacattctaaaggcaggcatcttgatatcgttctctttacacacacacacacacacacacacgcacacacacacacacacacacacacacacacacacaccaggcgctttgcattctaaaggcaggcatctctgtaaactctgagatggactggagtcacaccccaagttgctgccatagctaggcctgactccctggtccaactagaatttcctccctgtgtttcctcagaaagacattaatccagtgccacttaatatttcaacggtgagtgtgatttctcctgacttgttgacttgtttacccacaggcatcttctaccctcactcttggtggcaagtcatggtgagatgtgtggctggaagaactcaatttggccacagcagtgtcacctcaggtcagaatacaggatgtggaatggtctcttaaaaaaaaaaatgagtgctttcttttctgactgtaaagttggcctcaccgtttattagctgtgtgactttgggcaagttatttaagccttcagtgcctacatttttctttattagtaaaatggccctagtaagaactctgcctcactggtggtggtatttaatcctcacattacatattaaaagatcttaggactctgcttggctatggtaggtgcctattatttttattattattattaaaataactattttcctttggttgaacttgagcacagttgtggctttacccatagttacaggagaaatagtctgtgaacacttttttttttttttttttttttttgagatggagtctcgcttttgcagctcaggctggagtgcaatggcacaatctcgactcactgcaacctctgcctcccgggttcaagcgattctcctgccccagcatcccgagtagctgggattataggcacctgccaccacgcctggctaatttttttgtatttttagtagagatggggtttcaccatgtttgccaggctggtcttgaactcctgacctcagtgatccgcctctctcggcctcccaaagttctaggattacaggcatgagccactgtgcccagcgcatgtttttttcttccaatctaatcatattttgaagcacagagctgaatataggcctctcatttatacataggagaaatcatccataatagtgttgaaatctgatgtattactgaaagccttttttttttttttaaagttttggggacaaagccagaagtacaagggaatacagtgtccttgacatgacattacatttatttgagaatcgggcagattctctgccatactgatcgatagttttttttttttttttaatttttatttttggagacagtctcactctgtcacccaggctgcagtgctgtggcatgatctcggctcactgcaacctctgcctcctgggttcaagcgattctcctgcctcaacctcccgagtagctgggattacaggcgtgcaccaccatgcctggctatttttgtgtatttttagtggagatggggtttcaccatgttgaccaggatggtctcgaatgcttgacctcgtgatccacccgcctcagcctcaaagtgctgagattacaggtgtaagccaccgcgcccagccgatagttttgtttttattttgtgaaatgcgaatcaaaggcagcacagcaaacatactaaaatagataggtctttgaaaccaggtttacttactgtgtgaccttgggcaagttgtttaacttctctgtgccttgatttcctcctctgtaaaatgtggataatagtcagctgggcacagtggtgcacgcctgtaattccagcactttgggaggctgaggcgggcggatcacctgaggtcgggagttggagaccagcctgacaaacatggagaaaccacatctctactaaaaatataaaattaactgggcatggtggtgcatgcctgtaatcccagctactctggaggctgaggcaggagaatcgcttgaatccgggaggcagaggttgcggtgagccaagattgcgccattgcactccagcctgggcaacaagagtgaaactccttctcaaaaaaataaataaatacataaataaataaagtggataatagttacatgtttaaaatgttgcaaggcttaaattatttttaaagtacttaaaaaaattgcctgaaccatagtgaactctctctgtgtttgctaggcgtagaaaaaaaattaaaaatatattcagtcatcactagaacaaccttatttatgacagtggtggagtggtgtcatcttgtcactgaactctagctatggtgggctagttgctagaggtttgtgagaagaaacgtgtatattagtgcagaagagttctagtgcaggagacagcaaatttatttaaaaagcaattacattcacattgttgaatcagtatgggatgcgatgactgtagttaacaggactacctagtttgggggttccaagaagacttcaagaaaataaaacttctaggctgagaccaaaaggagggatcagagctttccctgctgagagtggggaagaagtattctccaagtgcagggaaaatgcatctgagaggtcagagagagcacatcctgtggatggaaaaatggtgctcaggtgggccagggaatctgcattgaggataagaatggtgctgtcgagggggtgggggagggtcaagaaggcccttggaaagcaggttgagggctttactctaaggacagtaggaagtgatcgaaaagttttgtgtaggggagtggtgtgagttgaattgttgtagaaagctttctcggagtgcagttgtgcaaatgaatcggaggaaagcaggactggaggttggggggtcagtcatccaggccagagactttggtggcagaagaggagtcaagacttagcagctgcaggctatagggggtgattgggtgtgggggctgccctgacacctcaggttctggtgtgggctggtgagtgcagttcactgaggtcctgccacagcagcagcttttgtgggagagaggatgagtttttggttttggatgtggagggcaaggtatttcgtagtagccaggagacatgttcaatagtgtgtttcttttatgggtgtgtatttcaggaatggggaatacagctggagataaagattctggagacacaccatatggatgggaaacgatgccatgcagctgaataccgaggctgccgagagagaatgtagagggagaaggcagggagagggtcagggcaaatccggaggaactccatcttttaaggggtaggtgaaagaagaacttgaaatctgagaaacagtagccattgacagagagatggaaaaccaggagagggtctcaaaagccaaggagaaagagtgttcagagagcaggagggagtagacaaggccatgccacagagaggtcaagtagcttgagtcaaggtgacattgtgttggccacacactgtcattggtaatagtgggagagtagtttaggtggccaagcagaactgggagcctgcttgcagagggctgagaagggagtgtgaggaaagtcagtgaacttgggtacggatagctctcctaaattatttggcctgccatccaaatacttcaaaacattcaaccctgtcttcaagcaggcttgaccctgcttagcatctgagatcagacagggttgaatgtgttcagggtggtgtggctgtagacccagattacgtggtcagtgggagaggaggagatggaagattcaggggtccatctcagagcacaaagtgtttgtttgtttgtttgtttgttttgagacggagtctcgctgtgtcacccaggctggagtgcagtggcgcaatctcagctcactgcaagccccgcctcctgggttcacgccattctcctgcctcagcctcccgagtagctgggactacaggcgcccacaaccacgccctgctaattttttgtatttttagtagagacggggtttcaccgtgttagccaggatggtctccatctcctgacctcttgatctgcccgcctcggcctcccaaagtgctgggattacaggtgtgagccactgtgcccggccttttttttttttttgagatggagtttcgctgttgttgcgtaggctgggtgcagtggcgtgatctcggttcacggcaacctccacttcccaggttcaagcgattctcctgcctcagcctcctgagtagctgggattaccggtgtgcaccaccacacctggctaattttttgcatctttttagtagagatggggtttcaccatgttggtcaggcttatctcgaactcctgacctcgtgatcttcccgcctctgcctcccaaagtgctgggattacaggcgtgaggcaccgtgccctgccacaaagtgcttcttatttatttatttaattattttgagacagagtctcactctgtcgccaggctggagtgctgtggcgtgatcttggctcactgcatcctctgcctccggggttaaagcgattcttctgcctcagcctcccgagtagctgggactacaggcatgcaccaccatgcccagctaatttttgtatttttagtagagacgaggtttcaccatgttggccaggatggtcttgatctcttaaccttgtgatccgcccgccttggcctcccaaagtgctggagttacaggtgtgagtcactgcgccaggcctgctttttttttttttttgagatggagttttgctctttgcccaggctggaatgcagcggcgcgatcttggctcactgcaacctccacctcctgggttcaagtgattctcctgtctcagcctcctgagtagctcgcttgccaccactccccgttaatttttgtatttttagtagagacggggtttcaccatgttggccaggctggtcttgaactcctgacctcagctgatccgcccacctcagcttcccaaagtgctgggattgtaggtgtgagccaccgtgcctggcagcgtgcttcttaatatagaaggtgggattcatattctaggtgaagaagtggtgggagggtgtacctttcacctgtttcatgacagaggagatggtaaatgatgtctacacactcaaattgtagatttatggcaggacatcgaggaaactgtcaactgatggatttattttccctgaggtagatgacaagattcagtaattctgttttaatctctcccccaccacattctttttctggttgatattaatactacatgacttgtaagagtggttttcctcatagtctgtttgaactgagtgggatggcatacagatgttaagctgagaagaggtaatggggttaggggagaaaaaggagttaaatgtttgggtaaacaaccctcatgatacccagaaaggccgctgtttcaggctttatttcacactttgttctgttgcacttaaaagacccaaacggtccttcatcttttttttttttcccccaaagtattaaaaccgattttctcttttatctcaccggagtcatgctgattctctttggatgtctacagggaataaaatgcctctggcagcacctgggaagattgtaggacttccaagtgtctgcctctttgtccaagagaagaggaggaatagaaattgtaagagttaaaaatggaataattatctattatctaaaaatatcttctcttgctcttttctagctaactacttaggttcaacctagttgaagaaacaatgcctagaagaaataaatgcttacaaaagatacccatcagtgggtggtatgcagatagcccttgtcttcccttcagggctggacaccctgaccgccatggaggtggccacacagcatcccttcagggatgtggagtgtggagaccttcagatgcttcagagggaggatatgagtggagaagttctttgcatgtgtttctagagctagagttggtgtcctgtttttttgtggaaaggatagagtttaaaaattaatctgaactttttcttcccctttcttcagattattgttataaaaatactatggatgctcatttatttcagctgtcagtgagaggaatcagactaaaaccttgttgaagcaaaagaaaaaaaaaagaaattttggcttgtgggtgaagactgaagactaaagacctttcttactgcactgggaattccagagaatactgactctttttccctagaccagtggttctcaaatgggtgattttgactgtctagagacaattttggttgttactttagggagatgctatggtttctagcgggcagaggccagtgatgctgctaaacaccctgcagtgcacaggacagctcccctacaatgaagaatgatccagccccaaatgttcgtagtgctgaggttgagaaactctgccttagaaatagggagcccatgtaatctaaacccagatactcttgagaagtacagttatgctaagacaataaccatgaactggaattgctacaagtatacctggacctgtggttgctctacataaaggccttatcagtcctgggtcacttgcccggcatagaccagtcactgagatgtggtggatgttgtactttggccagcctgaatcatgtgcctaccagtcgggtgaagaagtgggcagcaagtgattgctcggacagaatgccacagctcacaacaaagggtatagaaactagtaaaaaaaagctgatgtcttgtaccaagttttagttttagaaaataagatctggagatctgtataatatggagcatatgattaacaatattgtatacttacaattttcctaagagggtagatcttatattaagtgctctttccacaaagggaaaagaaaacaaaaacaaaatgatacagggagtgggaggaaacttttggatgtgatagcattgataatgatggtggcttgatggtttcacaggtgtatgcttatctgcaaacacatcaagatatgtacattaaacacacaaaaagcagtagataggctgggcactgtggctcaggcctgtaattccagcaatttgggaggctgaggcaggaggattgcttaaggttaggagtttgagaccagcctgggcaacatagaccctatttctaaaaacagggttgggggcgtgggggcacacacctgtagtcctagctacttgggaggctgaggtgggaggattgcttgaatccgggagattgatgctgcagtgagctgtgatcatgccactgtattccagcctgggcagcagagtgagaccctgtgtcttaaaaaaagaaagctgatgtcctatacataagataacttttacttttgaaactcactttattagacctgttttgatctgggcctagggactgcacatggcaaaacaaatgaggactatatgaaaacagtcaaaataagtatgccttctatttttttccccgttgcttggttgattaattttaaccataatagaggaggtgagagagatgaaattggcaagagggtggaaatgaagactgtgattcctgtagcttgcctggatacaaggacaaggttgttggcacagtgaggtatctatgccttataatagaacccctgaccagaggaaaaaatttagattaaaatacttaatatttataacaccttagcttgttgtaggccaagaaaatatttaaagaattaaatagcagtttactggcttaatttaaatttctgacactgatagttctcctatttatttttgaagaaacaaagcattgttaagaaaaactaatttttgtgggtatcattaatccagcagaatggattgaataattttacattctttttacctttaaacaaagaaaacatttcttgaatggaaattagaacatatgtattttctaattttgtatgttcttgatttaattttaaatttgaaatcaattgagaaatcctttaagcatctagaaaagttgtctaaattattttcttctgaaactgtattatagtctctggaaatattttccatctttcgagtttattgtgtatgcaggataaaatccaacgtaaggatttgacagtaggtagctatttgcactattttctgttcattgcaataagagaactgagacggtcaaactaaatatttgttatgtaaactctgaaatcttttagaatcgactgttgtggcttaattgatactgtctaaaaggcttgaatggctatgcaaattaacctgttgatgaacagccatgtatccagaaacagaatgtatcacttaaccacagcgaacagtgttttgtttgcaataagatggttgagtgctttttggcagtgtttacctgagtgtggcaggactgatttatcttgacaagcaaagaacaaaaagattttaaaaagtgcttctttgtccagaaaacaaagaggcaactttgtaaagacctttgtattttttgaccttaaaattttcattccaaaagctttaaatttgaaagtgtagttttgagtcaacacagtttctcggtttaatgtatgcagtgagaacaaaatggaaaggagtggagagggagttgtaccatggtggaagtgaatgcatcagggagcatttgacccttggaaggtgttggagggtcacctagaatgaagggaggtgtttaatttctttctgactgtggcgtcagtttaatgaatgcataccaaaagtcagagtgtacattaggaagaaagaatggaacgggattaatacataattcagctttgtgtgtgtgcattgtgtttgtgtgtgcataatctaatcgtagtttacatataactaaattaagagggattggtgatgatttctttaaagggaatagtcatcacccaacctatttgttttgtgtgcattaatatccgtttttatgtgttggatttgcttaaatggaagtacatataaaatatctttttttttttttggggggggttgtaatctcactctgtaacccaggctggagtgcagtggcgtgatctcagctcactgcaacctccgcctcctgggttcaagcgattctcctgcctcagcctcctgagtagctgggactacagtcacgcaccaccacgcctggctaatttttgtattttttagtagagatggggtttcaccatattggccaggctggcatcaaactcctgacctcgtgatccgcctgcctcagcctcccaaagtgctgtgattacaggcgtgagccactggtgcccggccataaaatatcttcaatttaaaacaatgagctttggagggctcattgtgggcaggtcgcgtgaggtcaggagttggagactagcctgatcaacatggtgaaaccccatctctgctaaaaaatataaaaattagccgggtgtgatggtgcgtgcctatagtcccatctacgtgggaggctgaggcaggagaatctcttgaacccggaaggcagaggttgcagtgagcccagatctggccactgcactccagcctgggcaaccgagtgagacgccacctcaaaaccaaaaacaaaaaaaacaaacaatgagtagatcactattgttttagattagagatgttagattttaattgacctgatatataagtttagctattgttaaacattatctgagaagtactaaaacaagtttactggaattaatgataataatggtggtgtttgtagtaggagtagataatagttgttgtttttttttttttgagacagagtcttgttcttccacccaggccagggtgcagtggcgtgatctcggctcactgcaacctccgcctcctgggttcaagcaattctcctgtctcagcctcctgagtagctgggatgacaggcgcatgctaccacgcctggccattttttttgtatttttagtagagatggggtttcaccatgttggccaggctggtcttgaactcctggcctcaagtgatgtgcctacctccggccccctaaagtactgggattacaggtgtgagccactgcacctggcctttttttgctttttttggagcacttgtgtttcagagactgtgcccagtgttttcacaggagttagcatttctcacagcagtcctctgatagttaatctcgtaataattgccattttgcaatttaagaacgtgggtttagagaggttgacatttgcccgagggtactcatctaggtagctgaggctcctgcaagttatacactttctgaagcctttagtttttttttttttttttttttaagatggagtgttgctctgccatcaggttggagtgcagtggcatgatctcgactcactgccacctctgactcccaggttcaagcaattctcctgcctcagcctcctgagtagctaggactataggcgtgcgccaccacacccagctaattttgtatttttagtagagacagggtttcaccatattggccaggatggtcttgatctcctaacctcatgatctgcctgccttggcctcccaaagtgctggaattacaggcatgagccacaacgcctggccaagcctttagtattatagaagagcatgcattattgtcattgatacagtatttcacagatctgatttggggtgttatcttgtgtaaagtcgtggggttgtaatgtctgcaaagcttactttcgggaaattaaaaattttctatcaagtgatagaaacttcctttaagctattaaaagttataggaaaggaagtcattttcatataatctggaatagtggctgtgctattttatttgcattacaaaaaattgaaaaaaacgctattgtttgcttttaaacaaagcagactttaaaaagtaatgttactgttaatgatttaatagagggtacacaggtttaatctgtactcacagtttgatcttttttttttttttggtgacggggtctcatttgttgcttaggctggcgtgatcttggctcactgcaacctccacctcctgggctcaagtgattcttgtgcctcagcctcccgagtagctggaattacaggtgtgcgccgccatgcctggctgatttctgtattttagtagagacggagttttgccatgttggccaggctggtctcaaattcctgacctcaagtgatcctcccaccttggcctcccaaagtgccgggattacaggcgtgagctgccgcacctggcctgctttactattaatgctgatctgggcctttgattaaatttgctgcttatctcatgcctgtgttgccattttattttcttcccaaataatagccattccttttatttttagaagtatttttattctctttggtgatggtattctcaatgtatttaatctgaagtaaattttctccagattcacctatgaggagcctgctacccagaaggttaagaattttgtccaaagtcatatggcaaagtaatagtatcagtgaagacactgtagtcagttttaaaacatttcagagtttagccagtaaatactgaatttagtaaacctcaatttgcgtatggaaagctggaaataaaactcgtctcctgactgctgtgttggagctggaaggaatgtccaaccttcttacaccatagataaggaaacatgaaacatgcctgcagcggccacttagatatatctgctctgtcctgtcagttcaggaagctcatttctagtgttgagtttactctgaagtcaattttcttttcttttcttttttttttttgagacacagtctgttgtccaggctggagtacagtgatgtgatctcggctcactacaacctctgcctcctgggttcaagcgattctcctgcctcagcctcctgagtagctggggctataggtgtgcaccaccgtacctggctaattttttggtttttttttttttttagtggagatggagtttcaccatgttggccaggttggtcttgaactcctgacctcaggtgatctgcctgcctcagcctcccagagtgctgggattacaggcgtgagccactgcccctggcctgaagtcaattttcttatgtttgtttgcagtgaacaagtaattaaggaaatgaaccagtaaatgagaaaattatatttgagagaatgatttttttcccctttcgaaactattttcatgatgctcacgtattcatgaatgttgaaaatttacattgggatgagagtgagagagtattgaggctgcaccgtttaataattccacatgtatgagagtccttcctcttgatgcttaatttgtggttagagagattaacaaattgagcaaagatgatgtgacattatttcatagtttggggcttccattcatctgctactactcgttctaagaaagacctaacgttcctaaaaactttgatacccctcaccttgcctgtgttccaggttccagtaaactcctggcttactgagggcagtgtctgtctttcgtcctccagcagtgtctagaacagtgccttgctcataggcactgagtcagtacccatctggctcctggaatgtttgagttggaagtcccagaagtctagaatgtttatttaggttaagctaagaagcagatgcaagttgagggaattcagggcctttaattcttgttctgtttccaggtgtcatttacataaggcatacgatgccttttgtaagtaactccataccatttgttgctattgtagttcctcttgcaaattcctgctgagtactttgatgcacaggaggtgaaaggggctagaaagctgttttggccttagttgagttgatgaaacttcagaacgttaagacaggcttagaaaggagtcagtgttctggggcacagttgggatagtgttcaaaactactgagggccccaaactgcctccagatagaaagaaaagctcagtgggggttgttagaaatttagttcctttggatgaatttctgttgtctttccttgatgatagtttatattcaacatactgaatgtaattgtattcaatttttttttttgtctttcaccagctagagaatttgggtgaaattttactgttacacatgtgcattagcactgaatttgtttaacataaagcaaaataacaggaaaaagacaaatataaatgattttgctacataagttgtacattcttctgttagaattataatgaagtccctgaagaaatattaaaatccggctgggcgtggtagctcacgtctgtaatcccagcactttgggaggtggaggcggctggatcacctgaggtcaggagctcgagaccagcctgaccaacatggtgaaaccctgtctctactaaaaaatgcaaaaattagcggacgcctatagtcccagctacttgagaggctgaggcaggagaattgcttgaacccaggaaatggaggttgcagtgaaccgagactgcgcagttgcactacagtctgggcgacaagagtgaaactccgtctcaaaaaaaaaaaaaaattctttcaaaatgactgctttaaaaacattccaaacaataaggatataataaaagcaaacttattatttaagtaaaaccaaagatgtaacatttgaagtttttgttattttaagaacaaaaatatcattttgttctcattaaaatttttacttatttttacttgttaaattttctcttacataaccagtcttttgtgatcaactcagtctgggcgttctgtgttcatggcatttcttcccagttaattcattctagaaaactgcaaggtgttttgttccatctgactgtttgtaaacaggaagggaccctagctactcgggaggctgaggcaggagaatcgcttgaactcaggaggcggaggttgcggtgagccgagatcacgccattgcactccagcctgggcaacaagagtgaaactccgtctcaaaaaaagggaaagaaaaaaaaataccagttccatgttatcaagaagaaagagagggctgttttggaaaacactaacatcattggccttttctttggcgagctgctggaatattttaggaagtagctgtacttttgctcttataaacacagttaaatagatactgcctcttgtccttctcttgcccttatatagtgtaggtgatatttttctatttggctcttttagaagctggactatcacgaaagaaggtggggtgtgggtgtgtgtgagtggttgtgggtgtgtgtgtgtagtgcattatgagtcagcctctgtggctgtttgctgtgtattttgtccttgttttgtattatttcacatatgtgttgaggagcaatgcatcagtaatgaatgtaacagaagagctgcatgtaacagaatagccagttatcaactggcttttagaccttgaccctgttggtaattttttttttctgtcacataataagtcaatagtaggtggttgctggctagttgtcagtggtgaggattctaaaaatttcttgcctttttcctcatggttgcaagatggcctagtcattacacccacccacttactaggaggcaaaaaaaaaaaaaaagaaaaaaaagaaagggaggatctgtatccaaggctttcccaggactctccagtcagcttctgctaatacctcatgggccgcagttcttaattgctctccctagccccaagtaagtctgggaaaaatttgtttgtggtccagcccttgttgtagaggaaggtgtgggtggtggggggagtataaaatattggaatggctgttgaataaaccatttctggatcttctaaaaacagttacacactctagagtgggcatctcaggagtgtttctccattaacttcagttaatcagcaggtctttgatgagcactgttagtatgaactataccatagtcccccttatccgtggtttcagttacccatgatctgaaaatagtacatgaaaaattccagaaataattcatgagttttaaattgtgtgctgttctgagtagtgtgatggaatcatgtgccatcctgctccatcccacctgggatgtgaatcatccctttgtccagggtatccacactgtatggttgtatgtataggaagaaatagtgtatataaggtttacagtgctattcatggttttaggcattcactggggatcttggaatatatcctccctggataaggggggaccactatattgttattggtcttagggagttagagggagaaatgcaaatgtgtaatgtattgtcttattagaatttacagtctggttatgggaatacaacacagaaggttgtgtaattgtttttttttttttcatcagattataagaagagggaagggcattcatgaatgcctggtataatggaaaaggctcaccttgaggagaggggccttggttggtctaggctggtggcagtgcagttgcagagagagtgagagcgagagagagagagaaatgaatgatgccagagggaacctgggctatagtggcttctttaaatttacggaaaaatataaatcaaagatgataatcttttcagcttaggagatgaggcaaacattggatatcagaacctgaaagttaatgggaacacaggacagtctagccttttttttttttttttttttttgagacagagtcttgctttgtggcccaggctggagtgcagtggtgccatctgggctcactgcaacctctgcctcccgtgttcaagcaattcccctgcctcagcctcccgaaagctgggactacaggcgtatgccgccatgcccagctaatttcttttgtattttagtggagatggggtttcacagtgttgcccaggctggtcttgaactcctgagctcaggcaatctgcccgcctcggccttccaaagtgctcggattacaggtgtgagccaccgcgcctggctggggcagtgtagctttgagagaaggcttggtgacccagctggtcctcccagttttgctgccatgtccatcatctagatttccctttaccagctttccatctgctgtagcattgacaacttccatccgttcatagcctctgcttcctctgaacattggcttactcacgggcctctacggtgagtgtcctcagcttcaccttccacgactgcacacctgggtacttaacctgttcttcagtcaccttcctaagagaatctggttggcccagctaattaccattgtccttgtttcggaagaggctgtcaggcctggctcacgctggtcattggccaacctgtctgttcccttccctgggatctggtgcccatccctgtccagtcacctgtgatacagaacaggtgtgcccgagactgctacctcaccagggccagggagaagaggggcaggcaccatacaaatacaagcctggtacgtgtgccatagcttgctttgtgcacccctattggttttataaacgttacattagataaaggaactgttttccacctctataaagaatttggtgagaccagcctggccaacatggagaaaccccgtccatactgaaaatacaaaaattagctgggcgtggtagcacatgcctataatcctagctacttgggaggctgaggcaggagaattgcttgaacccgggacgtggaggttgtggtgagccaagattgcgccattgcactgcagcctgggcaacaagagcgaaacttcatctcaaaaaaaaaaaaaaagattttgatgtagttatgtatgaataaacctaaacctttggctaatttttttgatattttaattcttttagcagcttattgagatataattcacacaccacacagttcatccatttaaaatgtataatcaatggcttttagtgtagtcacagattagtgcagccatcaccacagtcaattttagaacatattcatcaccccagaaagaaagcctgtccccttttggctaatactttttgatgctgatgataacaggtccatgcctcagtgtgttgctcagggaggcctttctgactgtgctgtttaaatgtgcattccttctccattctttgtcccctgtgcctgcctatttttcaggcaggttgttagaatacaggtggtgtatttttttttaatttattattattattattttttaggctgagtgtggtggctcaggcctgtgatcccagcactttgggaggccgaggcaggaggatcacttgaggtcaggagttcgagaccagcgtggccagcatggtgaaacccggtctctactaaaaatacaaaaattagttgggggtggtggtgcgtgcctgtagtcccagctacttgggaggctgagacgtgagaattccttgttcctgggaggaggaggttgcggtgagcagagatcgtgccactgcactccggtctgggtaacagactctgtctcaaaaaaaaaaaaaaaaaaaccgaaaacaggtggtatattttttatgcatctactttttgtctattttcttcaatgcaaggttcatggaggcagaggtttttgtcttagaataagtaacacatggtagatacaaagacaatttgctgaacaaatggtttattactttgctgatagtaataaactattgtaataaaatagtgataacactgtgttactttgttaaacttccacttaccagttttatctgagaactccgtatgttgtctcattgaagaactgttatctccattttactcttagagaaacagaggctcagaggtgaaataactttcccaaaccaggaaactgccagaatgaatttataagtcattgttgtctatgaatacaaatataatgcaaggcacatatataatttaaaattttctagtaaccccattaaaaaattaaaaaacaggtgaaggtgtaatggcatgtgcctgtagtaccagttacttgggaggctgaggtgggagaatccctttagggcaggagttcgaggctgtagtttgctatgtttgtgcctgtgagtagccaccacactcctgcctgggtagcatagtgatacaccgcccccccccccctttaaaaaggaaacaggtgacattaattttaatattttacttaatctggcgtatccaaaatattatttcaacgtgtaaccagcataaaaatgattgagatattttgcatgctctttttttcagatagtctttggacttcactgtgtatttaatttaatttgattaatttattttgagacagggtctcaccctgtcgcccaggctggaatgcagtggtgggatctcagctcaccacaaccctcgccttccaggctcaagtgattctcctgcctcagcctcctgagtagcggggattacaggagcctgccaccatgcctggctaatttttgtattttttagtagagacggtgtttcaccatgttggccaggctgatctcagactcctgacctcaggtgatccacccgcctcagcctcccaaagtgctggaattataggcatgagacactgggcctggccttttactgtgtattttatacatatagtacaaatccattcagcccaggtacctttcagtgcccactagccccatggtcttgcatctgtaaccttgctgcttccctgtattcaggctgtcactcttccattttgggaggataatacgcagtatctacacctgacatttgtggaggctgaccatttacaaaaagcttaggtttacacactcagctcattagattttcacaataactgaaggaggtaagtgcgtcgggttacaatatccagttagtatagaaatgtttacagatgactatgtcaatatctagagagcttaaccagcttgtccagatttatcaggtttctacttggcaacgtcagggtttgaatccagcagctcccgtgagtccacatcactgtgtgctgcttgtggacagagcggcagattggggagaggcagagtctgggtgggaaggtagaaggggaggggccatacttttctaagtgtggggtagtccttcaacataaagggtttgtctgtcccccaagtccatacctggtgttctgatggacttactctgttggacatacacagagattccttgtgcatgattttagccttggctcattttgacctctcccatttttccctcttgttttgaacattgccctttattccctaccctaattcatgtcttatttcttcttttaggctcattcaggctggtttccctaagtcccagttgaaggggggctatgttagtctcctctgggagggataggaaaactgctctgctgtgaatggccggtggggctttcagtggctgagagatggtagttcctgggtggctgccagcctgccagacttgggcaaactatgtgtattggaacaaaaggctgagtgtgaaattaatagctctcaactgagaactgtaaaagagctggttgtaggtaaaaagaggcagtttattttgtaagttagagttaactttttttttttttttttgacacagagtcttgctctgttgcccaggctggagtgcagtggtgtgatcataacccactgctgcgtccaccttccaggctcaagcaatcctcctgcctcagcctcccgagtagttgggattacaggcatgcaccaccatgcccagctgatttttaaattttttgtagagacagggtcttgctatgttacccattctggtcttgaactcctggccccaagcaatcctccctccttgacctctgaacactctaggattacaggtgtgagccactgcacccggcgtaatctctatatagagttaaatttgtttaaaattttaaaaatcttttctaggtttttctccttttagtagtaatcgctgtactgaccacaagtgggttctgtgtatgtttcacatttgtatgtggcttctttggtacttttgggtggcgccaacagcatttgatttcaaccttgtgggtctgaagcattattttagtggttcctctctgattctcaaaacttgatatttgaatttatctctttctcttttccacaggtgaaggagcagtctttcaggaaaggaaggaatgtttttgttgagttagcaattatatcaggcatttaaatttactctccataaaatataattgcctggaattctgtaaccaaataacagcaaacagaatgaattgggaaatctgcccatttggaatatacgggctagtttacctttcatagtagtagagttttcttaagattttgtgctgattggcactaagtgactttgaaggtgattttaaagacggcattactaggaaaaacgaaggagaaaaagttaagtgaattaaatgagtagccacttgctttggactttatgtagcagtaacagcagcaacagcatcttttcttgttcattctcttgactctacttttcatgcttacacccagatcagaaactgccagattctccattagaaattcattccctctttttttatttttattttttgagacagagtcttgctctgtcacccaggctggagtgcagtggcacaatctcagctcatcgcaacctctgcctcctaagttcaagctattctcctgcttcagcctcccgagtagctgggaccataggcatgcgccaccatgcccagctaacttttgtatttttagtagagatctggtttcaccatgttggctgggcttgtcttgaacccctggcctcaagcagtctgccttcctcagcctctcaaagtgctgggattacaggtgggagccactgcgtcctgcccagaaattcattccttttgaaatctaggtatgccacaaattaatgttatttctaactggttatactctttagcattggtagacctaaagataattagttttagaaggtatggaattatagcctagtggaggtttaacaaaaggaaaacaagagttgattgggtaggtgaactagcaaaaaaaagataattgcttatttatttatttatttatttttatttatttatttatttattttttttgagacggagtcttgttctgtctcccaggctggagtgcagtggcgcaatctcggctcctgcaagctctgcctcccgggttcacgccattctcctgcctcagcctcccaagtagctgggactacaggtgcctgccaccacgcccggctaattttttttgtatttttagtagagatgggtttcaccgtgctagccaggctggtctcgatctcctgaccttgtgatccacctgcctcagcctcccaaagtgctgggattacaggtgtgagccaccacacctggccgcttttttattttttaacttgactaagtggactgtgatggggagtggggtagattgttgctcatcagaacatctgtcgcccttatctactctggattccatttgctaggggtaatgaaggataacaaaagacttttatggttaaggagacaggacataaactttgacaggacataaacataaggaaagtaaaagcagaatgagctaattatataatatgaaaacagaaaacccataataaaactgtataagatttattgcaagatggctactaaagaacagtggttctcaactttcagtatgtattagaatcacttgagaaacttaaatactaatgcctttaagaaaatgactgtttttttgttatattttaattggtctgataatctgtaagtttagctattgttaaacattatctgagatgtactaaaacaagtttgctggaattaatgataatggtggtgtttgtagtaggagtagataatagtttttttttttttttttgagacagtctcgctctgtcgccaggctggagtgcagtggcgcaatctcagctcactgcaacctccgcctcctgggttcaagcgattctcctgcctcagcctctcgagtagctgggactataggcatgtgccaccatacccagctaatttttgtgtttttagtagagatggggtttcaccatgttggacaggatggtctcgatctcctgaccttgtgatccgcctgccctgacctcccaaagtgttgggattacaggtgtgagccactgcgcctggcctggcctggcctggctgagtgattttattctgcctgctttgggatgaaggctgggcattggtttgtttgagaaccctgcaggtaattctaacatgtagtcaggattgagaataatttttatagacagatggtgattcctttttttttttttttttttttttttaaaaacagagttttgctgtgttgcccaggctggggtgcagtggcaccatcacggctcactgcagcctcaactttctgggctcaggtgattcttgtgcctcagcctcctgagtagctgggattacaggcgtacgccgccatgcctggctaatttctgtattttgagtagagacagggtttcaccatgctggccaggctggtctcaaactcctgacctcgggtgatctgcctgcctcggcctcctaaagtcctgggattgggattacatggtgaaccaccatgcctggcccagacagtgattcttgatctttagtgggaatcaaaatcagctgaatagagttggataggtttcctggaaggtaggacgtgagcaagtttctgagtaatgtataaagcttgtgagaaagctgggtgggaaaatacaaggtctgtttggggtattgatcgagctaattttggtgggggagtaatgtgagatgagggtgggaaagtagccttcaataccactttgagtttagatttcatatttttagacttggagataggtgaggctggagaccctagtctgagcttgccaggagagaggtgggtcagtaaacagcacctgaagaccaggcacacctaacactataggaagtgcctgttctgtgggaggtgactttgaagtgtggctgatctcccatcggctcccatgcagtaatagtgactttgaggtaaaaaaaaaaaacctccaaatctggaatcaattaaaattcagcaaacatttatttttttattttttgagatagagtctcactctgttgccaagggtggagtgcagtggcgtgatctcaactccctgcaacctccgcctcttgggttcaagggattctcgtgcctcagcctcccaagtagctggggtttataggcgtgcaccaccatgcccagctgacttttgtatttttagtagagacggagtttcgctatgttacccaggctggtcttgaactcctggcctcaagtgatccacgtgcctcggcctcccaaagcgctgggattagaggcatgagccactgcacccagcccagtaaacatttattaagtgtgttttatatgacagatgtgctgaggagctgtaagtttatttttcagtaacatgctgagagtgtttttaaaagtaatattttgggccatggaaccctttgagaaataaaagtaggagctgcttttccacaaaaatgcccaagtacaagtaatcttgcataagttttagggcttttggatactctgaagtcaactcataacctctgtaggtgttcgtagattccaagttaatttttagaatagactgtggactaatgatggaccatgttggacagggaaatggggaaatctaggagtccacgctattttcagtttttcttgttaggcataatttatcattgtgagtcatttaagatctatttagcaaatatttttgaatgaagtttacataattcacagccaggtgtttccaatatcatacctggaaatataaagtacacattagaacagggatgggtgtgtgtgctgtggtgtgtgtgtgtgtgggggggggggtgtgagtgtgtgtatttcaatgtgccacgcccattttcattcctgacagactgcaaagtaatgggtgtgtctattgtgttacgtcttctgattaaaacacaaggtgggatataactcagcaattctgagcatttgctgaagaatgctagtgctgatagaagtttcatgaggttgggtgtggtggctcatgcctgtaatcacagcactttgggaggccaaggtgggcagatcacttgaggtcaggagttcgagacaggcctgaccaacatggtcaaagcctgtctttacaaaaaatacaaaaattagctgggtgtggtggcacatgcctgttgtccgagctactcgggaggctgaggtgggaggattgcttgaacccaggaatttgaggctgcagtgagccatgattgcacaactgcactccagcctgggcgacacgatgagaccctgtctcgataaaaacaaaagaagtttcatgcaaacagtatctgaagtcagaattcttctatagctcatgacatgttctatcccattttggagatacacaatgctgtgattacagttatccctccatatcctcgggggattagttccaggaaccccttgaatacccaaatctgcagatgctctcaagtcccttatgaaatggtagtatttattggctgggtgcggtacctgtaatcccagcactttggtagtctgaggccggtggatcacttgaggtcaggagtttgagaccagcctggccaacatggtgaaaccctgtctttactggaaaaaaaataaataaataaattagccaggtgtggtggtgggtgtctgtagtcccagctactcaggagcctgaggcaggagaatcgcttgaccctgggaggcagaggttgcagcgagctgagatcatgccactgccctccagcctgggcgacagagcaagactccatctgaggtgggtaaaaaaggtcgtatttgcatataacccacccatgtcctcccatatgctttaaatcatctctacattacttacgatacttaatacaatgtaaatgctatgtaaatagttatattgtattgttcagggaatataagaagaaaaaagtcagtatgtaagcaaccatcagttttttccctcaaattgttttgattgcagtcagttgaatccatggatgcagaactcatggatatggagggctgtctgtataactgtgtgtgggtgtgtgtgggtgtgtgtgtatatatacacatacatatatgtatgtgtgtatatgtgtatgtatacacatatatatacgtatatacacacccacccacacacacccacacacactgcactccagcctgggcgatagagcaagactccatctcaaaaaatatatataatataaatatatattatatacgtaactatattcatgcatatatattttgagctcatatatattcatacatatattcacatatatatatatatatatatatatatatatatatatatatttatttatttatttatttattttatgatggagtcttgctctgtcgcccaggctggagtgagtgcagtagtgtgatcttggctcactgcatcctccgcctcccagattcaagcgattctcctgcctcagcctccaaagtagctgggattacaggcgcctgccaccacgcccagataagttttttgtatttctagtagagatggggtttctccatgttggccaggctgatctcaaactcttgacctcaagcaatccacccactttggccgcccaaagtgctgggattacaggtgtgagccaccgcgcccagtctacctgtatgttaaagcaaatccagcagcaaagaaatctgttcagctttgtttaaacccatcagttcctaagtttatttaaccagggcctctcttctcaaagcattcttttctttctcaaaggacaaagattggtaaatactagtttaacttctaattaaagttggctgggtgaaacataagtgaagccttaatatgtgtgggctgcagaatttatctttttttttttttaatccacatggcaaaaatcatataggggttctgagtggtaacttagtttccctgcatgtctagtatcagaattttgaaaaacattgtgaggactgagagttacctaaataataactttaaaaaatagctggttttgctcctataaagaagactgagcctatattaaaagattatcaagaatcgtcttgaaaatctaggcataagtgtgcacctgtagtcccagttacttgggaggctgaggtaggaggatcgcttgagtctaggagttcgaggctgtagggtgccatggtcatacctgtgaatagccactgcactccactctgggcaatataatgagattacatacctgaaaaaataaaacatgttagttttcttctaacctgtggcttttgtccaactggagtcctttccctagcaaaaaggcaaaattgaaaataattgtgatggcagtggaggaccagtgaataacatatttgtattatcaagggaatagctcttaaataacaggacagacacattagagccctttagaaagggagcaaagatatgagattatcaaattatgaaatgtgttatatatgaatatactagggagtacctttccctgcacccatggtgcagtataagtcttcaggcatgaaacatatatttgttaatggactattccgggatgacttttaaatatttacactgaataaatacctgtatctggttggcccatgtcctagctgctgaatattcaggaaagaataagggatggctcctgaccttgagaagcttagatttctggtgaaagtagctttctcagtgcaattatactgtgagtggcatcttcttcctctctgggccctccccctggttcctgctccccactactattgccacagctgagtgtcaggctgaatgaatcatggagctatctgaggatggcagtacttacattactttattacgttgtaaaatacttcctgataagaacgtactagtggttttttgagtgtctggaaacattgtaaacctgtcaaataattctaaagattccgctgttaacatcagcttaaagatttgttagtaacgtaacttgccaaattccttgccccatcacagtggtctccctaattaaaaaaaaaaagtaattaaaggttgagatttaatgaattttacttactaaattttctctgaagccagagacttgaacataatgaaataattgttcatttttcaaaaccataatatttttgtccttttaaagtagaaatggatggtagaaattgtagaagctgaataaatttggtgacaactttgtttttgagtttgtttaaacatttaagtgcttaaaaatgggggcaaattttcttgtctttttttttttttttggcagggaatcttgctctgtcacccagactggagtgcagtggtgccatctctgttcactgcagcctccgcctcctgggttcaagcgattcttcttcctcagactcccaagtagctgggattacaggcacacactactatacctggctaattttgtatttttagtggagacagggtttcaccatgttggccaggctggttttgaactcctgacttcaagtgatctgcctgcctcggcctcccaaagtgctgggattacaggtgtgagccactgcgtccagccttcattcagcatatgaaaattaaaaaaacataaaaaagggcagaaatgaattatgcagcatgatttcattattgctctcaggaactggataatgctttaaggtaggactaatctgtttcaatgatgagacattttctcactatacatagcagttctggtcattagtgaaattactcagtaaatgttgaagaagaaggaaaaatgaaggtatccatcatgatcctaattaccaccaatgaaggtaattagggaaattactcagtaaatgttgttgaggaagaaggaaaaatgaaggtatccatccataactcaagatgatcccctatttagagaataagtatacattctacaggcatctaaggttttcatgtttctctgttctgtttggttttaatggtataatatacattaaaaattgtgcatcaaggattttatttcaggtatgtgctgcattgcttctctttatgtaataaattccttgttaactgacattgtttcccggggatttccgtatgttaacaagttctttctacagagatgattaatacttacggtgatcaccctgaggttccacaaaaccctcttgaatcatcagagatgacattctactcattgtaactttaatgccatgtatttattgtcttttaattgttttgaaagttgggcatctgtttgagatatttttttcttttggttataatgacccgtttcctgaacttttcagataagaaactataggatactatcatggaacctgttttctcctgtaccctggttttaaaaccagtggctggaattaagacatgtgttgagggaggaaaagggaaaagagaggagcctgaagggactgccacttttctctagcagtggaataaggagtacttcattgagctaagaataattaatgtggagtgttgaaagatcattctgtattttatgcacatgttccagataacagcataaggacctatgaaaagcaagaaaaaagttttctggggctgtcatctttgatcacatagagatggagtgtgtgttcatacaccagccattcctgtccgtccttgccaccactgacttagaccaggtgacacatgggccttagtatgaatgttgtaattggagaatctgcctcaattttgagctcaactccagtctgtagacttgctgatacagtagtatttgtctatcacagcacttagaaatgatagcctgtggtcaggtgccagtggttcacgcctgtctgtaatcccagcactttgggaggatcattggaggtcaggagttagacaccagcctggccaacatggtgaaaccctgtctctactaaaaatggaaaaattagctgggcatggtggtgggcgcctgtaatcccagctacttgggaggctgaggcatgagaattgcttgaacccgggaggcggagattgcagtgagctgagattgtgctactgcactccagcctgggcaatagagcgagacttgatctcaaagaaatggtagcctgtatcacattgttttatggctatatctctgtatcctgtatttaacttatagtcatgtggtgttatgaaaaaaagtaatcagtatatattgagcacttctttgtaccaagctaagtaatttggaaagacttgtttgtattttgacctggattcagattccacctctgctacatactggcttcatgacctcagtcaagttacttagcccatctgagcttcggtgtttgtttttttctgtatgacagttgtatgattctgctaggacagccatagccgagtaccacagactgggcagcttaaatagcagtcttattttctagtaattctggaggctagaagtctgagatcaaggtgttggcaggattggtttcctctgaggcacctctccttggcttgtaggtggctcttgtcacatggtcttacctctgtgcctgtatctttgtcctaatcttcttttcttttaaggagaccagtaatactggattagggcccaccctaatgacctcattttaacttaattacctccttaaagaccctatgttccctgtaatcctagcactttgggaggcccaggttggaagatcacttaagcccaggagtttgagaccagcctgggcaacaaggcgagacccctgtctctgtttaaacagaaaaaaagaatcccgtgtctgaatacagtcacattctggggggtaaggaattcaacatgagtacttgagggacatgtccagccgcctgtaacagcagtgaaaatgacatgtgctcaagtgggtttattttactttttaatttttgtgggtacacagtaggtatatatatttgtgggttatctgtaatattttgatacaggcatgcaatgtgtaataattacatcagggtaaatagggtatctatcacctgaggcatttttgttgttgttcttgcaaacaaatatactcttttattttaaaatgtatgattatttttgactatagtcaccctgttgtgccagcaaatactaggtggcacaatttttttgtacccattcaagtgttgtgttgttgtgaggattaaatgaaatagtatatgcatgtgagcttagtgcatgcataatgttagctttctccttgctagagcggggtagaatcttgttttctttatattctatccaagtataaacagtaaataaatgtcagtgaaattgtgttttaagtatgtaggtgccccttttcataattctcatcttcctcgcctccactcttgcaactaaattagtatttttttcttttcttgagatggagtcttgccttgtcaccaggctgtagtgcagtggtgctatctcggctcactgcaacctccacctcccaggttctagcgattttcctgcctcagcctcctgaatagctgggacaacaggcgtgcgccaccacgcccagctaatttttgtatttttagtagaggttgggtttcaccatgttgggcaggatggtcttgatctcttgacctcgggatctgccctcctcggcctcctaaagtgctgggattacaggcgtgagcaaccgcgccaggccctaaatgagtaatttaatgctaatttaaggggatctctcctgagaagttctctctacttctgctctctgcgcactgggacgtgccatctccacctttaaactgcgctaggcccttgttcccttcccagttggcaggattatctgagacttctctagataagagcagtggacttcagctccctctccctaggttccgtgtttccacctggcggtagtgtgtatctgccagttgacactttacatcacacagtttgtgatttttaggtctgctctgcctttctcctctctcctctctgcagttttttatcttttttttaagccacagttctacagacagatgggaagtttagagcaaggtaggataggcgagtgagaaagcaacatgagaaaaatgagtataggcttattgacttaatgttctagctcagacttgtaccacaggcctgtgccttgtggcgagtgaactgtaattcctctgaggatgtctctcttgaatgtttgacaaggcattagcaatcatctgtcgcccagggaattccaaacaaaaacagatgagtttaaaatcctagggtataaacggccacagaattgtttaacttgttgacttctaggggaaaatatgtattctacaaatgttattacagagtttttacaggcatttttattattaatgatgggaagcttcctggagcattctcttaagtctagtggggttactaaatgtagttttccaactggagcttggtttcctgaaagctattcttggtggggtggatgagtgcagctgtcgtatctcttagtatttcagtttgagtcattgggtgggcggaactgattagaattccaaaagcaatacatataggagttaggtggaactcttttggaattaagtaggaaagattttgacggaactcctgcattccagagttcagtggtaaaaagaacactttatgtacagagtatttgggtaaatgtcttctgcattttgctttagttttttctttgttggtagaagggacactttatattaagaagctgttacaatgtattgtcaagatagagttatttgaaaatatttaaaaatagcagatttcccttctaaacatgctgacttcttgtaggttaatgtgacgttactttcattaatgtacatatgtatgtatatattatcatgtcttcttttaaacactttacagagctttatagtaagttcacccagttcatcacaagttagaattttgctgcatcctatatgcctcacgggaagagacattatcttgtggaaagtggcttttgtgctaataaataaacatcccttggaatgttaccctccatagcaaaggggccatggaaggctctgtgttttaggattacagctgcccagagacagcttgggaaacagtgttatgttttacagcatctattagaaatcaactcgatgtacacttaaatattgtattctgagttataacacagcaaactgacattgtaatgttttccaatatgtgattttcattgttgccatgatgtcataaggatttaaaaacagttatctgtttttcgtgggcagaacttaaaacagtgttaaaaagcatgcactctgtgtaccaaaagccttaaagtggaatgatagggaatccctatggggtaaagagaagattcttgattctctaccttggttctttagaatgtgagtcaatacattaagaacctggactgctctgaaacagaggcacatttgagagctcctggaaacccctttataggattatttccttgtctttgttctttagtccttgatttgttgtcaagtgaagcttgagatatgtcttgcagccatttgagaagcagcacatctggttagaagcagagactggggaacctgattgcctgggtgagtcattcctggctctgccactccagctttgtgatctcaggcaagttacctctctctgccccagtttcctcagctgtaaaatgggataataataatattcataagatagttgtgataatgaaatgagttaataaatgtaaggcaatttaggatagtgcctggcacatagttagccctgtataaaaatgttgactcttattatcttggtacatgttaaattcctatatttgaccatgttcagaccaagttgatatccacttccatttgttccacattcctgacctaatttgtcttggggtctccagccaaaatctaagattccccaggctaggcaagcatgaactcttgttcttagtggaatctgtgtggcagaatttatttctgcaggtatccaatgttgttggatgggtttggtttgcctgtaagagtgtgcaggtggaaaacatgacctgggtttgtgtctgtagggtttaaagtatgtgtttaggacaagggttatataaggacaattttgaagtcaaagttttaatctctttttcttcccctcaggtttctttattctataacatatttacttatttattataacctttagggctcagcctctttatttcctgtgactttgtttatttcatgagagggtgaccacccaggatttacaaagcttcttgtgtgttgtggaagatagtataaaattcaaataatgcttttacctgagcactagtgtgtgtttcgtttcttccttgaacttgcttaaagaggtaagcaagattacctcttggggcaaagattcttggcagagatgagaagaacattttgtcattgacagagtctcaacaggacccccagctgacatagaaacacttgttttgctgtcttctccatgctgatcctttgccacagccctttcctccttgatgtatttttttttttttttgagacggagtttcgcccttttgtccaggttggagtgcagtggcatgatctgggctcactgcaacctctgtcttccagtttcaagtgattctactgcctcaggagtactctacttctgagtagctgggattataggctctcgccaccacgcctggctaatttttgtatttttagtagagacggggtttcaccatgttggccaggctggtcttgaactcctgacctcgtgatccactcgcctcggccccccaaagtgctgggattacaggcgtgagccaccgcaccggcctgatggtcattaagtgccctcagcattctcactcctggagtccaggcctaaagcttgcatccctcctcctggccagtccccagcctttagaaataaataggctttaaatgagttctgctgtttgctgttctgccctaggctgaggctaatggaggtggtctgtctgcatgagcagagctgtgtgtgagaggctgctaggagaaagcaatacctgttgtcttaggggccagcttcaggggccagtgacagttaagactcttcctcagagctgcattaggggcctatcaagccttgctctcacatatgcagaataagcaccttgtagcctggcctggtaggagaaaggtgattattgtcagtacccctggtccttgtttccttttcacccagaaggcagagtgggtatatggaaagatcacaggctttttggctacgctgacctggttttgaattctggctctgccactcagcctattagtacaaataaataatgcacactgagtcttagtttcctcctccctaggcatgggggctctaaatccttttgcacagaattatggtataaaacagcatgtatgcagcacatctggatagtggcaggctctgatgatgataataatatcactaatactgatagaatgcttactatataccagatattgtcatgagatataatgtatgttatttgacccttcccacaacaacatctccgttttacacactaggaaactgaggcatagaaaagttccgtaagctggctatgatggcaccgagcacaaagcccagatttaaatccaggctccgaaaagttagctccacagtttttcagatggagaattttttgagatttctaagacttttgataatataaaataccactacttgcaatcatttatggcctcctcgtaatcattaacttgtagctggtgtatttatcttgtgtagacctgctagtggcaacagatacaacctactgctaatgaggaaattgcccttttgcgaatgaatgatggaaaaaaaaattctaagacggagtcttgctctgtcgcccaggctggagtgcagtggtgtgatctcggctcactgcaacctctgcctcctgggttcaagcaattctcctgcctcagactcctgagtagctggaattacaggaacgcgtcaccacacccagctaatttttgtatttttagtagagatgtggttttaccatgttggccaggctggtctcgaaaggctgatctcaagtgatccacccaccttggcctcccaaagtgccaggattacaggcatgagctaccgtgcccagcctgagtgatagaattttaatacttgttctggttcaatgtgaagcatatttctcccttcagagacttacctgtggggctcccccaagacagcaagctgactagaaatcattgttctagaacttttgataaatgtgcacaagagagactctcctattccctttgtttccttgcccatgtgacttgaagctctgctgcttctgttgggtgaaggtttgatagggaacagctgcctcgctcatggggcagcattgggagcttagtgcactgggacttgtatcgcagcatggacttcaccttgcctgttggaggctgagacagcaaaatgcagttcgtccagatgctgtgaagagtttcgaggactttcgttaggacgatagtactatggtaaaagctttggggtgggctctgtcctacgagagagcgtgtctttccttcctggtggcctgcagtgacattgacgctctggagataagtggctatattcatcactgatctgagcaacctatgactgggcgtgtcctggcagcagaaaataactgctatgctgatagctgttacagtcagttttcttcttggacataaatttacattaatgttaaactgttttaaggtgcatatgcatgatttgcgtttcagctatgtatctctggccttttaccattaggaaatttggttttctgtctttgctaattgaactagagtctgtgtggctggatagaatcgtctgggtagggtgtgattttctttttttttttttttagacggagtctcactctgtcacccaggctggagtgcagtggcgcgatttcggctcactgcaagctccacctcccgggttcacgccattctcctgactcagcctccctagtagctgggactacaggcacccgccaccatgcctggctaatttttttgtattttttgggtagagatggggtttcactgtgttagccaggatggtctccatctcatgacctcctgatctgcctgcctcccagagtgctgggattacaggcgtgagccaccacacctggccgggtagggtgtaatttccaaagttgacctcacgttgaacctaaggcttaaagatataaccttcctgtcagacggtcagatctcttaacactggatcacactgactgacctttaagggtgactcatgtctgtgtcatttccagcagcatctttagtatacctctggagggatagtttccttctctaagtagtaaaaggtgaaccaggaggtgttgggggagtggactctgcttttcatttctttgaataatatacatgaaattatacattgtggtccttattgtgccatcaattttgtgtttttaataatccaagtttctaaagacactctttcctatagatggggagataaaacttgaggaattggaatcctcatgctagaaaggcacgttgcaggtccagccagtgtgtagttactgttcattagtctatgcatggcactcaactagatgacatgaggatccagacaagtcttgctttctgccttcaagttgcttatactttaggtggaggtatcagtgatgtaaaaactacatgggtttgtgacaggggagatcctgctagaagtgtcggtttagcgctgagaggagcaaaatgatttgaaatagatggcattttttcatgcctgctcagacaggatttttgcatgtgtgtgaatttcctcacctttgaaagagtgggtgctgcctgttgtatgatagatgtctgacataaaatgcctctttttgcccctcatatcacgtggcctagtgtaattggggggttattctgggaaaacaattagatatgcattgtgtttacagtgtgctacaactctttaacctgggacataacttaccgagatctgccatgacatgagccgctttctcacagtcctgttggagacctgcctgccaagggcacagagcattaaatggtgggcaaaagttatgctaactgaagtctgttttgtcttagggtctttcacagccctttttcatatttcagttttgttaaagccctagagcagggatgagaaatttgtagtaaatatgcacgtgttctctccctcataccccaagaagctgctcataggggtgttgctaatcaaaatgtcctattcctgcctgggtatagccttagagtatttcttaacacatgattcctggatgtcgctcctttttgctccaaactggcacattttataaaatctgtttgtaatctcctttgcagtgttatcctcttgctccatttcattttaataagtgttgagtgagtggtacagggaatgaattctgttggaggccaaaaaataagaacacttagaatgaccagtaaagagtttatggtggaaggacttaaactttaatttgaagggtagataggatttaggtaggtggcggggaggaagctgtcctgtgaactaaggtactgaaaaggaaagtagaaatcatgacgtgggaatagcgaatatgtgtttggtagatgtggagggtttcttccgggcagtggttcccagggtttgtgtgtatcagtcatctgctggactgcatcttcagtttccatttcagtaggtcctgtggtagcgccctggaatttgcatttctagcaggttcccaggtgatgctgatgttgctggttcaggggctgcacgtgagaaccactgctgtggggagcatgtaagctgcggccagaggagtcatgctggagcagaggtggagggtaggacagcctggcacccacctccagggaccactcttggcaggtgtgcactgcgttgtgacttgtatgaagcagtggccctgggcccagggatcttgagtaccagcctaaggagctggcactctctttaggcagtgggaagccattgacaaattttgatcaggagaatattattggcatctcctttcagttaatttggtagatggggaagggtcctgaggggggaaagcaagctgtagcatagtgcagtgtcccccagatggattatctcaggagtgcatttgggagagagaattggaaggctggatgttcagtgaggaaggtaaggaagagagaagaatgcaaaggtgacccaacatttccttcagtttgggagtctggggagtggtgatcacattgacagaaaggggaagtcagagcaagagcacaaatgatcagttactttaaaactgagtttaagttattttcttccaaagatgattgcctatcctgttttcagaagggtctatgaatgtaccatgccttttgttttgtctgtaatgtttaagcttttcatgattctaaatatgtaatctgttgaccctgaaatttcctcttattctgaggtttaaatggaagaatgttgtttaaaaatgcactaagccatttcactgtaattttccctagacacttacacccttatagtcttgcccgagtatgagtgggacaatgtcacttttgctcttcgtacataagccttgttacatgggattgcagtatctttaatttttctggaagttactaatttctaattatctgaacattatgaacacttacagatttgtttatttcagttttcccctcattttcaaagtaatatgtgctcattgtagaaaagttggaacataattataaaattaaaaatctgtgagctacccataaattactcctttgatggctgcactcgtttcacttccccttttctgtggctgtgggtggatctgggagcagagctggtcccgtgtctggatcagggccgaggctcagcatgccagtgtgtggagttaggtgacagattctgccctacctctcctctcctacccagtatctagctacaccccaactttgcatgcggtcacattactgggagtgacagtagccccgctaagggtgaaacaaaatggtaccatagtggaggagggagcccggtcagcaggcttgaaggaaagagggcagtgtttatagaggtgatgaaatgctgtgctcagcttggtctcatttgcgtgtctttttgagactttagggccttgggaagaaggagactaggaaaaaaagactgaactgtattatcagtgcagggagcaggcagccctgttgtgggattcccctcttctcctttgcatggagagggacttgagaaggggaagtcacttgcctatccagagagaaggaaatacccaggtcataacaagcctgcctcatcttgtgggtggtataagcagggcagcagccatggggtgacagaaaaggcaagtagtaacagaacttgagacacagcagggtgagcaggtacctaaaggagtgctgccggcatggcatcctctgagagcaagtccacctagggtggactgggccaagggaagatgcctcactaggctggtatcatcaattttgtgtgggttaagccatttgtcctccacctcccacttttgggagaatgagagaagacgctccagagaatgagagaagacgcaagggctcagatttgcatttgatggtgggaaacttaaccctatagatttagggagtaactgttagtgacctaacctaggactactggcggggccgggcaaggtgattcacgcctgtaataccagcatttcgggaggctgaggcgggcggatcacgaggtcaagagatcgagaccattctggctaacatggtgaaaccccgtctctactaaaaaatacaaaatttagctgtgcctgtagtcccagctactcaagaggctgaggcaggagaatcacttgaacccgggaggtgggggttgcagtgagctaagattgtgccagaaactattgggggataggtaggtgtggcaaccgtttaatttttgaccaaactgggacatgatttcatatttacattgggctggacctggcaagccaggatgtaggctcaccctacatatggggaatatgcaagtcatatatacacatttaaaaatacggggagctacttttacatcttaaataccgccttgtcaagaccctcaactatgttcatactatgacatttttgttttgttctccatttttaaaaaagggtatagtagtccttattatgactatgttgccatactaaatgttttactaagaatatcgttaatggctaagtgtttcaccttctaaatgtaccagttttctttcatttttttcttttcttttcttttttttttttttttgagacagtcttgctctgtcgcccaggctggagtgcagtggcgcaatctcggcttagttttctttattaattgcatacaattactaatctagatttctttccagctatttgttattataagtgatagcaaagtacatctttacgcgtcagtatttccatagttaaattcttagtcagatttgtataattcttgatacatattgctaaactctaggtatctattttaaatctgagtttccacattggaaaactgacagttgagtttcattgatttctgaaatacggtaaaataagtggcttttaaaaagtcgctgaatagttttaccgcttagtatgtctcttgtgaccttgccttgcaaaggggtaatatagcaaagtaacaacttgaatgaagagaacagttttattgctagtgcagcatttgccacattgccataaggtgaatgtcctgcagagagactgaatcatactgaatttaattgtggtgggtgtgtggggtttaggcatacaaatacttgactctgaaaattgacagtttggcacagtatggttgaaagatcatgtattgggcgtgttgaactacgttgagttttcatgaggagcaagactctatgtctttgaagttgtgtagtgtcatggagtgctggtggcattttccacatggcatatgcgttttattatcagcatgaaattaatacattttcaggagtgggttcttccggtatgagtcatttactagttagagaatactttgtggaaacagttgtcagcagaaagagtcgtcttaacatcagcaagaactaaagctgagaaatctgctttgtgagaactgtgtacatcgctgggtcaaatgacctgaaggtgttttgtaaagccctgtgtggtaatcggttcagtcactgctaatatctaaatgcagcatgccagtcctgagatgcagggactggcatgctgcatttatatattagcagtctgagatgcccagtactgactgtggtacaacttgttctgaggggtcagaccagtttgcaaacaggaaagaagagacttctggaaaatttatgtgtgtaaagacttcctggttagtttgacagcattcctgagttattcacagctcagctagtctctaaagactccaaagacccaggaaaaattttcatatatatataaaaacaacataaaatatatataacatatattacgtattatatataatatataaattatataatatataaaattatatattatataaattatatataatatattaaattatatattatataaattatatatattatataaattatatactatatgttaaattatatatataaattatatactatatgttaaattatatatattatataaattatgtgttaaattatatattatgtaaattatatgttaaattatatattatataatttatataacacacattaaattatatattgtataatttatataacacattaaattatatattgtataatttatataacacattaaattatgtattgtataatttatataacacacattaaattatgtattgtataatttatataacacacattaaattatgtattgtataatttatataacacacattaaattatgtattgtataatttatatagcacacattaaattatgtattgtataatttatatagcacacattaaattatgtattgtataatttatatagcacacattaaattatgtattgtataatttatatagcacacattaaattatgtattgtataatttatatagcacacattaaattatgtattgtataatttatagaacacacattaaattatgtattgtataatttatagaacacacattaaattgtgtattgtataatttatagaacacattaaattgtgtattgtataatttatagaacacattaaattgtgtattgtataatttatagaacacattaaattgtgtattgtataatttatagaacacattaaattatgtattgtataatttatagaacacattaaattatgtattgtataatttatagaacacattaaattattatatttatataacacacattaaattatgtattatatttatataacacacattaaattgtgtattatatttatataacacacattaaattgtgtattatatttatataacacacattaaattgtgtattatatttatataacacacattaaattgtgtattatatttatataacacacattaaattgtgtattatatttatataacacacattattatataatttatataacacattaaattattatataattatataacacacattaaattatatattatatattttacataacattaaattgtgtattatataatttacataacattaaattgtgtattatataatttacataacattaaattgtgtattatatattttacataacattaaattgtgtattatatattttacataacattaaattgtgtattatatattttacataacattaaattgtgtattatataatttacataacattaaattgtgtattatataatttacataacattaaattatataatttacataacattaaattttatattacataatttacataacattaaattatatataatttataaattatataatacatattaaattatatataatttataaattatataatataaagttatatataatttttaaattacataatatataagttatatatgatatatattatataatttatatttatatatatatttaatttatatataatatatactgcaaaatatatataatataaaacatatattttatagtatatattatatatattatgcaatttataaaatatatattataaatatatattatatatttaaaatagaataaatatatattatatattataaatataaaatatatattataaaatatatattatatattataaatataaaatatatattataaaatatatattataaatataatatattataaaatatatattataaatatatattataaaatgtatattataaatataatatattataaaatatatattataaatataatatattataaaatatatattataaatatattataaaatatatattataaatatattataaaatatatattataaatatattataaaatatatattataaatataatatattataaaatatatgttataaaatataaaacatgttataaaatatattatgaaatatgttatattttaaaatatatattatgaaatatatgttatatattataaaatatatgtaatatatatatgcagttgattccaagatgatgaaatgtatggacgactattttctaaaaaaaaaaaaaaaaagaataacatctaagctaaagggaaagaacagctctgaatattgacttgtttagctttcattagtacttaacattgaaacagagtttttgaatgttcaggcatcactaaatctaaaaataaaatcacaaggctgtagttttgcttttagatttcccagttttcaagtgatggcttgttgtgttttatttcttctgttgtgtctccaatccagtgctccatttttgcttctttctgttctctggtcccggatttgacatgtattggtacagattcccagttgctttcaaaaggtgccttgagaactttaggcataagtgaaagctgtattgtgcccgtcagatcaatagtgtgtaacttttagaacacaaatattgcaaagataatgtttatgataccataagtcctgccatgaattccctgagcatcccatgggtgtatgtatatgatatctaggacataaatgacatgtagtttatgctttcaaacagaagtcatccagacaaccttccctccccctacaacattatcatgtctgagctcttttttcttaaaatgaaaatactaagctgcttgaagaaatgtactgctaagaggacaggcatttgattttcactctgtcattgttagctgtgactttggccaattagtgtggattttcagcaattatttcatataaggaagattgtactctgagattttaatataatagatttctaaataattataaaggcatagctcatagttgacttaagtgatgctcattttctttatcctttagataggcaaaccactccctattttcataatttgtcaccaaatacatttttcaagtctctagtagtgaaaaactgagtgtattaactccttttacaggtcaaacttctttctgatttcgggaaaattgagatttgtgtgtttattgacaagaatttttctgaggtagattgttgaaaagctgttggtttcctaatttccaggtgcatggttgcttttttggttaaaagtaagacagggggagaccctgggctgaggagctgtgaaatctctaaagaggtctgtgaagtaggttattaagaggaagtaaccttattagctggtagctggagagcctggaagcctctcttaagcagctgcatcatatccaagaactgatttgcattcatgttactatgaaaacagatcaaattgtgtctctaaatgtgtttgttttgtgaatctggaaacaacaacattcaggttatgtgaccacctgagtaactgcccggtgagactgggaagtctaggagcctgctgcggcatcctgaaaagcagcttagttcttagcaatggcagggagaagtggcgtgagtctcaaaatctgtaggaaggattttctttttccgctttttcattgatctctttcccttaacccagatactttcccatctgcaggagcaaaaggggggaaaattccatgaaacgttgagtttcaatgtacagcagtaggaaaaaagttttaatgtttcaaaggataatggaggataaatggtaacttaaagcattggtaaatattatgcaggtcgtgcatatgggatggcatacatatgggatggcatagattagtttttgtgttggaatttattcaacagtgattactatcttgaacctgtaagacctgttaaagctatttgagggtatgggtggaggaaaggtgggttacagaaatgagtctgtattcagcctgtgctgtctttcctcctgccctttctttgttcaacactccctgctccacagttctctgctgtcctcactcttgtgacagtggccttctccagggtcacacctctgacctccctggactcagtttagaggatgcttttcatttcttatctccacctcttgggagcatgtgatatgttgtcagtcacttttttgttcctgaagtgctttcttctctattgtgaagggacctggagtgctcggcctgtgtgctgaagaatgtgcagctcttctcactagtcatatctcctcagcagatgaccaaggtggaagctagaagatcagggttgtcacataatcgggtgctggaggctttagaagcaaggagggtattttcagtgggaggatcaggtgtgacattctggtagaagtagtatttatttatttattttttcttttccttgggatttgagatgcacttggcacagtgagggctcaatatttgaatgaataaaggcagggttgaaacacacagatgagggaggagtattttcagtttaggaaacacatgaacacaacatcagcagggggagaagatgaagctcatgaaggtgaaaatgaatcactctcttggctgagtggagtgatggaagcggtgggggaggaggctcgcaaatgtgttcttgccagactgtggaaggctgtgaggatcagctaaggaatctgggggactctgggcaggagaggtggttggaattgggaaaactaatctggcagcagtttgttgagtcagatgggattagaatgagaaaaacctcattttggtctcagctctggaggggaccaaagtctgagcccactgccttcgtgcttccctggctcagccctcacaaccaattcccctgttgtccttctcatttcacctggccacctggtgccatgaccagtgaccactgaatcctgtcgccttgtgtgcacagcctatggagtagtaacagaacctcatctttggaagtcatgatgcctggggggaagacagcagcagcgtgactggagttaatgtgaggcacccgacctgtgagggttagagggtctgtgacttagaaagtgaataaggagggtacctttgataggattaggaataaggggcttaaggcaaaatcagggctaagaatttaaaacccaaatagttcccggatgtgagaaaacttcgtgagaatttactttaggatttatcatcggttcctctccacatctcttttccttatatccacaaaccaaacacacccctgccgttccacatggacaccataaatagctccttttaaaaaatttgattttttttttttaaaaagcgtttctgaagggccaggcatggtggcttgcacgtgtaatcccagcactttgggaggcctaggtggatggatcacgaggttaggagtttgagaccagcctgaccaacatggtgaaaccctgtctctattaaaaataaaaaaaaattagccaggtgtggtggcatgcgcctgtaatctcagctactcaggaggctgggacaggagaattgcttgaacctgggagacggaggttgcagtgagctgagatcacgccattgcacttcagcctgggtgacagagcaagactccttctcaaaaagaaaaaaaaaagtgcttctgaggtccagtgaaggtatgaaggaaaacttgtgaaagcacttttgtttgtccagtccttggtgagattaggggtgagaccaagggtaaggagatcagcacatggggctgggaagggcaggttcctccattaacctctaccagcctgctctgctcctttttacacatttgcggtatttggtgtgtagaatttgcacagtgggttataaacagtctgattatctcaaatgatatccatgcttgatctctcttgttggtaaaaatggggaacaatattcttgaggtatttgctgagagctctaattatcagtactttagcagattcccatgacaccaggaaatctagatattttcacatgcttgagaaaacattcatgctttattaagctacaagctgtacagcaacatctggaaagtcactcagatggaataaaaccaggttttggttgaaacatcagttaatattatgaaagaattataaacatgatgttcatgccataaacttatccggttcttgcagcagcagctctcttcagctaatgaaattttcacagaactgatgatatcactgaaaactgcaaggtggtgactgcttttgtgagtgtgacctcccctcttagcgtctcccactgtctttgggagtgagcactggggaaggaggctatttttgtgaacactatctgctgctttccattcagtcgtggagaagtcaattcaactgtaagcttaagttcagcatggcataattattatctaagcaatatttcatcaaggtgcatttctatttaagtgggctgagggccacttggttgtgttttccacatattttatttatgtttgagtcagagtctcactctgtcaccaaggctggtgtgcagtggcacgatctcagctcactgctacctctgcctccccggttcaagcgattcttgagcttcagcctcctgggtagctcgtattacaggcatgtgccaccatgcttagctaatttttttgtatttttagtagagatagggtttcactctgttgaccaggctggtcttgaactcctggcctcggcctcccaaagtgctgattacaggcgtgagccaccatgcccggcccacatgttttaaatgacatattttaaatgacattcctaactaatgcaatattctgatttagaaactgaagacactttggccacctggccaaatctcacattttagatagttttcaggtaaatggagactaactggcctgcccagtgcacacagctaggtggtatcagaactctgaccttttgtattttcacttcctatttgggtctttaccaaataagcaaagcttcatctgtaaaacagatggaagtcattaaaaatcagagcattcctgttggtccagggagacaggatgcagatgatgtgtgggagtctcatcagctccccaaggcagggatttatgagggctcacatcggaacctttcctattagcaattaagaaggtgtgttcgtaatgaacagaaaggtgtgttggtgtgtggatttttttttttttttttttttttttaaatcctagtctcttagctcaggctgccataacaaaataccacagactgggtggctccaacaacagacatttagttctcacagttctggaggctgggaagtccaagatcaaggtgctggtatattcggtatctggtgagggcccacttcctgacttgcacgccaccttcttgctgtgtcctcacttgggacacgggaagagagaaagagaaaacacatgcttgagtctccttctcttacaataattccataaggtgggcttcacctttgtgacctcatctaaacttaatcaactcccagaggtgccacctcacatgggggttagtgtttcaacatatgaattttgggggaaacgcaaacattcagttcgtaacacctagtaatacctttaaaaaatgggctgtctggcagaaagtatgttctcaattgttgagaagatccagtgtatcagtaattattattcatactctcaaatattctaagatgtaacaaaacatttgaaaatattcagaggtgactagattaataattcgacttttttctacctgcttgtccagttcattaagcaaatatttacttgagcacctcttatgagtcaggccctgtgctagattctgtgccaaagggataataaaaacctgagctagagtagcccacatttggtggccaatgttaaagttatatgctgttattttctaactatcatattcaaataagttttatcaagtttccttctggtcgtgtctttccttttggatgaaatattgtaaacatagtacatagagaatactatactgaatacttcagtacttgcatttggccttatcagattttaatatttgaaggaaacaagtcaaaatattttttaatataagtaaatctctgtgagagttgaaggctcctgtgacccctcctcatcctgtgtccttaccattctataagtaaccactattgtggatttgggatgtttcattgccacatatgtttttatatgtgtacatattatacatattatatatgtatgagtttatgagtaatgtaaggtatattgttttgaaactttatgaaaataacagcaaactgtacatattctttactttttttttttttttttgagacagagtctctctttgtcaccaaggctggagtgcagtggtgcgatctcagctcactgcagcctctgtgtcccaggttcaagtgattctcctgcctcggcctcctgagtagctgggattacaagcgcctgccaccatgtctggctaatttttgtatttttagcagagacagggttttgctatgttggccaggctggtctcaaactcctagcctcaggtgatctgcctgcctcagcctcccgaagtgctgagattacaggcatgagccactgcgcccggcctcttctgtactttaggaggaaaaaaagccacattattttttcctttttgctacattctgtagttcttttttaaaaacctaacatatagcattccattgaatggttattccgtgtgtgtgtgtgcgcgcgcgtgcgtgcgcgcgtgtatatatatatattttgtttgtttgtttgtttgttttttgtttttcctccctgcggggcatggagttgcccaggctggagtacagtggtgcaatctcagctccctgtaacttccgcctcctgggttccagcgattctccagcctcagcctcccgagtagctgagattataggcacccgccaccatgtccagctagtttttgtatttttagtagagatggggtttcactgtgttggccaggctcgtctcgaactcctgacctcaggtgatccacctgccttggcctctcaaagtgctgggattacaggcatgagccatcgtgcccagcctgtcctacagtgtcttagtctgttctgttgtcagatatttttggagtgtttccaaattttcattaatgtaaatagcactgctggtgaacattcttatacatgtctcctgacgcgtgtatgatgtgtatgtgcgtttctctggggacatcacgtgagagtagaattgctgtgtggtagcacgtgagcgtctttcactccagggttgtcttcacctttactcgatagtacacattgctttacacagtagtcagattacattccctctgcattgtactggtgattttgttgagctgcatcttttccagtattttgtattgtgaaacttttgagtttttgctcatctgttgatgtaaaagtgataccttattgtttctaacttgaatgctgcattttcctgattggagtgaggttgaatatcttttcacgtatttattggcctttcaggctttttctttttgagctgcctatttataacatgtcctcttccttccctccttctttattggtgacagggactcaggttcagagaagtagattaatcataatccttgattcacaacccattattatcatttgtgtttgcatggcccttttatttgctttatttataatataatgaacacctacgagctcatcaggttctgagacattaccaacaacttcctgtgcttctcctcactccgtctctcggcctcttccctctttatatatgctacctgagctttattattccttatctagttctctttgtggtcctctggggccttgcttttcttattctccattattatgatttatccaagttgttgtgttggctttggtctcattcctgttcttttgtagtgtctgctctgttttgcttatgggggatttttttcttttgtgtttttagtttcactctgtgaactccttttcagctgagctttctctgtaggagtcctggggaatgtgggttgaaggtgtattaaaaatacaaggtagttggccaggcgaggtggctcactcctgtaatcccagcactttgggaggccgaggcaggcggatcacttgatgtcaccagcctggctaacatggtgaaacccgtctccactaaaaatacaaaaattagctgggtgtggtgatgcatgcctgtagtcccagctactctggaggctgaggcaggagaatcacttgaacctgggaggtggaggttgcagtgagccaagagattgcaccactgcactccagcctgggcgacagagtgagactctctggaaaaaaagaaaatgtgtgtgtatgtatgtgtgtgtgtgtgtgcatatatgtgtgtgtgtgtgtatatgtgtgtatatatgtatatatgtgtgtgtgtatatatatgtatggtaggtgtttcagttcacaaaatacttagcaatattggggtaaaatataacacacacatatatatatatatatttttttttttttacaaatgtacagttgtgattataaattctggaaagaatacccaggatgtgccagtgaagaaagaacagaatttcagagcaatatcttaggagttgaacttgcatcagagtgagaaacaaaatgcctggagccttaacagttatatctagaaaaagaatggggccttgaaaggaggagttggacctgggatctccccgcatagctatttagccaaaaatacaaagaagtttgtccatctcagcctggactcagagtagggaataaaagtactcagatcccctcctaaaatgagaaagtatcagcctgccctcacttctgaggcttcatgtgtatactgctcaactgtccaggaatcaccaagtcagggagttaacataatgcggagccatggatcctcctctgctgaggcgccttgcagaaacaaatcatccgtgcctgtgtacgtgccttcccccttaacagtaagcttcttgacctttgtacattgatacgtatttgtggaatgaagaagtgaacaagtagaaacacataggcattcttaacagaatctaaagttccacctgcaaagtaggttcagcaccttaaaaaataaagtgtagaagggacattattttgcccagtaaaatgtttaattttcaaacagttctactattcttaaaatgttctgcagatcacagactgcagtgattgagtagcctgctgttgtgtgtgttgtgaaggatacaaagactgccaagtgttttacccttcgggagctgtaagtgtaggggagggacaggctcgaacacaaataattatggtggaaagtgcaaagtaagtgccacaggaaatttacagagcggttatggttttgcagaggttgtgagtgattcatttcacttcagaaatttgttcattgagagaacacttagtagagcttcttgtgttgtcagcattaggaggattataagaatacctaatatttattgtgcactcactcatgattaggcaggcaacattttatgtcaatctttgcaacataatgttaattctcacaacattcctatgaagaggatcctataattatctccatgaaattttttttattgaaatgtaccacatatatatgtgcacttttatgagtatacaactggttaggttttcatgagtcacattcaccagtgtaagtagcatccagagcaaaacagaacatatacacactcgacaagtgtcagggcttcaaagcccccaagaaccataatcttgacttctagtagcagattttttgggattggtttttgtgttttctggaaattgagttatatggtacatattttgttatgtttcatgctattgcatgtagtttgggattgttcattcccattgccattgagtattccattatctccattttacagatgaggaatgttgagactgagatgttaaagtagcccaggatcatgcagtaacaaacatgttacagtaccatttagtgttttttgaaacatgattttaatgttcttgtggtgttctatcatgtaagtataggacagtgtaaccagttccccttctgatagacatctaggtggtttccaacatgttatcactcatactttaccataaaaattcaatatttaaagtacgttttgaggtttccagctgcttttgcagttgactatagtcagttccatatagtgtggcagctagtgaaatattaatttcctttgtggctttctttgtaaggtagcagctgccggtcaagggtggcctttgtagtttttttccttagagacagggtctcactgtgtcacctacgctggagtgtagttacaccatcatagctcactgcagccttgaactcctggccttaagtaatcctcttgctttggcctcctgcagcgctgggattacaggtgtgagccaccatgctatgcccatttgagttttgatatgtaatctacttgccttttgaaagtgccttgtaagagtactactagtgtgtttacttttttaccttttatcctacgtttgtctttttatacctcctctccctttttcctacaaaacttcctgtaaggagatcttggttctgctgcagtcaaaaattatattttttccttgagggttagctctgctctttggcctgctaatgagtcttacagggtctctgtgggtccttcagaggagatatatttttacgaaacattctccggtgcagcagtttacaaacgcaacttctggagtgtgagctctttgaaggtaggagctgtgtagtattcacgtggtgcttggtacgtagtaggtgctcagtaaatgtgaggtgactggatgaggagctgctggagcctcagatttttatttattttttatttttttaatttaatttaatttttttttttttggagacagtctcactctgttgcccaggctggagtgctgtggcgtgatcttggctcactgtaacttctgcctcccagattcaagctattctcctgcctcagcctcccgaatagctgggattataagtgtgtaccaccacctccagctaatttttgtatttttagtaaagatggggtttcaccatattggacaagctggtctcaaactcctgacctcgtgatccgcccacctcggcctctcaaagtgctgggattacagacatgagccatcatgcccagcttccttttgattgacctttacaatattatgtttttttgcttttgggaacatgattaatttttagacttctcaaacagaaatagaagacctagagctatttgtttataatttcccccccttcttgtagtagaggaggaattatttagtaatgtgatagaaaataagtttataatagttttgtaaaaatattaagtttcttctattttctccattcattgaacatttgttgaaaccttgctgggtcccatgcaatagggatagaaagatgaatataattaatccttgcccttggggaatatataatctagtgggagagacaaacacacgtgtacttacccattgtggtaaaatatatttatatatctgtgagcattttttttaaaagcgtagtggaaggagacacctgggaggttgggaggagggccctcctggaagagacaacaacggagcttcctcttagaggaggtacataattcctcctcagtctggtacccaaatactggttcatctctttttttccttatttctttttttttatttttcttttcttgagaaggagtctcactctgtcgcccatggctggaatgcagtggtgtcatctcggcttaactgcaagctccgcctcccaggttcaagcgattctcctgcctcagcctcccgagtagctgggatcacaggcgcctgccaccatgcccggctaattttttgtatttttagtagagacggggtttcaccgtgttaaccaggatggtctcaatctcctgaccttgtgatccacccgccttggcctcttaaagtgctgggattacaggcgtgagccactgcgcccggcctgttccttatttctggaatgctagtactggccatagttataacattctatgatttctaatgtaaaaacctcgttcttgtcttttccctcatgccatagagcccttccacggaggcttgttgattttagctctgaaatgattgtaggatgtagttttcctctttctcttcccttctctctgcttacattgctgtctccttggtttggaaggacagtgatggaaataatctttgtgtttgaagcatccggcctggagcatggcatatcatggggttcaaagttgttaaatcaaaaggaactgaatagcctgtaactggttttctctcctctagtggccttttcctttcatttaattctattcaatgtcctcaaagttattcaattttttttttcttttggtatcacttctgtgtttaaaattcttccatgactccttattaccctccagatgaagatccaacctcttagccaggtctttacactgaccccagcatgccttctatgttcctcacccttccactgccaccattttactgtgtgcatgtctggagttgtttgtttttctcatggtccaacgtaccctccccactttgttttgttttgttttgtttttgtttttttggagatgaagtaggctggagtgcagtggcactatttctgctcactgcagcctccgcctcccaggttcaagtgattctcctgcctcagcctctggagtagctgggactacaggtgcgcaccaccacacccagctaaattttgtatttttagtagagacggggtttcaccatgttggccaggatgatctcgatctcttgacctcgtgatctgcccgcctcagcctcccagagtgctgggattacaagcatgagccgttgcgcctggccagccaacacgcccggccccctccccattttttatttgtcacttcggtctgatgttttgagatccagtcttaaccctgcgaaaccttctctgcctttcccagaaagagttaattgtgccctctgctatgttccctgagggtctgtacagtcaatcttttttagtggcatcccatctcatctagctcatcccaccccaacccatcccatgccatctcatcccatccctctcctctttgtcctgtttccccatttcatctgtctcttacattttcctctgcatttctgattagatcgaggaccaagaattgtgactgatgcttctttgtcccctgttcaggtgtttcttaagtggcagatgaatagttcctccctgtactctcctgtaaacatactttttgcttttacatctcttcagttttgcttttacttttttttttttcgtaagggatacattctttcagtagctttatttaaatgtagtgtgtggaccgtttgttgtgaccttctttgaaattttctctgatcatggcagcccaaaatatcggtacctgcctctgaaccatcttcgttgtctctggctgtgttacttatacaacacctgctattattatttgtatttttgttttatatgtttcatccctccttagattataaactctgaagttagaggtcatcttatagacaattttgaatcttctgtgttaaaaaatataattttggccaggtgtggtggctcatgcctataatccctgcactttgggcagcctaggtgggtggatcacttgagtccaggagtttgtgaccagcctggccaacatgatgactttgggcagcctaggtgggtggatcacttgagtccaggagtttgtgaccagcctggccaacatgatgaaaccccgtctctactaaaaatacaaaagattagccttggctgggtgcagtggctcacgcctgtaatcccagcactttgggaggccaaggtggtgcattacgtgaggtcaggagtttgagacactctctctctctctctctctctctctctctctctctctctctctctctctctctctctatatatatatatatatatatatatatatatatatagactttttacccccccacgcttgaaaaatgtgctacttcctttagtctccatggtttcagatgggaaatccattgttcgaattggtgttccttacagatcatgtatcatttctcacagcctgctttcaagcagatttttttctttgtctttagttttcagaagactagttattgatgtttaccattgatcctagccttggcctgaatttctttttgtccttttttttttctcttcgagatggagtctcactctgtcacccaggctggaatgcattggtgtgatgtcggctcactgcaacctctgcctcccgggttcaagcgattctcctgcctcagtctcctgagtagctgggactacaggcatgcatcagtatgcctggctaatttttgtatttttagtagagacgggatggggttttgccatgtttgccaggctggtcacaaactcctgacctcaagtgatctgcctgctttggccttcctaatgctgggatggcctctctttgtttattctgatcataaatttgctcagcttcttaaatctgtttatgtcttttaccaaatttggaatgttttcagccattatttctttgaatattcttttagccctattctctttttcctcttggggctcaatgatacaaggctggatgttttgctgttccacaggtctctgaggctctgcttattttcacagcctgttttctattgttctgatagagtgaattctgttgtctttcctcaagttcagtgattttttttatcctgtcattttcatcctactattgagcatatcaagtgagtttttgttactgtacttttcagttgtataatttatatttggtttttaaaataatttcacttctgagattttctagtttctcatttgtttcaacagaatttataattgattattgaagcacttgtaagagggttgctttaaaatcctcatcagataatttcaacatctgatttatctcagggttagggtcagttttttggctaaaatgggaatttgacttgggattttcctggttcttggtatggtgggtgatttttgactgtattctggacattttgcctatcttttttttgggggggtgcgggcagtgggaatgttctgaatcccatttaaatcttttgttttagcaggcagccacccagttagtcttagcacacaggtcctgccctacatttgtgggctgtggttccaatgacagtttaactttcagagcctttgtggtgtttgtctgcttggtggttagatgccgctagggctgccgtctcatttccccctgctgttattgctggctgtggaggcagaagggatttccctaggctgggctactaggtgtctcccagtgggggaaacgtagtctcaggaccctggagactgagggactttcctgactgtggcatagtcccccttcctgtgggggacagagagctcttgagccagacacttgttgagatggaatctctctacctgtgccccacggttttcctcatgtctgtgtgcaatggaagggcgtcttaggcccatgtgaccagagaggcttcctgggccaggtcacttgtggctggggagtcttgtgtctgccctattgcatatgtcgaggctcccctagttattgttggtggggctttaggttggtccttcttttggatggtgtaggacttatctgatgtgagggggactcgtgtttgatctgggtcataggaatgagcctacctgagctgccttttgttctcatgtcatgggttgggaaatggtgggtctgggtgaccactttgcatagggggatgcaagatactgtttcactgagctgttcttccatttttggggtcacaaactggtttgttttcttcttaccatctttcagagttctcctttggttatctcctctgctatttccagggtttatagcgcttagtagggaggagcagagagacatagttttctatgctgtcttgtgccttgtcattcattatttttttcctttttcttttttgacacagcgtcttactctgtcacccaggctggagtgcagtggcacaatcttgtctcactgcaacccacgcctcgtgggattaagtgattcttgtgcctcccaagtagctgggactacaggtgcctgacaccatgcctggctaatttttgtatatttagtagagacagcgtttcgccatgttggccaggctggtcttgaactcctggcctcaagtgatctgcccacctctgcatttgaaagtgctgagataacaggcgtgagccaccgtgcccagccttattcattcttagatgttggaattttaaaaagcaatgaaaaatgtcagcaaaatttagcatttatttttctacgttcagtaaaacatatctctcaggggtcttatggaggtaaggaaacatgagaaccagttaggttaaatgactggtcctggggctctattggtcgttaattacagaacacagactagagttagactcctcttaatgaatccactatttgtttctttgtagcaaactaagttgaagacttctctataagaaaagagaagagaaccattgctgtgctgtaatgctctgggctttataatgttaacacacaaaataatttatatatcaagtggaaaacctctcagaatacaggaaaagaatccagtgttcaattatattaagagtgaataacatgctgtgtttgttccaattttagtattcatcattttttgtaaagtgtaaaataacataccgtctgttttttactataaaacatttgaatggccttataaaatgtttcttgcaaaagaaagttctctcactggttatcatcaccatttgtattatacttcaaagagagtaaagaatataatgaaggttggtggcaccacccaagcgaattaatctcatagcttagcattatgtgggacttttcatcaggtcatcgctgtttactccacagacatcagatacctctcaaaatagttctccatgaagctttttttcctctgctgcagagatggagaaatggagaaacccagaagttaactgttaagttgtttgtaatgttttttgaagtccccagggattttacagaaaatggagccggagttgaactcatcccaaaactctttggatgtctgggatgggaggcattgatttctctccctgaggcacagcaagaactaggcagagtaaataggactaaacactggccctgtttaatgtcgcttgagtaatgatgcttgagtaatgatgactgacaggtcggaggagtggggcgtatgaggatggactgactctgtttttcttctttccatatggacttattccttttgcttctacttttgtttttccttcctgttccctacttaatagtcttgctgaaaaatatatctgacctgtattgaagaatggaattaaacatactgggttttggagaacttttcccatcactcatagtaaaactccaacataggtgatccataggctaaaatgagatgttcagaagttagggtgaagcttcttaaaaaagtgatagtgtgatgatggttgattttgcaaacttgttttctctaaagcataatatagctgagctatgatcctaaaggtaaggtggtaggtagtattaatgccagcaatgtactgactgtttactggctcagactcaaagactgttagcattgggcagggccccctttggaccatgtttgtagcctctctgtcctcagcagagtgtctctacaatataaatagtggtatttgtgtctcgtagttacttgtaatgaagcagcctgttgtattgcaggtggccagctctgcttcgcaggaaaccagctctgcctccctgtaacttctacttacactggttttttgttgggtctctaggaccatgcagggtgaatctaataattgttcttgttaatatctgtcaaaattcagaacagatgttgtgactttaccttctcaaagttgtttctcatcaatcttgaagactccttatcctgctgttttctgcatgttctgttttgccggtatcccttcaaaatgtggtcctccaaatgaaacatggtgcccccaaagttttggagaactcctttgctgtgtggaagtgcggactgtgacatgtaagggtttggggtctgtaaattctatttatcaacctctctccactttttttcccttagttttgtttattgctttttttttttgagatggagccttgctctgttgcccaggctggagggcagtggtgtgatcttggtacactgcaacctctgcctcctgggttcaagcgatgctcatgcctcagcctctcaagtaactgggattacaggtgtgcaccacaatgccaagctgatttttgtaattttagtagagatggggtttcaccgtgttggccaggctggtctcgaactcctggcctcaagtgattcacccgccttggcctcccaaagtgctgggattacaggcatgagccactgcatccagcctatttatttttctttttttattgatacataactgtacatgtttatgggatacatgtgatattttgatacatgcatacaatgtgtaatgatcaaatcagggtaattgggatatctattgcctcaaacatttatcatgtgctttgggaacatttcatatcttttcttgttattttgaaatatttttaattatagtcagccttctgtactgtcaaacactagaagttattccttctgtctaactctgtttgtacccattagccaacctctttattgcccctctcccatgcttccctacctctggtaaccaccattcttctctctacctccatgaggtcaactttattggcccacacatttgagtgagaacatgtgatacttgtctttctgtgtgtggcttgttttacttaatataatgacctccagttccatccatgttgctgtaaattacagcattttattcttttctgtggctgaatagtattccattatatctatctatagaccatgttttctttatccattcatccattgatggacacttaagttaattctatgttttggctgttgtgactactgctgtagtaaacatgaggtgtgcaggtttccctttgatatgctgattttctttgccttggataaatattcgatagtgggaatgctggatcatatggtagttgtatttttagttttttttttttttttctttcaggttcaggggtacatgtgcaggtttgttatataggtaaactgtgtgtcacgggggtttggtgtacagattattttgtcatccaggtaataagcatggtacccaataggtagtttgtttttgatcctcaccctcctcctaccctccaccctcaagtagccccccaggtctgttgttcccttctttgtgtccatgtgtagtcagtgtttagcttccacatataactgagagcatgctatatttggttttatgttcctgcatttgcttaggataatggcctgcagctccatccatgttgctgcaaaggacatgatggtgttcttttttttatggccatatattattccatggtgtatatgtaccacattttctttatccagtctactgttggtggacatctaggttgattccctatctttgctattgtgaatagtgctgcgatgaacataaatgtatgtgtgtctttatggtagaatgatttctattcctctctgggtatatacccaataatgggattgctgggtcaaatggtagttctgttttaagttgagaaatctccagactggttgaactagtttatatttccattagcagtgtataagtgttcccttttctccacagccttgccagcatttgttattttttgactttttggtagccattgtgactgatgtgagatggtatctcattgtagttttgatttgcatttttctaattatgagtggtgctgagcttttttttatatgattgttggccacatgtatgtcgtcttttgaaaagttcttgtcctttgcccactttttaatgaggttgttttttgcttgttaatttaagctccttataggttctggatattagacctttgtcagatgcatagtttggaaatattttctcctattctgtgggttgtctgtttactctgttgatagtttctttttgctgtgcagaggctcttttgtttaattaggtcccatttgtcaatttttgtttctgttgcagttgcttttggcatcttcatcatgaaatcttggctaggtcctctatccagaatggtatttcctaggttttcttcaagagtttttacagtgtcaggttttacattgaagtctttaattcatcttgagttaatttttgtatatggagttaggaagggggtctagtttcagtcttctgcctatggctagccagttgttccagcactgtttactgaatagggagtcctttccccattgtttgtttttgttgactttgccagagatcagatggttgtaggtgtgaggctttatttctgggctctctattctgttccatttgtctgtgtgtctttgtaccagtaccatgctgtttcggttactgtagccatgttgtacaatttgaagtcaggaaatgtgatacctccagctttattccttttgcttagaattgctttggctattcaggctcttttttggttccatgtggattttagaatagtttttctaattctatgaagaatgtcaatggtagtttgataggaagaacattgaatctgtaaattgctttgggcaatatggccattttaacaatattgattcgtcatatcccttctcttcattttttaaaaaactagttcttagaaaaccaaagcaaaataataatttataatttaaattaggccaggcatagtggctcacacctataattccagcactttgggaggctgaggtaggaggatcacttgagatcagagtttacggcaacagtgagctatgatcacaccactgcatcgtgggcaacagagcaagaccctgtctctttaaaaagatataaaaaaggtaaattaactatcttactcatgtaatattgcatacagtgtggataacacgcctatgaaactttatgctaacacaaagggctaataatcccaaactgtctcaaatttaagattatttactctccaaccctgaaggctaaaaagaagcccatgtttgtacttatacaatattttccacccaatgagccctttattataataaaatttttatttataaaatccatactttaagccttttgtttatatttatttaactcacaagaactaccatgcacacatactgacggagctgagtgactgaatccaggcagggcagatttgcaatgctgagagctctccccacccatcttaccacctcagtgtccagagtccaggcggctttccaggtcggatcaaatttactctaaatttgtctaaatcggctctccagacattatagttacatatatctattatctcacttttcataatgttagtctcatttagacttttgtgttagtttgtccaaaagtgtttcaataccagattatagtaatgccagattatagtaatcagataacatatattattatatatgaatattgtataatatataattcattattaatataatctggcattatatagtaccagattaagtaatcaggggctttttttctgtttttgggggggcgggggatggagttgctgcttatagatcaatgcctgtctgaagactgttgcttatgataaggagtttgctgctttcatcaagaaagtattgctgtgggaaaatgttagttaaactaaacaaaggtgcttagtgacttggttaatttacattctatacagattccttgtctggcaggtaccctgtgacaaacccttcaggcgccagcatattatcttttttgagacaagatgtcattctgttgcccaggctggagtgtggggatgccatcatagctcactacaaccttgaattcttggccttaagtgatcctcctgcctcagcctcctgagtagctgggaccacaagtgtatgccatcctgcccagctaaaggggccaacattttgaatagcattgcctgtaggtgccacgaaactgcccctgccacccagttctaagaagtagatccattggttttccaagtctctagtaagcgtgaaacccggtgaaaggatgctacgcctaattcatatgtcaaattaaacctaacagcccagtgccatttagtgtgggggcaggtaattctgctgaacagtttgagaatgaaactttgaaaatggcaaggtcatgagttaggaattggagagacctggctttgattctggttttactgtgtgacatattttgcttcccttgaggtctgttcccaccccccaattcatgaaatggagacataagatctaccttgtaggatttctaaggattaggaatgatttttatatgaaatatcctgcataacagtagatgcttactattgttaagaattttgaaatgataattaaagctctaaaaaagaaaaaatataggtgattgtattaggtaataaaaagtatgacatgaaactattgttcaaaaggtgatacaagaagaaaaaggaacagaagaacttatattccagaattattttttttttaaatgtaggaaaattagaaaattaaagagaatttttctgaaatggtcaggaacgtaaagaggtcggtgtattttaagtgtgtaagtgacagaaggaattgccttcttcaaaataatggaaaaacatttgactacctaaaaatagagagttcaaaagcataatccaaaaaaaggccataaagaggaaaatatttgaaaccaaattattatatatcaaacttgtaatagagcaaataaagactgtatatcaatggcattttataccagagacataattgtaatcaaataagaaaaaagcacacaaaatcaattttgaaaaaagttgaacaaatagagtaatgaaccccatatcacttggtgactagaggatgctagcagtctcctgcctagtgtcctttgaactggagcctgaattgtattaatggtccagaaaaagttcatgaaggtcctcgtcctcctttggttgtatgggtgtataggggaagagagaatcaatgatgaagttaaatccagagtatcagtaataaaaaggtaacgggaaaatgtgctttataggcatgtggatctttgttcaatgaataattatttcttacatgtctttttgtggtcttttcagtaatctaccgatttagaatcaaagctagttgaagttagaaagtatggatcacacatcctgccactgtgtgcatctactttatatacaactaacaactgtgggaccccagttacaaaggctgtcggaggtgagcccactgagagctggcagggggtttcttatgcaggttgtatgtgggttttggagaaggtgagagaagtgcattctaggaggaaggcagagcatgtacaaagactgcaaggaaggaaaaaactttggcatttttttttttttccaggaacagaagggaggctgttgaagctggagttaggttagcttaggggttgatgaggctgcagagtgagcagaggtcagatcatgcagggtctttcaggctctaggaaggaattggattttatcctgaatacaacagaatgatactgaaggttttaagcaggggagtaaggagatccaattcatattttaagttaagttttgctgctgtgtgggagttgggttggaggaaagagtgggagcagagtaatgtgttcacagtggagatagagaagtgagcagatccgtgggatgtttgcatgtagagtgaatgtgtagggggttaagggaaaggcaggaatcaagcatgatttgtcatagaatgatttcttgccaaaaatgacaacctaaaaacatttggcattttggagcattctcaactctgggccccctctggttctgcactcttctaggacctcattttagctgccttttctccctctgccccctcccttctgttctgctctccatttgtgtctccttcttagtttaattctctattttcaactctagatttcctctactttttccttttaaaaactattcttgccagctgccctggtggcacctgttgtcccagcttcccaggaggccaaggcaggaggatctcttgagcccaggagttcctggctgtagtgtagtgtgcgatgttaatcaggtgtctgcactaagtttggcatcagtatggtgacctcttgggagcctgaggaggagccaactggcccaggtcagaaatggagcaggtcaaaactcctgtgctgatcagtatagcatcatgcctgtgaatagccacagcactccagcctgggcaacatagcaagacctcgtctctataaaaaacaaaacaccattccttatttaattttaatcacctttcttcaaataatcgacagtcaaaatttctggccctgacctctatctgcagccgtttgtggaatttgtgtagttaatctgctgcattctgaaatagctaacatgcattttttttcttgatcttaaattagcttcctctcttgacttccctttttctttttaatggttccaccaatctttgtcatccagacaggataacttagtaatatttgattcattattttccttcactgcaattcaacatgtaaactccaatattggttctaggttgttgatgaagaaactaaagctcagaagcattgtcacctgcccagagtcacacagctggtcactggtgacacgggtttgtgagccccactctgacttcagacccacattctcaatcattgcactatactgtacaccagcggtccccaaccttttcggcaccagggactggttccatggaagacagtttttccatggattgggttgggggatggttttgggatgactcaagtgcatgacatttatcattagattctcataaggagtgtgcaacgtagatccctcacgtatgcatagttcacaatagggtcacgctcctctgagaatctaatgcccctgctgatctgggacccagggcttggggacccctgctatacgccaaggagatttaggataacgcttttccaaaagatacctaactttactttgtttttaatatatgctaaattttaaggttgagactactgctattaacaactgtcattctattatttagtattttctctataagtatgtcacatatagtatctctttatagagattttcaatttcttatagcagcttatttacattcaccctttttgagcgggaagaagaaaggagtgatattgagtggtgggcacaagattctcccttttttcttccctaccattacaggcgagagatcatttacccttgctcctgcaaatactgtttcattgttcgaaacatagttggccatctggcaaaaactgttatttaaaacttgcattcttttattactagtgaagttggaaacattttttggtgtttactagtgatttctatttattttgtgaattgcattcattgttcacagttaacattatccccattattatcattggcccttagctctgaaacttggtagagatgaattaaaaggtgcaaccagtcttctaacttctgcatcagaaattgggttgaagatgtcttacatgaacctgtggcttctgagtatttaacaaacttttatattaaccatctgaacgtttacatctcatctttaatacaaattctggaagtggtggtgcagagttgccagtctgagagattcaggctcagctggagaatgtgttgggcctgaagtaacacaactgtaaacctatttgtggagaacctaaatgcacatacagtgatttgcctccacatcaaagacctctctgtagtgccttagggtatggtgagggcagtagtccagatagagggccctcagtgactgtcccatcttttagaacagagcccacagggttgggttcttgcaagatctatctggggaatcttcctaaagccatcatgacagggtctgtcacttcattaactcaacaaatactaattgagcatctactctgtgcctcattttgttctagatcctgtggttatggcagtgaacaaaatgaatagaaatatccctgacctcagagtttcccttcggggacaagtttagctcccctggaggctctccatacttgactttctcaagtctaactctttctttgcttcctagctcctcgccttaatcctctttttcctgtggcccttagatcaagcctggcttcctcttcattttcagtgttctgctactaagttcaacagcttctgttaataagggacttcttttattcctggcttcaccatgtcctagctgcaaccctcagtcccacccaagtcagactggtaagtgcgggccccaggcccccagtgtcctcttgtgagaattctctttgtcttctagtagctcctcgttggaatactggccattcttttaacacattggcttctgaaataagtgtagaacatgtgtgaacccactgtgtatattggggttcactgctccctagggagtttggtctacctgaggcatgtgatttgtgtagatcctcaagtaacagcccagggatgacaatcttgacttgtaagcatggccacattatcctgcagccctgactgtcctgataattgggtaccatccattctttttgttttacttaaaagcagtttatgctcagtgaagaatatttgaaaaatactgacaaatatgcaatggctttttttaaaaaaaaaaaacaaaaaacaaaacactggttaaggttttcttttgaggggggagcttaccttctaaacagctgttttatgtgcaactgcatacttttctcctgctttcattgatgttttacaagttgacatttgtgtcttatctgtaacctgcttgcagattggtcgctagccacttgcagagtgcaattaacaagagtgagctccgatataaagatggtgatttatttccaaagctagcttagaggaagaagcacaggtgtcccacctccaaatgtaccccttagcttttggagcagaaagtgggcacttttaaaagtcaagggagggtgtaagcaaggtgggggatacctgtgttagcttggtgccttatcaacgaggcggctgagctggtgactgctggggtcttcatgggtgtgactaggccctaaacccctcaggtgggagagagtagtgggaatgtttttcgactgttctctcgaggcaacctcctgatgggtgagagttgcatagcaggcatgccttggtctgtaaattgactaactctcgaggacttggatgaacttagtagggaatggctggtgaaggagggagtaaaaagctattttttagcatttctaaaaggctgcgtaggaagtggggaatgaaaaaaagaaaacatctctttgaaaaatggggtacttggttacatatttatgtaacaccttctccctctttgaacacagctagttttcaggaggtccaggcccgtgtcagtatgctctagggtgctgtggatgatgttgattctggggtctagcttgaccttgcttgtgaggaatacttcacagacctcactacccagccagcacattcattttctaacagccacatttccagatttcctttccttccttctttcctcctgttggctttgtgttcctcagtgtagctctccgtttccttccagtcttcctgggaactgttccttccccaggagctgcccataaagccttttccccacctctgcttctttcttctcttctaatatttcaacatagtcaagatattttgattattcacatacattttacaaggacattgtaaagaaagggctttgtggcccaactgtggtctgagcagtgtttgttccccacaccgaggcagcatattttgatggtttagactgagaactgaacccaggacccaaagcctggctttaccatttaatgtgatctgacttctgtgccccttcttatgcttgtctctaaaatacagtgtgaaaatgtccatgtaatttgttatagtgagcattaaatgcactagtacatgcagagtactcacttggagcagcgactggcacaaagggagtgttaaataaatattagatggttattgcacatacttaacctgcttggaagcactggtgtgaaacaattttccagttaataatgagtgttcaaatttctttatgttgaacacagttccttatgtttcagtggcccatctcatggactcaggtactgcctgttgcaattttttacatggattggtttctgcctttaggagccttttttttttttaaataaaagaattgtatgtgttaatgtagtaaagtcttcaaacataattttggcctttaagggatgtttttatactcactggcctatacccgagttgtcactcatggcctctgctagctacttcacagctcctgtgaaggacactgctctgcccacagcccctgctggggagaaagctctctgaggactgtgtcctccctcttctccttttcctggggtggctgatttgattgggatgggacaccagatagctacctctgtcatggccttccgtgggaaaaacatgagccaagccaatttgattctcttgagaattttaatttaggaaatcagaaggaaaaagccgtgggagccgaaattgaaagaatgccatgaactaatggcatgaggacaggcctgccaggcagtgacatggcagcaaacccagagtctgacagcaagaattaatagaagtagaagagaagatgtgacaattgcacgcgacagagaaaactaaacacacagagagaagccaagttaggttaatggcagaggcccagggagaagatctcagacatagctgtactgtgagttttttctcaaagcaagttgctcacatgttttcctggtctcttcgtaattgtattctcattatttaaggctttgcattcaaaaggtcctaacttaacagcagctatatagcatatgtagtcctttcctttcccatcgaaaggattactctcattttgttcttattgccttaatacctcttctgcaatttaaagtgatataaatttaactcactttttagtactatcttcaagtctccatattccatgctgtgttttcctgatagcagtaatttattttcttcttttttttggaatatgtcttctattgcactcctgtgaaatttgcaaatctggacccctccgttcctatgcaacacgggctggtgatttctctcagatctagggcatggactccttagggcagcagcctcaccctctttgtattcgtacagcaccatgggctgtgctgagcaagtgatagatgcccaacaagtcgttggtcgtttcttgtggttcatttagttcttatcatcgtggcttgtcttggatcacaaaagaggatgttttagccctttgctaggatgcatctttttttttttttccaagctttaaatttatttgaaggaaaataaatattaaagaatttgagagaaatgagggagttatacagtaactgttggctttgattgggaactaagtttctcatttgtgccgtgaatgttgttactccaatggcagaggagtgaacaaactcatttgttaagcgagatgaacacctgacagctaaatccctactaatatttgctttgggccctaagtgtattctgtggttaacaaggtaacttgtcttgacattactcccacatgtgggagtgtttttcttttggtattccctttcttagcatatttgggaaaccactttatttgccaagttactatatttgctaccaaaatgtttgaataatgctgtgttttgtcattgagcgtaacttccatgatctttaaaaacaatgctttgaaatagtgttctcatctgtatattgtttctcttgtgtcctaatttcttctttttataagaacacaagtcatattggagcagggcccattcttaatgacctcattttaactgattacttctgtaaagaccctagttccaaataaggacacattctcaggttctgggggtttggatttcagtatataaatttggggagaacacagttcaacccataatacagaggaaccaccaccctactaattaccatagcacccattaaaccaggctttcttggcgtcgaagccaagaagcttaaaagatttgtttgcccctagagtccacagtcattaggttgagacttctgagtctcactaggtgttggcatagttaccagaaaatccttaaaggaccctcctcatctctcacctggatcaggacaggagcctcctaacttgtcaccctgctgccgcccttgtccaccttcagtctgctctcaacacatctctgggttccactacttcctggttgtatgaccttgggcaagttgggtaacctgtgtctgtgtcctcttctgttgtagtgatagttaaccgaatctacaaacgtaaagtgattagtagagtacctgatgttataaggtgtggtagccagaatggtggccctccagtgatgtcctgtcctaatcatccctggaacctgtgaatatgttattttacatggcaaaagggactttcagatgtgattaaagaccctgagattattggccggaggcggggggcggggggaggaggttatcttggattatcgtagggcccattgtaatcacagtggtccttaaaagagagaagagatgtgatgacagaaacaaaggtcaggctgggcactgtgtctcacacctgtaatcccagcactttggagggccaaggcagggggatcacttgaccctaggagttcaataccagcctgggcaatgtagtgagaccccatctctacaaaaaataaaaaaataggcgataggcgtggtggtggtggtttcatgcctgtagtcccagctactcaagaggttgaggtgggagtttctcatgagcccaggagttcaaggctgcagggagctatgatagtgccactgcacgctagtctaggtgacagagtgagacagtcctgctgacaccttgattttagccccatgagacttcccccattttagacttctgacctccaaaaactgttagataataagttagcgttgttgtaagccactgcatttgtggcaatttgttactacagcaataagaaatgaatacgtaagtgtcagctgttttatctggttttcctgttcctactgtaaatgagattttctttaaacagaggaatctgtggccaaagacagttggaaaatgagtgggctaggtggtcgccagcattctcgtcctatctcccatcctgatgtggcaggtactctctccagacagtgcctagccccagtagtttctcagcatttgtggaatgtttagggaaggctggatggtggtctccagtgtggagctgcctgtgggattctctccagtccccacatcactcctgaaggattcttcataattatttggctattttggtgtttggttgtctgtcatgtgcaatattggccttgagctctgtgctccaggtttatgggtttcttttggggcctatgcacctttgtgggctctccttgttttccttttactccataaatttgtcacttcaagtcattcaagtgacttcagatgtgtattctgtgataagaattcattacacagacaccccaggcaagctggactcagagttagggccaggaatgctttaccagaatagagccagagacaatgttggcccatgagctgcttctggaacagcctgtgatttggcctttaggcctaacctagccctgtgatgcattctgggcttatgagttgtttgcagcattttttaaatctaaaaaatgagttagttatttgctttattttttaacctgtacagagaagccataatgccatttttgcatatagtaccactgctggttttgtaaaacaggaaaacgtgaaggaaaatatgaagctagtctacaatcctagaggaatttcatttcacttccaagttacttggattaatgtcaacattatttcactggcatgaagggtactaaattcttagagtctgtaccctgttcctctttagataaaacatgaaagaattttggtgcgtgttttgatgtgcagagtcaggggcagctccctcagcagacctttgcgtagttgataatctaattatgtggctctctacataaagaatatgagcttccaggtgcaatttgtctattttaaaaagggctatggaatctattatgatttataaagaatcttgtattcagatttaatgagtgacaagagtatatttattaaccataccctttttcttttcaagcccaggattatagaacatgctgcatttctaaaagcatccccattagtgctttcgttgctggggtgggaagttgtaggagttaatagtgacaacttcatgacgagggctcaggcttgtaacttaaggggttatcctgcactgacagtgctgcctagatgggcagtcaaggtagggtgacccaaacagagatgctccccatccccccagcagagtgtctgtttgtctaatatctcatggtcttaactaaaaattgttgataaataggtggctctgctataagaaataattttctcagttgtagaatcaaggacaagcagtggcagttcaggccagaatctggaggctgtccacacctgaattcaaaacgaggttggctctctccatgtggtatcctacctctcaaactcagcacatctcaaatataacccctcatctctcaaactgctcctaaccctgggaagaattagatcacctacattgtctctcctatttgcctgtggatcaagacacaaaaattcaagtctggaagactctgaagtggcaagttcatttgaagggtgcaggtcacattcattcttttatgttagctgtgctttttgtgcacagtcagacttggcattatccaccaatatataacagccttgagggtatctcaagagcagtattaattcacaatactcaggaattagcaggcagaagagaatagggggcatggagttacaaataaatgatttttccatttaattgcaattctgcactagagtcatttagagagcctgatggtttcacaccagttgagatctgggcaaaaggacctgggaataacgtgaaatctcttgaaagattgaatggtgtaatggaaaggacattggtgggagtctgagaaaccagggagttgatcctttgcctccaggacttattaccagcagtgtaaagaggtctgtgacttgactgagtcactaaactatctctgaacctatttttttttcttcttctttttcttttttttttttttaaaggtaacagcaacacctaccctgctggtgtattaagaataattgaaataatatttgtaagtcaattagcgtagagcaggcgctcaataaaggttagttggttaggctgggcgcggtggctcacgcttgtaatcccatcactttgggaggccgaggcaggtggatcacctgaggtcgggagttcaagagcagcctgaccaacatggagaaaccccatctctactaaaaataaaaaaattagctgggggtgatggcatatgcctgtaattccagccacttgggaggctgaggcaggagaattgcttgaatccgggaggcggagtttgcggtgagctgagatcttgccattgcattccagcctgggtgacaagagtgaaactgtcaccaaaaaaaaaaaaaaaaaaaagttagtttgttagtttcctctattctccctgccctgcatctaacccaggcagagatgttgctggtctttgtaactaacttagtcagaaactgcttgagttttatgtgcaatgatattggaaagaaaatacatttaatggactgcattaagtttagcaaactgccttatgcttttgttttgaaaagaagaagacatctataaaatatgaactgcatgggaaaataaatttaaaatgtataaagtaatggaaaggaaattacatttataattattaaaagaaatagaatatggtgtggtcagatttttaacagtggaaattttgcataatgaactctggtaaaaccctaagaggagatcaccagaaaggggaaaatgagtgatagaaatgcttatattttaaaatgaagaaatgatataactataattcttagcacaggtacaaagcatgctctttacatagggagaaatacatcagattagttatgcaaatgagccccaatttaatctgttacaaacattttcaactaatgaaattaggcatgaaatgctgaaaaattggtgcatttcagttttaactttccagagaacctactattctgaccatatgaaacaccatctttaaaataacctgcagcctttgatctagtgattttggataaaataatgaaacagctccaatggaagactatatagcttatgccagtctattcatagcaatatataaaaaatacataggtaagtaaatataaacaaacatgttcgtatatattatgtgtaaatgtgcacatataaacaagatcctgttgcgatctggcaaagcaaacagcaaaatagaataatgtgtatgtgactactaaaaattataagcccacaaactatcagtatttggaaataggtacatgaaataaaatcatcctattatatctttttttatttttatttttattttattatttatttattttattttattttttcttgagatggagtctcgctctgtcacccaggctggagttcagtggcgctgtctcagctcactgcatgcttcgcctcccgggttcctcccgggttcacaccattctcctgcctcagcctcctgagtagctgggactacaggtgcctgccaccacgcctggctactttttgtatttctagtagagatggggtttcaccgtgttggccaggttggtcttgaactcctgaccttaggtgatccgcccgtctcggcctcccagagtgctgggattataggcctgagccaccgtgcacagcctattgtatcttatttacaggtttggctgctgtttcagggatgtagagaagcataagactgacagccgtcgcttcagggaaatgaggttccggagtgggaagataggtgacaatgcgcaaatattgactaaataagtttgggtgaatgagtaagtgctatgaaggaaataagacggcagtagaatggagagggccacggtgcctaggactagccctatcctaggaaggctgaggtggggaggattcctgagctgagccatggtgttggaggagtgggctagtaaagatgtagcctcagggaatagcaagtaaagggttttcaaactggagtgagtttggcatgtgtgaaccaagagcaaccagtgtgtctagatcttagagaacaattgcatgtttgcctggtttacattaggaactaagttattttatttatttactttattattttgagacagtctcattctctaacccaggctggagtgcagtggtgtgatcctggctcactgcaaccttcgcctcctgagttcaagcgattctcctgcctcagcctcccaagtagctgggactacaggcaaccgccaccacgcccggctaatttttgtgtttttagtagagatgggttttcactatgttggccagtctggtctccacctcctgacctcaggtgatccacctgccttggcctcccagagtgctgttacaggcgtgggctacctcggccagttttttttttttttttttttttttttttttgagacagggtctccctattgcctaggctggagttcagtggcatgatcttggctcactgcaactttctcctcctgggttcaagtgattctcgtgcctcagcctcccaagtagctggtattaaaggcatgcaccaccatgtccagctaatttttgtaattttagtagagatagggtttcaccatgttggctgggctagtctcaaactcctggtctcaagtgatctgcccaccttggccttccaaagtgctgggatgacaggcgtgaaccaccacactggccatattttacattttaacacaaccaaattttattaatttttctttatcagttatcttttcaattaccctcaaacctaatggctaaaatagcagccatttattccattgtgcgctttactcactgggcagttacatgtccctccaaacagcctcatgcatgtacagggctggctggctggctggctggtgggctgctgctgcggcaactatacggggccactgagccaggagtcattcatcagtgagccggcgagcctgggcttgttctcgtgaaggactgagggttccatgagagtggagcagaggtgtgtaacattccttgaggtggaggctctgaattggcacagtgtcactttctctgtattctattggctacaagactagcccaggttcaaggggtgggaaatagatgagtttccatgggaggagctgcaatgtcagtgcactgagatgtgcctgcaaggagggctggaggattggtccatgcttgcaatccatcccatttcaccttatgcttggtgcttttcttctatactttaggtgtaagaaattaaaatcctgtatgatccaaaagttttacagttttgccttttcatatttaggtctttcagtgttcacatattatttttaaaaattgcaaacagcacgataaacatgaattagaggaaaaatgaagtttcagaaacttacagtggggaatgttgaacaaaaggttagaggctgtgcacgtggtggagcaggggctatatggggagcctttgtatcttcagctcagttttactgtgaacctaaaactgctctaaaaatagtctattaaacaattttattaccataatatgactcagtcttcattatgacagtaatgtgtgaaggagacacacaggaagacagcagctgtgtgaagtgcagaagtcagtcaacaccttcttagaaagtgctttaaaccagaggcaggattgtatactgctcaggccatggcctttggaccagtggttctgaagaagaagcaagccttcgctgctattgtttgtagctgtgccaaccttatgcaaattactcaacatctttgaggtttggcttctttgtttgtaaaatggtataataatctttatatatctcttgagaatttttgaatgaaatgaaatgtgtatcacctagcacggtgcaaggcctgtaaaataaatgttagcctattttagaagtagagttttccactattaatctccaattaagatgaggacctctgtaggtcttttgcagaattaattcttcctaccatttcttcttggccttcagttacttctctgatgctgttttctatgaacattctttttgaatcttctgggtttctctggctggagtggttatttggcaattggttaagagcagctggttggctgaccttgggcttttgagttccttatgtctgaaaccatggcaggcagccagattgcatcaagccactatcaggtgtgtgtgttcctaatcacagcctgaacttcagaattgggcaagtcctgactggagtgagcagagaaagggagaatactttagggaacaatgtgaaataatcagatctgaggaagaaggaggtaggggagggaataaacattttttcagcatctgttctgtggcagggtatgaactagaagtcagaggctacccagagcgtgccaggttgaagatggcgggccatttggcaagggagttgggtcatgccttctcatagattgagcggaggagagctctacagctttaccaattttaggaagaataaatttcttttatgctttgacataaaacaagaacccaagtcatcattatacttttctttctaggtctgtcagtggcccagcggaagtttgctcattcactcagagactttaagtttgagtttatcggtgatgctgtgacagatgatgaacgatgcataggtaattaaacatgatattttggtttgttttcctttgccatggccaccaaataatcactcctttcttcttacagatgcttccttacgtgaattttcaaattttttgaagaatctggaggaacagagagaaattatggtgagttgagaggggtgtaaattaataagtcagctttcaagggggaaaaaaatctggatttggaagcttgttctggtagaagttgtgaagcatttatccctgggtacagtagtgcattgtaatggaaagatgaggtttccggagccctgatttctagttccttgagggtgctgaccacggtcagaacttggagaagctgctgggcctctcgaccaaggccttacttcttcatctgtaaagtggacagtaggactacatcactgctttctagctttttgttgcagcagagcactttaatttatgtaggctctcatgcagaagcttaatatatcagcgggataaaagcagaaaagcttatgtagaaacagaggacagctgggcaatgttagtgcctgactcatactcctgtagatttctaggctgtgtggaaagggagagaacttgggccttggaggtctttgagatcccactttgcatcaagattcatgatcataacaagaataagaagaactacccttggccaggcatggtgggtcatgcctgaaattctagccctttaggaggctaagctgggtggattgcacaagctcaggagttcgagaccagcctggcccacatggtgaaaccgcatctctacaaaaatacaaaaactagccaggcatggtggcatgtgcccatggtcccagctactcaggaggctgaggtggaaggatcacttgtgcccaggaggctgaggttgcagtgagccgagattgtgccactgccctccagcctgggtgacagagcaagaccctgtctcaaaaaaaaagaaaaaacaaaacaaaaaacaaaaaacagctgtcccccatggggtgctcttcatatgcagtgctgtgctgagtgccttgagtgtatgatctcatttgcactcaactgtaaattttggggttattgaatattgtctgcttttcttaaaagcttacattaccttcctaatgatattctttaattaaaccagatttacagcagaattgctaccaggttgtgacacaccatctattctcaccatttatttcaggcttaaaaaaaaacacagattcaggctgggcgaggtggctcatgcctgtaatcccagcactttgggaggctgaggcaggcgagtcacctgaggtcaggagttcgagaccagcctggccaacttggtgaaaccccatctctactaaaaatacaaaaaaattagctgggtgtggtggcatgcacctgtaatcccagctactcgggaggctgaggcaagagaattgcttgaatctgggagatggaggttgcagtaagctgagagtgaaccactgcactccaaacttggcaacagagtgggactctgtctcaaaaaaaaaaaaatacggattcttttttctatattcttgaaaatgagtactatctagaattacgttatagtgtaagtgtatgagtgggtctagatgtggtagaaataatactggacatattagctaagttggtttaccttgactgtgtgccagtgcattagtccgttcttacagtgctatgaagaaatacctgagactgggtaatttataaaggaaagaggtttaattgactcacagttccgcattgctggggaggcctcgggaaacttacagtcatggtggtggaaggcaaaggagaagctggcaccttcttcacaaggtggcaggatggagttgagtgcaggcaggggaaatgccagatgcttatagaaccttcagatctcacaggaactcactgtcatgagaacagcatgggggaagccacccccatgatccaattacctccacctggtcctgcccttgacatgtggggattatggagtttacgctttcgtgtaagatttgggtggggacacagagccaaaccatatcagccaggagctgttctaagctgtttacctaatgctaagtcactgaattctcacatcaaccctatgagatagattctgctgttgttccccatttaaaggatgaggaaactgaggcacattaccttgccctagatcacatggcatctaggaggtagagctggtatgtgttaagaagcaggcactctgaactgccctccctgtcactgcagctggcttcgtaggtgtcactctaatttcctgggtggtggctggtgggggtttatgttggctagggctgcgggaggacactgatttggatttaaaaagtgacagagggctgggcgcagtggctgatgcctctgtaatcccagcactttggaaggctgaggtgggtggatcacctgaggtcagaagtttgagaccagccaggccaacctggtgaaaccccgtctctactaaaaatacaaaaattagctgggtgttgtgggcacctgtagtcccagctacttgggaggctgaggcaggagaatcagttgagcccgggaggcggaggttgcagtgagctgagatggcgccattgcactccagcctgggcgacagagcgagactccatctcaaaaaaaaaaaagtgacagagacatatgtcctcaaaagccctaatataatttgcactcattcctaaattttgaggtaatttgtgtgtatatattgtagatactgtagagggtgtgtgaagacagtgtggtcccatgaggtttttctggcacacactgacagatacagtcattattcatgtgatcctgtagtcatcaatttttcagctatttaggaaagactaaataagatggtgaataaaaatagtgccatgacatcacctttctagtacatggagccgatgtgtgggctggtgaggtacgtgttcttagtttatgttaatagtgtcaattttttttcttaaccctctttgatagttgtacttccctggcatcctgaacattgagcgcatacctattgatctctttttatgttccagttgctgttgagaatctcaggacaaaggtaaaggcaaagaaagcaaaagtctctgccttcatggaggttagattctaggcgggggtagtgaagtagaaataaacctgtaatccattggcaggcagtgaaaaatgctacaaaacaatacagggcaaggagccaggtggggcggggctacagcatatctggagtggtgaggtgcggactgccttttcagtaggatactgcacaaagggcatcatcctggtgtctggaggaaaagttctgagcagagtggtgctggattttagctctacagaaatagcgtgtgaccattgttaggctcagtattctgtttctgttttaggttcctagaaatagagcgatgaggtccaaaaacaggaacatggtattggctccaggctgtgtggagtagacagcatggtttgcagagctgttgttagccaactggctggtttaagctccagctgtgatggaggttgatagggtctctgtgttagacaaggttgggttcccatgcagggtaggaacgagaatagggtggtgtctgtataaggccatgaaccttaggagtggtgtggtgtgtcatacacaactcattgtgggaacagaaacacctgctggaaagcaggacgctgtccaaagctggggtgggtggcagccacagccaaccacggaattaacaggacacctcctaatgctttcttcctttttagcttggaaaatttcaaacatgtaccaaagtcgagagaaatatacaatgaaactacatggactcgacatccagcctcagaccagtctcgtttctcctgtgatccctactccccttgaccccctgctctcctcattattttgacagaaagcccagtttcattcacaaatacttcagtatatatctcaaaaagcagacacttaaaaaaacacagtatccttatcacaatcagtaatttcttaattttgtgaaaagttaggtcatattcaagttttcctgatactcattccaattctgcctctttccctccccaagccccgccctcaataacagttggtctgtttgaatctgagtccaaacatattacatttgactgatacatttccaagtcactttcaatctataggttcttctccccatccgctttttttctcctttacaagaattcctgatccttttatatttgcctcggaaacctttaaaatagtactttcctaagttatcagtgagttgcaataatgaaattagtaaaagttgaaaagttggattcttaacccatattgacattgtttgggtacttctcatcttgatagtcactgatcacttttttttttttttaaagtggaatcactgtggctacctttgtttctttaaatacctttgaatgcttactaaaacataactgatgcattgcagaacactcgcctgaaacttttgaggaagaatagatacttgcctcaagaaatttccagtgtgatactggagagtaagtggtaaagagctaattaaatagcctatactaagtgcttcagacaaggaatgggaaaagaaaacaatatacaaagtgcgccagcaaagataatgtggctcacatggagtgggcagcccctaagcttgtggctgttaggaaagggtttatggaagaagtattggagctagagtttgtggggtggagacacagcagagggcctttgtatagtttagtaagcccatacccccgacaccgggacaaggagaaaaggaatgtctttaagcagctaaaatggttgccagtacattctgagaactttgaaagactcttgttttacttaaattttttttaacttaaaagttttagaaaccatcagcatgttaaaagccacagattaagaaaggaatgcaaaatgactgtaaaatggaggtagaaatagtctaaaattggttccaaggatttcatagtggtcacttaatctttttttttgtttgtttttgagatggggtctcgctctgtcaccaggcctgagtgcagtggtgcaatctcagctcactgcagcctccgcctcccaggttcaagcgattttcctgcctcagcctcctgagtagcggggactacaggtgtgcgccaccacgcccagctcatttttgtatttttagtagagatggggtttcaccatgttggccagatgatctcaatttcttgaccttgtgatctgcccgcctcattcacccaaagtgctgggattacaggcataaaccactgtgcccattccactttatctttaaaagcaattagtttagtattttctgaaatcctaaattgaataatggtgcagcataatattaataattggatattcataattaagactgagtcattaaaatgttaaaactacatatgtctattttagaaggcaaacagtaatgtcaactattttaaaatgttttctgaatcttaagggtaagatgagactttaggttttaagggataaagtcatctgtgtgtatgctcagcaatccctgttggttttgagccaccagttatataagttcatacgcctcatctctatgcttaaataggctgtattaagtatacagttcaacaaatagtgtgtgcctgccacatgccaagcactgtgccacatgctataaagataaagacataagtagtgattcatccattggaggagatggctgaaagaaggcatgtaatttccaacatgcttcgtggtaatcaagtgattgagaaattcagggaaggcatcttggagaggtgatatctgggctgagttgaaggatgagccttagctatgtctggtttcctccttgaggggaaactgttgaaatttcgaaaagagggaaggatatgtttgcatagccccttcctttcccccctacaatgtccagctttgttcctactaaagtgaattgttggagagagaagtagagcaattgccagtctaagaaaaaaagtcagtgtttccctccacactcaaagaagtgtaatttctatgaatacacatgcctcaccctttaaaaagtcaagatagttttttttttttttgagatggagtttcgttcttgttgcccaggctggagtacagtggcatgatctcagctcagctgcaacttctggctcccaggttcaagcgattttcctgcctcagcctccccagtagctgggattacaggcacctgccaccatgcctggctaatttttttgtattttttttttttttgagatggagtcttgctctgttgcccaggctggagtgcagtggtgtgatctcagctcactgcacccctgcctcctgggttcaagcgattctcctgcctcagcctcccgagtagctggaactacacgcgggtgccactatgtccggctaattttttttgtatttttagtagagacagggtttcaccgtggtagccaggttggtctcgatctcctgaccttgtgatcttcctgcctcgacccccccatcgtgctgggattacaggtgtgagccaccgcgcccagccaatttgttgtatttttagtagacatgaggtttcaccatgttgggcaggctggtctcaaactcctgacctcgggtgatccacccgcctcgatctctgaaagtgctgggattacagatgtgagccaccgcgcccggccaggacagtgtttttgagtgagtagtttttgctgatcatgttgccacccttgactctggaggtgaagaactcaacctggggagtcagatctgatacagttagtggctgcaactgctctactcacttctgcgcgtgttctcagaggaaagggctgtgtggtgtgttgctgccagaattccagagatgttctctctggcatggcaggacatgttgtacttatctgaggtgggcagctgtccaggaatctaaggacttttaaaatagtgctgtagtgtttatgttgttcttttaaaagcccttcatattgcgtttacttctctacatgtattcttttatcagatcattgagtttcatccctagcctaaaatggttgcccagtttctcaggattctggcaaataagggcaattggttgagacccagaggttcaggaaaactgcggggaagcgggagtgccaggagagagaaggtggagcttgcctgatggtgcacaaaaggtgcctgagatggagctgttccgcctccctctcatcctgggggtgctgggggcagactgggctgctaaggagatgtgaggaagtgtcttgtccacggctgcacccctttccccatttgggcaggaaagccctttgcctatgcagactcttcaggcttttgagacccttttctttttctgttgtttttctctaccacagactttacccttgtgaaaataccaggccagggatcacttcctgggtgacctgccctgaccttttgcccctatagggaaggtactaagctgctgcataccaaaggcttttgttagcatttagatggtcggtcacaggcaagacgtgatgcctgctctctcagccctggcctgtgctttactgcacccccttctcatcatcctttcatgctctcaaatctcctccataagtttttggacttttgacacggatttttgttccaaactattaggttggtacaaaagtaattgcggtttttgccactttttttttaaatggtcaaaaccacaattcctttttttttttttttttttttttgatggggggagccttgctttgtctcccaggctgaagtgcagtggtgggatcttggctcactgcaacctctgcctctcatgttcaagtgattatcctgcttcagcctcttgagcagctgggactataggcacttgctaccacacccagctaatttttgtatttttagtagagacggggtttcaccttgttggccaggctgggctcgaactcgtgatctcacgtgatctgtgcgaattggtctgccaaagtgttgggattacagatgtgagccaccgcacccagttgaaaccacagttaacttttgcacttacctaaatattttttaaaaagtgtttcagagtattactaaaagaatgtatgatggttaaaatgagttaaatgcattccaccttttaggagcaaatatgctattctttctttagtatgccctagggcacttgtcatcaaagtatggtccctggtccagcatcactttaggaacgtgcaagaaatgcacattctcaggcccaccccagaactctactgagtcagaaactctgtcagctggtctttcatgaaactctccaggtgattctgaagcaggctgaaatcagagctactggcttagggtgctagtgaaatcttggctggcaatcctttccttagggttagatctgtctggacgttggatacactctaaattgtttcgtgatgactgtgtccctgtcaggaggttaaaatagtgatggaaagcctaagctttgacttctcatttccaaaggatttgagactatagctggtttgtgttaatggaataggtttagtaggatttttagtgttacttactttgtatttaatattgcttgtgagttcttataggataagtacctaaggcattagatgccattaaaaagattatgcctttagtttcatcttattatatttacagtattttatatggcatgtgaagcttgttttaatcagttcttttacagtttatgtggatttctgttggcaggcacattcagaatggaggaaattcatcttgaacttatttgtgagaacatttctcagtttggtttaaaagttgtcagtgacctaattttatgaagactttttcctccttggaactgacctttacaattggacagcattgctttttcttacaattctctttttcccgtaagcctgttattcagtcagatagggatgtctttgtaaaacctgtttttcaggaatgtaccgtttgagagtttaatttactgactcagaatcctatagagatcacagtcaggaataactcaaatcaaaattctaaaatgagtgaagattatcttaggcaggaggcctgtctccttcttggacccctttccctgcaaggccttgccccatgactcagtgtcctctctgttggtgactcattatcatctgtggccttccagccttgtcatcatcagattctacttccctgttgaaacttacatttcctgaatttcatatccttagggtgtattctctgcttctgaggaatcggccaactctgctctcttcttccccctgactgccccgcccgacatacacacacccacccacacacacacaagggaccctagaatgtaaccagcccatttaattgtctaatccagaggagtgattcgattattgggaatgtgtgcagctgagtctgctgtttcactagggaaatatttcgggatgagccaaggtacctaggatcagcctttagaccatgtcatgaaaatattagatggtatagccttgaaaacaaagaactgaagagaacttagggagacatatttgaccacttaatttttttttttttttaaaaagaggagtccaggcacggtagctcacgcctgtaatcccagcactttgggaggccgaggtgggtggatcttgaggtcaggagttcaagaccatcctgaccaatgtggtgaaaccctgtctctgctaaaattacaaaaattagccagtcgtggtggcgggcacctgtaatcctagctacttaggaggctgaggcaggagaatcgcttgaacctggaaggcggaggttacaatgagctgaaatcgtgccactgcactccagcctgggtaacagagcaagactctgtctcaaaaaaaaaaaaaaaaaaggaaattggagctcattgagggtggagtttctacatcactaaataaggttgtgacagagatgaaaatagaatctttcacatcttctagtatcctaacgacattatgccttacctttttctctttgtaagacataatatttttccttccacctttgaacattagtgaaatggatatgtatcttatagttgctatccaccaggcagcagtcatgaaacggacatgaggttacttctcttttactctttggacaactgtagctcctcagtatttcagtccacagaccacttaaggaagaaatatgaatgctggtggtggtttgaaaaccttccgttgagacctggttaggtcaaggaagtgctggtatcagtatccaaagagtgggtgcctgccatcatcttggaagaaaatcctggatacaagaatggagctccttaagagcaccctttgaagaaatgatgcatctccagtattttcagtggcacagaggaaaaatatgtgtggtgatacggtttggctctgtgtccccacccaaatctcaccttgaattgtaatccctatgtgttgagggagggacctggtgggaggtgattgggtcatagggccagttttccccatgctgttcttgttatagtgagggagttctcacgagagctgatggtttaaaagtggcagtttaccctgaacttggtttctctcctgccaccatgtaagacgtgcccttctttcccttcccttgtgccaagattgtaagtttcctgagacctctgcagccatgtggaactgtgagtcagtcaaacatcttttgtttataaattacccagtctcaagcagtaacttcatagcagtgtgaaaacagactaattcatgtgggaaaaaccagattttgatgactgagatgaaaagtgattcagaggagttggactttgaagaagttttagaaatatcttaacaaaagtagtttgcttacttctttatgcacaagagggatacatgatgaaaacatacctttcaaagagctttttcaatgtatataaaagtgctaagtgttaagctattatttcaagattagcaggatttttttgtggtaggatataaaataatggagtgttttacagttggtggtgattagattcaatgatatatatattaagttggtggtagagattgtgttagatattcaagaaaatgccaatgtagtgggaaaatatggtttcgaagctgtggcagccatgggcacctctcagatagaggaaggaggagtgacattgactatcaggcccagctgctctgtggtacagttgtgttagtgtgaaagccatgcctcccacgttctgcctatctttgtctgttttctgttgcttataacagaatacctgcaactaggtaaataaaaggaatttgtttcttacagttatggaggctgagaagtccaagagtgggggacccaggtctctcttcctttttctttctataaagtcaccagtctactcctgtgataacccattaatccattaactcattaggctgggaatggtggcttacacctgtagtcccagcactttgggaggtgaggcacgaggattgcttgagcccaggagttcaaaaccagtctgggcaacataatgagaccccatttctgcaggggcagggggaagccaggtgtggtggtggcacgcatctgtaggcccagctacttgggaggctgaggtgcgaggattgcttgagcctgggaggttgaggctgcagagagctattattgtgccactgcactctagagtctgggtgatagagtgagaccccatctcaaaaaaattaataaaattcattaacccattaattcatcagtggatgaatccattcatcttttaaggccccacctctcaataatgccagactggggattaagtttcaacttgtttgaatgtcccaagccttctaacggcagccttgttagacttaccccagaatggcactgcagcctcacccacacacacaaacacacagacacatccacccacccacactcacacccacacccatacacatacccacccacttccacccgcacacccacccacctgcccccaccctcacacccatacacacccacccatccggcttgctttccttccctgtctccttcccctgggtcagacctgcatcactgtctgatggcccctccagtcttccctggctccctccccattttctctcacagatgtttcccctaataaatttcttgtgtgtctcatcctgtcttggtgtctgcttcttagaggacctggactaacaaaaatgaaccatttggagtaaaagattcagggtacttagcattgtcattcatcggttgctattatcactataagcagaaaatgttgcttttatgtagaaatgctgttctttaaattatctaaatttataggagaatcccacttcatttataaatattttgagtgcctactatgagccaccgtgttctcacacctgaggatacaatgaggaaacccttgtccagagtgctcagctagtggccgcctggtagagaatgagttcccaagagtttttcaaccctgcagcccttgttttttactgttgactgccacttttttctcttaacccgtgcatcacagatgggctggaaagaaaagcttttgtcattgattaaagccattcttttctgaatgtttcttttcttctctcacattttttctttttcttttccttttcccttaagtcttgctctgtcgcccaggctggagtgcagtggcaggatcttggctcactgcagcctctgcctcccaggttccagagattttcctgcctcagtctccctgagtagctggggttacaggcatgtgccaccatgcctggctaaattttgtatttttagtagagacagggtttcaccatgttggccaggctggtctcaaactcctgacctcaggtgatctgcccgccttggcctcccaaagtgctgggattacaggcatgagccactgcgcctggcctattttattttcttgatttaacagtttattgccttagtatgcacgaggttccatttctagctgtgccactgagtcataccattcacttcagaaactaaaattttctcttatgtaaaacaaaaaaaaaattcaaaattgcctcatgaaactttaatttctatggggtttttatttcctctcataataatattcttcccaagtatttattttgtttaaaatatcgaagcgaggttcttactgtcccttatgcacagagggaaggaagatcaagtttcagcatctgctgcatatccttattaggcagactcattccttaaatactcagtagcttttgttttatgattctcattttttcctaagtgtacttaaaaacaaatctttacaggtagattgtgtttgatttaaataatctgaataaaatttctgctatcttttttcagttaatgtccttcagaatggatgctagcttttcttttgtgggaggcaaacacaccctaacatacttgttcgtagaagatagatactaagagaatcgtagactttggtgatacattgacctttttttttatttttattttttgagagagccaggtcataggcagatattcagggaattaaatcagagaccagaagttgtcagaatttcagccttaatcctctttaataggactaggtttcaagtttttcacagttcaggattgaaagttgataaaattcttactggggacattttattcttggattatctgtatgaaagcagaagtgtgataattgaactagtcgatttgggatatatactttaaaatcatagtttctagcttattatgtgagtcgtctttggtctgaaagaatgaggcattattcaacagccatttcctattaatcggctcctgattttcaagtttgaaccctgtggaattaatttatagcacctgagcacctgtgtcccagttagagctttgtgcgtgggttccttaaatctaagtaccaagtaagctagtacttagctaatgagtgtgagctattgccatcataaaattgaatttcgtttttacattagtttctctactgggaaaattagattagcttgagctgtgcttgaaaataaaataccatactgggatttgttgggaagttacaattgcttcaagtatgatgtgcctttttttttttaaattgttttaggtagggagaaagtattattcctggctttatagttgagaatattcaggtaacaaaaggaaattgttattttctgtcatctaaaaatagaactagttagggcagagccaaaatgaaaacacgttggcctcctatttttccgtgctggagggccctcgtagcgaaatcgattgtgaaactttttcactttttgtcaacattagtcttttgactcttgttctttctcttatgtcaggtattaaagtgggggaactttattggccatcttaatctttctatttaaacttgagcctagaatgatggggaaggtataggccgggggaggctggatagatggagaaagaggtaccaaagggtgagtgtggagggagagtgatgtaattaattgataatgaattggtttaattaggggaactcttgtgttaggagtatagagaaaagaatacgaaagcattttgtcaagattgtttatacggttctgaaattctaaaaaatactaatcctttattagtctggattctcaattgcaagcactagctagtttgaacataaaggaaattcattaaagggtattgggtttcttgtagtatctttaagagatgtggggaaccaggaatgatgcccaggttgtaccacagagctgggcttagagcagatgccactattgctactggatgtggacactacagtttgcaccaagagcctcactgccctgtggctgttggaagaactgctgcctctggaaattagactagttgctgccacctcgctagaatctctggtcactgtttttttttttttttttttaaagcagtagcttttgaatccaagtcttggatgggaccatctcattagtggaaccctagctaggtgtcattaccttactgcaagccagtgtctgtcatttttggcttttatggtgggaggtggactttgtttcagtgggaaggagaattcctcaaacataggaaggggtttcaagtgctgggcagcccaaaaggactgatgttcctgtatgtgcctgattgtaagacaacattattttcccagaagattaaacataataaaattgtttcagacaacttgaacacgtatacttttaggtatgcatatgtacatctgctagataatcagatgtctcccttcatcatttacttgattaaatatgtgtccatatttaaaatcaaataataggcaaagtcagcatatattttagaaacattttctgcacttatttaataaaaaatttgtcccagctcttggcacctttgagattagtatattcatcatggatacattctgaatttttcagtacagctttccagagcattgatggccacatctgcctgagttctttgagctatagcacctaaaatctttctgatgctttcactggaaattttatctcaagccaaaagtatatgttagcagcccatttggacagtctctttaaaaaacttattcctgaacctggcacagtggcttgaatccataattccagctacttaggaggctgaggcaggaggattgtttcagcccatgatttcgaggctgtagtgatctgttatcacaccattgcactccaagcctgggtgacagagtgagacccttgtctcttaaaaaaaaaacacacacacacacacaccaaagacttaactctgggatatgtttccatgatttctcttcctcctcttcttcttcacagggtctaactgttgcttgggctggagtgcagtggtgtagtcactgctccctgcagcctcaacctctcggcctcaactagcctcccacctcagcctcctgggtagctgagactacagatgcatgccaccccacctagttaattttctgtattctttatagagatggggtttatgccttgttgcccaggctatgatttgtttaatgtaaccactgatcttattccttttaaagtgagctttataaaattactgaatacaaaattttgaagtcatctctggaattgtaactaaatatcttaaatttcttagtgtccctttgtttttgtaacttagtcctgtttgtaatctctaagtatctgaaactaaatgtgattagggctattttaggctaagattcctcaaacagttgttgatcaaaataatgggaaagtccactcctttagaagactcttaagaactcttacacgaggcaagttcttttttttcctaacagatcattttgggaaaaagattcctttatgtttagatctatcgtatctatctatctatctatctatctatctatctatctatctatctatctatctgtctgtctgtctatgtatatataaagtttctaggcaccatttaagattccgtttcaaggaaaaacaagagctgtgtttttgctgaatggtttctttgctgctattcttgacattagaattggaaaacagaattttccctttagtttaatgaaatgggaagtatctggaaggtcatgggagaaaataggggagatattcctttgttctcagattatgcattcctctggggtcaaaaacacgtggaatccaggcttaaaataatgagtgttctggggaacggatgtaaaattccttctgtttcactatactcagcctatccttgttagtactgagtgattagaaaggcatgatttagtagttatactgacttactcagttttacctagactgagactttagaaaattgttactaaagatactataggatgtaggtatgcctttgttgtgtttttactgggtatggggttatagccctaagtcctattgtctttagaatttatgacatcagaacttagactttgatttccagtgtgggggaatgtaaagttgttggagtggttcctccccacagtggagtctgattctctgcaggttggttgttattctcaacagattttttagctctagcgtggactgtggaggatagattaagataacataactttcctttcctttttagacatttaagatccttacatccgaatgtctgacgaaaaaggatttcagacttgagtaattgtgggaaacattttaatcctccacactgttacataatactctttttactttgaattgtgaagttctaatggattctctagtttgctgttgtagcatgattctcaaaactacagcatggaaatgtactttgtacttctgtgtctcccagctcatttagaatcccagattgatagagatggatgaggacctccgctgtcctcttggccagctttctcccagtgcaggcatgtgtgagagggtattcctggtcatgggtcatctagtctctgcttggttatgtggagggagctggaggtcaccaccttgccaggcagcctgtttcattatagttctcttgagtccctatgataggaaacccaaatctgctactctgcagcttctacccatcaaacctggctttgctccctttaagcaaatcagaatgattttttttcttctctcatgcagtacccatttaaatatttaaagacagctttcatgtttccactaaatgttctcttcctccccactcacatgaaacatctagttttttttatttcttcctcctaaacctttttagcattctggttacattcctgctttaccccagttggaaatggctgttttaaaatgtggtaaccatgctattgaggtaagctctaatctaacgggggatgcagtcgagtgcttaccttgtttggattcaggcggtatgtgtcatcagtgtatgttacagggtcaatttgtggctccattggcttatgttaaactttcagttaagagaacattttaggagatttgagcccagtatgaaattcatgtgacctgttctcgagacatcttgcacacctgagcagttgcctttcagcatcctgtagattgcttatcccaggcaaatcctaacggcgctacttttgagtccctctctttagctcgagagctccttgaactgtgattcttttatccagcattccttcttccttcccaacttctgattggctgcaaatattgtaaatgtatattttttaaaaatacaagataagcgtaagagcattgttttgccatgatactcaagatgatcctttcaggcagggtttggcaaacagtgacccatgggcctgacctaccttgcttcctctttttgtaagtcaagtttcgttggaacacacttggacccatcattcatatgctgtttgtggctgcttttgtgctaccacagcagagatgagtagttggaactgcagctgcatggctgcaaagcctaaattatttactacctggtcttttatggaaaaagttggctgacttctgctgtgaggagagagcatctgattatttcatgttcaagaagcttccttttgtttccaagcagagctatccaaaaccctttccaaggctcactagccaaggcattttgcgacttcttttcttggctggttcaagtattttataggaatatgattatgtaatctgtatgtgtggttataaaatcacattctgtacttgttctcttatctaatttctaatatgttagtatttgaaaacttctcaatattattacttcatccatctccttgacattgggaaactgtcatcactgtaaattgccttttaagttttagggacagtcctagatttggtattcatttgttgctggggaagaaggatcatgtttcaccattaggaaacatcagtaacacttactactaacaaatattatataatatttctgtgaaattatagcaggaagtgagagattccgtggagcttccagtctattttgagaaaaggaaattcttgttgctcagttgacattgccttattgaaacatttattggcttctttattattttgttcttaaatataatttttaggttcagtttagaagttataaaatcaggctttgctaaagaaggaaaatcataattttaagctcttcaaagtatttttaataaaaaagttttttataaatgagttggatatagtgttatttgccacaactactactatccttgttttggaaatttgcttaccgatctgaagatagtaaggcagaaacccttatattcttcctcccacgtcacccccaagatggagtcttgctctgtcacccatgctagagtgcagtggtgcaatcttggctcactgcaaccactgccttctgggtttgagcgattcttcctgcctcagccttatgagtagctgggattacaggtgcctgccaccatgcccggctaattttgttgtatttttagtagagatggaatttcaccatattgaccagctggtctcaaactcctgacctcaagtgatccacccgcctcggcctccaaaagcgctagggttatggggtgtgagccaccatgcctggccgtgaaacccttatattctttttctactctagtgttagcctttggggctcagacggatattgcattgaattctccaaatgaaggaaaaatataatgacctaagattgctcttgtgtaatctttgtagcctggttcttttggtggaagacagtgtttactccagagtatggagttttggggttcttattttaaaatgccttcatgtgtctatattatttataacctacctctactttctgagcatttcctgggtcccattctgatggctaatggagaccatccgatatctctagccttgtctcgtgatcctctctgatttcctcatctgctttagtgacaccgagctgcttaggttccatgccctgaaattgctgttttcccctctccacatggaaggcctttgcctggagaacaccgtccctctgtttcaggctgagctgtgcataatctccttcaggaagtcttctcttacccagggggccttcctcctctgctccccagaagctctgcgcagcttgccagcactttgtctgccacgtcatactgtgctgacgtgttcacatctcttagaaacactcgcctgggatgaactcagccacccaccttttcccttccttgctggagaaaatcccacaataaggcagatgataacttcataaactcctcctcacctatctcaaaaggacttcttgtttctctaagaagtgttgtctcatttgtaatgattctttcattcattcttcagttagttgggcgtgaaacttctcatgtccaaactctctgcaagtgaccttgttttgtactttatggaaaaaatagccatttggtagcaactctcagctttttgtcatgaagcccacaaacccgtttgtactgggcaccccttttctccttctatcacagggaaggaaggattttgactcgtatgacaggccaaccctccatgcatgctcagcatcccatctcctcccgtgtcagagattttgaaccattctttctggattcttcacatgggcatttagacatgctctcatctcttaaataccagctgtcttaaaagaatacatgcctttactttatggcatgttctctttcagcagtcatcctctctctctactgccccacctggtcattctttgaggaagggttgttccccacgtggtctcacctgtcagtcataaatcaactccagcccagccctttctgccaccttgccatggatattgctgagctctcattctttctttaaaacgtctctgcagcccacacagctgaactccttttttttctttttctttttctttttctttgagacggagtttcgctgtgttgcccaggctggagtgcagtggcacgatctcagctcaccgcaacctctgcctcctgggttcaagcgattctcctacctcagcctcccgagtagctgggattacaggcactgcccggctaattttgtacttttagtagagacaaggtttctccatgttggtcaggctggtctcaaactcctgacctcaggtgatccacctgcctcggcctcccaaagtgggattacaggcgtgagccactgcacccggcctgaacccctttcttcttttatccaacaccttggtagctttctccagtttcattgccatcgtttacctctgttctttcatttcctgatctgagtacttggtctgagacatttccatttttctaccgtcctacctctctacttgcatgacttcaaatgccatctacttgctgatgaggacaaaattggtatctctgacctaggtgtctcttctaggctgtggacctgtgtctctgacagctggttttactaagatcttgggcgtttctcagcatctgggatttaacatgagcccttagtgtgtgctcccagctgctttccctcaagattttccctgttgcagtaaatagtgtcctttattttttatttttaaatttatttttatttttaggatttgtgagtacataataggtatatatatttatggggttatattagatattttgatagaggcgtgcaatgtataatagtcacatcatggaaaatagggtatccatccgttcaagcatttatcctttgtgttacaatctaactatactcttttagttattttaagatgtacaattaaattattttgagtatggtcactctgttgtgttatcaaatactaggtatcattcattctttcaaactatttttttgtacccattaaccatccctacctcccccctactatacttcccagcttctggtaacaacccttctactctctatctccatgagttcaattgttttgatttttgcatcccacaaataagtgagaacatgtgatgcttgtctgtctgtgcctggcaataagtagaattgttatctcttcatttgttcatgccagaaatctgggagggatcctggaaatcttcaccttttccattcggtcaatctctcattactttgacaccacctgcaaatatctctcaaatctgtctacttgtctttacttctgttgttggttgccttcatttgaaccaccgccatctcttcgtgtaccactctagaagcctcctaacgagtctgtcttccggttttctgtacctttcatctctccctcagcagccagagtaatcttgaaaagctctaattatcattctgtcaattcactgcttgaaaaccctcctgtggctttccactgtacccccaataaaatgctaacctttcccagagcccacaaggcccggcacgctctgatcccctgccatcactcagcattacaggctcacttcattgctccttacgcttcagccattctggccttttgacattccctgtaatgctcaaactcctcaccttcatcctttgcctctgctgatctcagcaggaaacaatttcccttgccctttgcaccacggattccttctcaccttttaggttttagcttaaatgtcactactttgaagaagctctctttgcacacatttctccttagacctcctctaatgcattcctcactgtactcctacttttcttcattggaaggaattactagaatgtgcgcttatatatctccttaggtgttcatgtatctggcttacatcttctctactgaacagtaatttccacgaaggcagggggctgtgcttgttttgttcatagctgtatccccatcacctggcattgcatgcttaacagctgtttatctcgtaaaatagataaatatttaaagtttattaagatggcaactttggagaagcacctctttggtacttttattgccatgttgcatggtggttatgcttggtgggcccagacctacatgacttggaatccctattcctatcttctgtgaacttgagcagttgttagcttctgtgatccctgcagttcattctgggccgacttctttcttgagtgtaccagtttcacagaagacatattatatggaggtttatttgggatcactagttgggtagatccagatgtgggagcttaaaaaatgacacaggtgctcatgtaagtgtgccttaagttatctatgagacactgtgtgtaaattcatgcactgtgaaaacgtatgctagcacttcttgtatctgtactctcaaatggaatgtgggacattccatattatttggggagtcaggattcctggctggtggtgctttgtaggactctttggtttgccattgctgtaggtcacatggtctaaaatgtagagaggataaaatgatattttgaaagatgatcccttttccctgactagttgttgctcttaattctttcttttagagctttgttgccccagctattttacacccaagcagcaaattatccaggtgggagtgaggggaatccaggggtcagcctggggtagaaagttgaaactgagcatcctgaatgtgggcatagtcgcttattttgagtgttccctacgttagagtatgaaggtctctttgggagaaaccctcacataatgaaacactgctgaggagcctttggttacattaagaatcttttcctattccaaatcacttattttttctgtaatgttaagcttggatttttgatcacctttctaaaaagagggatggcacattcttaaatagtgtttcgagattttcttttctattttggatatttctggtctcctggaagcagagggtgagaagccactactctcaccactatattgttactaagtatgttttcttttgatgaatattttcttttatttgcattttcagcattttgtggcttaacatgaaaatccccaaaccagccaacataaaaagaaaatgtggttgtggctggagtttgtgtgtgtggcttctctcatgtgagcttccctgatgtcatgtttgctagcacgcccaagcatttgactttttcgtgagcctccagtgactctactttgctaatataccttaaatccttaggaggtttctgtaatgaagggcagactggttgtatttgaacaagtagctacagtcctagttctttacataatgtagtctgattatcaataaaggaatgtaattgaattttaaatttctaaggagggggaaggaaaaaaacaatctcaaacagaagtgttctgttaatgaatgtgatagacccctttgttgtttacagacagccgtcttgctgttttgtggaagagagttggggctgtgttgtacatttcactggcaatctgcccacctcctcttccctgaaaatatttatggagttctagtgctttaataagttgagaagtgatttaattgttgcattggcagagtgagataaagccgttaaatacgttcattttctttctgggtgggatggaagagggaaatgaaatactaattttttcctttttggaaacctaatgctgtgctcttttgttatcactcttgttctctaggcattaagtgtaactgaaaccctgattaaacccttggaaaaattcagaaaagagcaacttggagctgtaaaggtttgtgtctaatttgaatacactcagaaaacatagatgcctctgctgcttcatggtacactttattcacatttggcagctttgaaggagatgccggagcaaaccatctgttgttttgtttgaaatgtgcttttccccctttgggggatatggaattggaaacaaaacaaaaacacctggacaagatggtaaaacctctagtaatcttcttgggctacacctttccatatagagttttaaaaatacctgtaaccaaacaacacatttgctctgaatagaaggagcttattactggggggagtgtagttatttctgtgcgcacctcagttttatggaggagtgtagcattacagtagggtttaagattatagacgctgccacactgtgatgccgttgaaactaggaagagactattaagttactgggatgtaatttccttcaatttaacaaaaatttattgagcctctattatgtgcaagtattgttatggtattgtgcattatattgtgtgttgtatagtactgtgctggggattcaaaggtgagtgaaccacagactttgtacttaagtatctgggatttaaccgtgatttccaggaataatgcagtggttttgccacaaggagcctgagatatatttagcaacttatttaaaatgtgcaatctgagctttgaaattaccccagagaaataatttccaccggtctttcctgaattttgtgtatgtacttgagaaagaaaaagtaacatttgcatgctgttgaccatttttggcttggcccaaggagaggggaattaacatcaattttaggtagggaagggagtttttatatttgtatttttttccccccacgtggctggggatgtgagtttttttttttttctcttcctaaaagaaatgactaaaatcccttggtggaaataaacactgtggcctcagtagcttaaccacacagatgaacccaaggagttccagctctgtaattgctgtttatggaatgaattctcatttaagtgacttgtgaaaatattagacatttctttttggcataccgtattacagtttttaatgaagggctacgaattgaggctcagaccctgtgaacagtgggagatcattgggggcaccaccccaggctccttccttggatagtttgccgtgctgcaggcagctgggttgtcccctctggctttgcagcaggagatcggaggtcagctttcacttctgcgaccttgactaagtaattggctttagtttcttatatgtaaaatgaaggacttgggggatctgactactgttttatagttttatgattttgttttgattgtgtctctttaagctctttaaagcttgttgcattttggttcattctcttttaacatttcattggcaggtattccgtgtaaacaacatccatttcttatttttctcatttgaattggatggtgctatatgtgtgacggttatattatggaaatgaaaattgagtgcgagtgaatatatttacttttacttgccatctattctactggaatttagaaatgtctgaccttgaatcttctattgactcattttcccccctaaactttccagcttctgatgttaacatttgttcagagtatatcctgcaaagcaacttgcacaataagtaatccttttaaaaggagaaatggttacaatagtttattctgtgctttgagctgtttaatgaccaaattctttcctgaagtcctatttctgtatccctccctgttcttctggcttcaagtttataaagagtttatgttatgtgcagtcttgctcagtacagtatgtgtgttgactgttgtacctatggatgtcacctgtgaagagcccgtcattgtaggtcatagggagaagccctttttcctggtagttttgtgtaccataataaacagtagagaaaggtggttgtctgtgttctgtaatgatatgtaaactatgtaaacatctgtccttttcattaggttgttaaatctttaaaagactctgcttttttttttttttttaaattctctaccagcccctaccctgccttaatacataaagtatctaataaatagcctatccaactgataattctagaagaaacaggaaagggcttaagtttgggtatttgaattactttccacatctgtgctgcctaaacattcagtcatattttgtcaagcacacagtcttgttcctctgattaaatctgcttacatgggatacttcaaaaagactttactctcttaggttaaagagctttttgtaaacagcataaaacagttttcacgtggggatttaagaaaaaggtctctaaaagttgaccacatcagaatttttagatatgggggtcaacattttgatctttccccgtctcctgtttcccatctgataatgttgtagcccttgcctgaagctctttcagttccctgtgcttttaccttctccggtttccagaagcccagttccatgtttaactgtggtttaaatctattctaagtggctaggtggtttttgtaaattggattttgaaaagcccccaggtattgtctactgttttgcttatatttggatatgctctccttgagccctatctgtttggtttggacgtatccctccattttatgggttctgctgcattttcttatgtgcttgctaggttctagcttttgttcaaaaagcccttttgctatcacagtgagaggtgaagccagctgggcttctgggtcgggtggggacttggagaacttttctgtctagctaaaggattgtaaacgcaccaatcagcgctctgtatctagccaaaggtttgtaaatgcaccaatcagcactctgtaaaaacacaccaaccagcactctgtgtctagccaaaggtttgtaaatgcaccaatcagcactctgtaaaaatgcaccaatcagtgctctttgtctagctaatggtttgtaaatgcaccaatcagcactctgtaaaaatggaccaatcagcactctgtaaaatggattaatcagcgctctgtaaaatgaaccaatcagcaggccgtggacggggccaagtaagggaataaaagctggccatccaagccagcaggggcaatgcttgggtcccttcccatgctgtggaagctttgttctttcactgtttgcaataaatctggctgctgctcactctttgggtccacactacctttatgagctgtaacactcaccacgaaggtctgcagcttcactcctgaagccaggagaccatgaacccagcgggaggaacagacaactctctatgcgccacctttaagagctgtaacagtcactgcaaaggtctgcggcttcactcctaagtcagcaagaccacgaacccaccagaaggaagaaactccggacacatctgaacatctgaagggacaaactccggacacaccatctttaagaactgtaacactcactgcgagggtccgcggcttcgttcttgaattcagtgagaccaagaacccaccagaaggaaccaattctggacacaacaggacacaggttgttgcctgatgcatcacgtcaagagtttctctaaggcctagctgagttcttattttcttttgaagctccttcaccctttttgagcttggcacttattgccaaatgtcccacaggactttgtgggtagctacaggaaccagtacagatcctgaacaacttaggggccaagtatgttgaacaaaaactctgagaaataccagaacgtgataagagttaacatgggataaattgcttttttggacatttgaccaagtaatgaaaatatgggtttgggcaagcagcagcacacagatgacaggtggatgcaactaactggattgagaatggaatctattcagatgctatcttggaaagagccaattataattttatccaaatagaagaagaattttaggcagaaaacttaatagatgttcatttcacaaattatgacttatcacctaagctcattaccagacctctactccaaatttctttccaagactatgactaataatttttttttttttttaaaatacaggatttcattctgttgtccaggctgggcagcagccttgaactcctgggtcagatgatctgagcagccaggactacagatgcctgccaccatgcatggctaattttaaaattatttttgtagagacggtctctctgtgttgcccaggctggtcttgaactcctgggctcaattgatcctcctgcctcggccttccaaagttctgggattacaggcttgagccactgtgcccagcctaatgaatacattttaaatacagacttccaaagattctataaattactacaaaacatgagtaaaacttaaacctgtctggataatttctcatattacattgtatttaatagagcagaaacaatattgatttagtttaattacatttctttcattcagtaataaaacacactagtgcctatcatacagcatagtattagaggccctgagatacaactaggaattacaacactggccagccttcaggaagttagcaactttttgtgagactgtcaaaaaagcaataaaaatatattgtggaaagtgctgtaatagcggtaagcataggtgtcctgggatgtactctaccatctcatctttggagcaccagaaagtctttcaggaagagttaattcttcctggtttgaatcctctttcggtgccttaattagccatgtgatttgggacaagtgacttaaggcctctaagtctcagtttcctggtctgtaaaatgagacttacgacacttgtctcaggaggttattgtgagagttgagtgaatttgataatgtacctgaagtgtctagtttgggacctggtatccatagagtaattttattatcccattcatgacttgctccccatcaccttgccaaacaggagttgctcagctttttgtccattctctgcattctgggtttaggggtgacaagccatagcatgtggcttatgacctttatggacaaatagtgctaaggcactggattagtgactctggagccaccactgaggaaccgaggtggcactttgccagcgttggtgctgctgcagtcctgtgctggccgttcacttgtgctctgacaggtgtctgccaggcacccttctgggtctggattcaagtgctccattctgtgaggatgaagttgaattctcatctctttagagaggctagaggagcttaaaggaaaggggtgggttggggtaggatagggcaaatgaagtgtcaagtaggaacgagtgacacttgccttgggagttaagggagggtgtgccttctccctgctggagtggggagtcctcacttaacattatcagtaggttcttggaaactgaattgaagcaaagcaacacataaggaagccagttttaccatgggccgattgacgtaaacaaaagtttttatgtcatatttctggtctcagaacatcaccaaacttttttttttttttttttttttttttaaaatggagcggagtttcgcccttgtcacccaggctggagtagaatggcatgatcttggctcactacaatctccgccacccaagttcaagtgattctcgtgcctcagcctcccaagtagctgggattacagacatgcgccagcacgccaggctaattttgtatttttagtagagatggggggtttcaccatgttggtcaggctgatttcaaactcctgacctcaacatcaccaaacttctcaataccacaacacttttaatattaaatattgaaataaatgtgagctatacatacatttaagaaagattaatgaaaacaagataatcatttactcactcctgttcagggtcgcaggtggctagagcccatttcagcagctcagagtgcaaggtggacaccagccttggacagggcatgatcccacactcgctcacacagtactatttagacatgctggtgaactgacctaagagatgtgggaggaaatagtagatacccagaaggaatccacacaggcacgggagaacctgcagactccacacggacagtggccctggccacgaatcggtttttatttttcccttattaatgttataatgaaatgatgctattcaaggacctgccatatttaagttcttctctagacgagtccaacagtaaacattatttaattttgtagtttgaaaataagccttttccatctcctcatcctaaacaattggaaaataaagaaaattcaaaaaaagtcatctagtaacaaattctttcctcttctaaagcaaaataatctggtaccctatagaaaaatgggcaattcacaattatgtttaaacttttatgaattctttgtgttctttatccatttttcagtggaagcattattgtgtgttttttgcaaaaaactgcttaatgaagaatatattttgtgttacaaatgtttccctacgttcttacatattggttgtaatcctcccccctttgctgtgtgccctttgcttgattattatgattttttttttatattggcaagttcttatggcttctttctttccttttttgcttagaagatccttctctattctgagatttgttgaaaatactctctatggcttcattgtttacttgtgactctttcaatccatctggaattaattttgatatgagatgaggttctctttctgcttcccagtaaacagtcatgccagcaccaatggttgaatcgtctcttcctttttttaaacccagtgatgtgtaatgacaaatttatatagtttttgacctctaatggtattcagaagatctggttatttgaattggggttcttaggttcttctcttctaccatttatataacgtatgtcttttttttgacccaaaatgctgttctaagtagtagctctacttttaaaaaaggttttgcatgtgcaattttataacagattagaaagctgacttctaccatattcaacttataaattttgtttggcttcctcgtgttgttacaattaagaaaaaatgtgttgccaccataaaaatcattggatttttcagcagttccagagaaatcagaagacatggccaacatactgggcttgtgttctcaagaggcaaaaatgttctggcgctgagtaatggctgccttcttctctggagtagacgaggactatctggttttcattgcctaccactcctgattgcatttctctcccagcctgtttcactcattagattactgcctggcccagactcatttcagtttttgtaatgtctgatttataagaaaagttttcatattgtatttaacttgatccttgttggaactttttggattacgctgttacatttatatatttttttctgtaatgcagtattgggggaaaaaaaaagctccattctttattgaatgctacttgaatagtttcctttgaaatttgtatcatttcagcacaagaaatcatatgagcacaaagaaacaataatactctataatgacattaagaacaaatgcaggaagaaataattacctgcgttttaagattcagaaacaaaacacagcagcatttgtataataccataccatatatggacgaagatatttctattctaagcttggtgggtgtgatgttgttattgttgtttcttggctaaattctttcttcataaaggcttgatgtctcctttttctttcattcccaactttacccacatgttgattttcatagccttctattgctgagtgtgctgggtgttttgaccgctgattaaagcgtcaccccttcctcggcccctttctgtgattcagattaaatcaaataaggtggtaaaaatgttttccatgttcctggtaagtactagtctgcagtgatagtgcttcttactatgtgaccttgctttgcagcagtcttgtgggcaaatgcaggggcctgacttccatttgtcttttgtttaagtctgagaaacagatgctcagagaatgtttgtgaccttgctacagagtcacagagtaatgagtggctaggactgcagcttgggtcttctgacacctaattcagtgtgtacttcacagcatcaactttttaaaatagtggacatttttaggtaatgggcatctgtttgtttcagtttattttctgttagttgttaaaatagtggaagagcataatgaaaagcagaaaagagagtaactatgtaatatcaatacattggacttagttgtaaattaaaaaaacctagagcgtaaagaaaaataaagtcttctgatcctctgtatcaacaaaagagtgactattaagtaaaagaggttaaaatacaacttctgcttttttttggttccatttctacacatgggtgaaccataggatcacagaattttaggtctggatctatgaggcagttaaagaaaagtccctgatctttttggtaagaaaacttaggttctatattgtcagatggttttttttttttttttttttttaagttgtgcagctagttggtaattaaccttggagtagaaaagggaagaaacctcagttcctgagtctctcctcctccatcagtgtgggggagttaattgagggcttttagatgacctgacaggggacatactgtcctgggtttccagaagaacagcgtgtggtcccatgtggtgaaaaaagataaataaaagaagtagagaattaacatgctttgtttaatctctttgcctaacaggaaggaaatcataccagaaaaggctggaatagttcattatttttgctttggaaaatacaagttggaaaattagggaagagaatgttccttttttaggaggtgtggagagttagggagaatttgaaattaatggaaacattttgacagcatgaggacatggtgtgctctcattgatactcaagaatgtttattaaaaatctgtcaagttggctgacagctttaggggagacacccatcttctctgcatttataaatgtgtatacttattttctcaaaaagcttctatagcaaaaggaatgcaagtatgtcctaattctagacagtacctaagaaatgtttgtgatgttaaccaaagggtgagtactggtatatcaatattattttaggccctgttgacctattgatacgtattttaaatagcgttacagaaatcactggaaaggtttgggaaagtagatgacatttctggtagacaatcttattgctatacaggtcgatcatcctgaatctgaaatccgatatgctccaaaatttgaaatgacactacaagtggaaaattccacacctggcctcttgctctctgatggttcagtgtacataagctttatttcatgtacaaaattattaaaaatattgtataaaattacctttaggctatgtgtgataggtgtatacaaaacagaaatgaatttcacgtttagacttaggccccatacccaagatacctctctttgtatacacagatattccaaaattcaaaaatatccaaaaatctctaccacttctggttctaagcatttcagagaagggatacttaacctgtattcatactggaccattagggaagatctttcccaagatgttttttttccaacactgattatgtattatgattttttgaaaatctagagtaaaacatactgattgattgagacagagtctcaccctgttgcccaggctggagtgcagtggtgtgatctcgattcactgcaacctccgcctctggggttcaagtgattctcacgcctcagcctcctgagtagctgggattacaggtgtgtgccaccacaccctgctaacttttgtatttttagtagggacgggatttcaccacgatagctggctggtctcgaactcctgacctcaggtgatccgcccgtcttggcctcccaaagtgctgagattacaggtgtgagccactggcctattattccattttaaacgaattccacgtctgtgccaaaatctggagcaagtttgcttttttaagctttatgttatttttcttacgtattttgtttcattcggttggtgaggggtgagtgacgtggaattaatttttaacattgctaagtctgaagaactgaaaaataacataggcttggaaaaaagtccattaaaggaagaaataaaagtgtctcttctatcctaatgctgtcttgatgattaagcagtaggcttggtacagatatgtttttttagatagctttatcacattcagagtggtgctttgttttattttcagatatttttcataatttgagcttcccagtggattaaccatgtgtatccttttgtttctgtttaatcatagttttttttttatttgtaggaagaaaaaaagaagtttgacaaagagacagaaaagaattatagtctaattgataaacatttgaatttatcagcaaaaaagaaagactcacatttacaagaggtataattttttatttttctgttacgttttcaaaatttgataagcaatacatgtcttttaaaaatgtgctttaatttggataacttttcatctggcattatatagagataacaaaaagtgaacaggtattgtcataaattaagaaaaaagtccttgtgaaacaagaaaaaataatgaatacatcttatagtgattaatgagctatggattcatagtagtaaaatttttgtttctgagcattattttataggaacataactttaaaccagcattagtgaagaacagatatattatttgcaggaatagatcaattaattggcttttgggagttcttgaagaaatgaattgaatttaataagctcatataccattatgcgtttatgtgaaggcagcattaatcttatttaatgctgaggattcaggaggttcaactttgttggaaagagagcatctgttttacttgtattaatagactcatttattttggaggcagccatatgtaagcaggaaggaatttatattttatttttcattttctctttgtttacttctaaatcccctgccatttgtttctctcactcacacacttggatggaaactcagttgtttacaattcaaaacaaaatgcttttattaaaaataatgctgtttgccattgttaggatttagtctcatcccacaaaattgtatttttttttcttgtttttttaacacataaggaatctggacattatgtactactgtcataaacacttattgaagtattatcaaaatgacacagtattaagtcttgtgtaaacctggattatatttaaatgttagctatttagttacatactctgtgtgtgtatggtttgtttgacattatccacatgtgactttttcttttgtgtctctaatacctttgactgacatttggatggcacttgacagttcataaaagagaaaagagcttttacacctcttcgtccttactgcagtactttgggtagggctctgttctctccttgttgcatattattgtgtgctccctcatctcctgccctctgtcaattttgagatgacagctgcagcttttacaggccccctttatgctagcagttctctacctgtgtttgctctcacctccattttcaggtatccaaaaaaagatcttcattccccaagtgaatttccaaatccacttcactttctcattaggtatttcattttaaactttgcttaggcaacatctttggagtcaccttggccctttctcttacactccccatctagtccatcagtatgtcatctttagttccagaatataatcagagtgtgtccacttctcatgactcgctcttctccaaaccctcctaatggcttctccagaggccccagggccacaagatcctatatgttctgcacccaacccagctggggtcagcatagcatatactcagggccgttgtatttgttttccttctgcctggtatgttttcaacagggatccatgtgtctcaaaccttcaattactcttccaaatactctccactcagaggtcagtttattaaaagtttttcctgaccttcttatttagaatgtcccctttactctgctttatatttttttcatattccttttttttttttttttgagatggagttttgctcttgttgtccaggctggagtgcaatggttagatcttggctcactgcaacctccacctgccggattcaagcgattttcctgcctctgtctcctgtgtagctgggattacaggcgcccactaccacgcccagctaattttttgtatttttagtagagacaaggtttcatgatgttggccaggctgttcttgaactcctgacctcaggcgatccacccaccttggcctcccaaagtgctgggattacaggcacgagccacagggcccagcctattttttttcatagtcttaaaactgtttgacaaactgtgcatttgttacgtggcttcttccactagaatgtaagcttcttgaaggcaacaacattgtcttattcagtgttctatcttcagttcctagaacagtacctgttaaggagtaggtacttaatgtatatttattgaatgaactagtgtggagatgcttgtacagtgagctggggctccagcaatttatcagtcccaaggataattaacctctagaaacatgaagagatcctaacgatgaataatttgtttcatttaaattacatacactttttaatcttgctctgtttgctttttacaaacttacatgctctcactgaagcagccttctattttaagtgtgaagcccttaataggggggatgctttttaaaggggaaaatgttaggtttggatattcattacttttggcagtggttaatgtaatgctaattttcagtgaattgagatgctcaagagattcataagagttgcagagaatgatactgaacaaaggcttagaaacgtacataattcattctctcctcttgcttcaattgaaaataacaggagaaggccgggcgtggtggctcacgcctgtaatcccagcactgtgggaggccgaggcgggtggatcacgagatcaggagatccagaccatcctggctaacacggtgaaaccccgtctctactaaaaatacaaaaaattagctgggtgtggtggcaggtgcctgcagtcccagctactcaggaggctgaggcaggagaatggcgtgaacccaggaggtggagcttgcagtgagccgagatggggccactgcactccagcctgggcgacagctccgtctcaaaaacaaaacaaaacaaaacaaaacaaaacaaaaaaaaccaggagaaaattgtggcatataccatgctggctattttggcagttctctgaggccttgctgctatacctctatgtttattgggcataatagcttctacctccatccacacccctacattctacttaatagttgtactgtaacaagtattggatatttgagaaaattccatttctgtttatttttgaagtctattttttcttcccaagtagccaaatgatatttcagtataataataatctacttgagaagcagatttcctaaataactttatgtgagacttgtctactttcttacatatatttacagcaggaatggctagaaattagttgataatcaaattgaaattgtgtatttgttaaaaactagtgatttgcttggagtagtaaaacgtatagtgattgccttttagatttggtcaggctgaaggaaatcattttgtgaccctagttacaacttggacgtccatggcattcttgtaagtgagggctgttgtcacggaatttttaggatgtctcttttccagccagaaatctctgtgtctggtgatgcctttgcccaagttttgctctggcccgctgggcttgttctgcctgctcttcctggcaggctgcactcggcttgtgctactggcctggatctcatgcctgccaagggcgagccaggcacggagtggcgaggagttcgtgagtgagttcagggtcatccggccactgtgcacagccgggcatgccgactgtggtggggcaggcagctccaggcacaggcactggctccgtgcaaggctgtggctggaccaggcatactgcaggtcgcttccattgtgggcactgggaacacggtggcacccggaaacttggagacaccaggaaccgcagagccccaaagaggatgtcacagccctggcttagggagcccctaggtctgggctccccgaagggccgcagctcttctctccttctcgtcgcccacaatgtagtgagcaggggagggggaggatcacccctgtttgtgttacagctctttcagtctggccattccttgggtcccaagttcttgtcccacatccaagaggaatgaggtatggagacaactggagggtgagcaaggtacaggggaacttcattgagcaacagaacagttctcaggagacctgaagtgagtagcctttttctgcaggcaggtcgacgtaatgagtgtccagctctcactggagaggagacctgtagtgcatagctcctttccacaggcaggtcatcctgactagtggaggagacccccagagggttgctccttccaacagctggtagtccccatgtctttctgagtctggctgagtccagagtttttctgggctcagaagggaggaagtgtgctgattggcccatgcgcagccatgagtgggcctggaaaaagcaccgtaagttttcatcccaggctgcagactccacctagaactggcagcccagcggctcccaggcttcaggccatccctggcttgaagctggggtttcaccagggacctgtctgtcccttcccacctaggaacctgtctcccgcagctgtcaacatgtcatccatggcgcccaaggtatttgtgccaagaggtgcctgcaggcccctgttaagctgctctcagccccctggcctccctcctgtgcttgttggcatccaaagtccagagggggccgagctggaggttggggttaccaggggcgctggcatgtcagaaccaccctgtgtgcatgcatacccggctgggtggcaacagtacctgggcttggctacaactttgctccacactgcatcaggcgccgggagccgggagaggccagggagcaggagcaggcacttcttgagcctgctggtggggcagtgggccttcgccggcccccaagagcacagggatgccctggtccagagctgtggctgcacggctgcagctgtgtctgggagcatggggctcctgccctgataactctgtagaagttggggctcctgcctgtttctggcccccgcgggcaccatggagtgcgcagccctggctgcactttgccctctgcagctggtgtcctcacagcggctgctccagactggccgctgctgccatcattgccagtaatcccagggattctggtgatttaatcacagagcatgtggcacaacagttctggattttcagaacattaagggggtggtgatagaggttgactggtaatgcaagggtaattacagtagcaagaacaaccaggagagagaatttactaaaagataaaatcaaattgataaatctgatgctggtataaatttcttcaagagcctttgcagtaataacaaatgaggaaatcacccttcttatgtctttattaaatagtcaacaaaattacagtgtttttgctgggagatgtgccaactaactgctgatggctgaactatcaaactctggttattggaggcacaaaaatatgattcagatgagtgttaggtagaaattctcattttagcttagtaatatatattaaagtatttgctgaaatggtttttattacattttgaaatgtgtttcaaatgtgttaaatgcttttcaaaaacaacacatttttggttataaaacgtgaataaaatttcaataaaatgtatgattttattttaaagtctatggcccagtggtattaagtacattcacattgttttgcaactgtcaccaccatgcatctccagggctttttaaaaaatcttcccagactgcagctctgtacctattaacaataactctccattctcccctgctccagctcctggcagccgtcgttctgctttcagtttctatgaatttaactactctaggtgtctcatgtgagtgggatcatatagtatctgtccctttgtgactagtttatttcacttagcctgatgtcctcaaggtttatccatgttgtagtatgtatcagaatttccttcctgtctaaggctgaataatattctgttatacatatggattggctacattttatttactcatccatccatccatgggcattggggtcactttgccccctgctgctatgaacaggggtgtacacatatctgttcgagtctctgctttcagttcttttgggtatatgcccagctgtagaattgctgggtcatgtggtaatactatttttcatttgagggaaaaatttattttaattttttgctgggagttgtgcctgttaactgctggtggctgaactattgaattctggttaatgaagccacaaaaatatgattttgaggagtgttaggtagaaatgttcatgttagcttagtaacacgttatgtttcaatattattttacttaaagcactatttttcacagtgcttgtaccatcttgcattcccactaatgatgcacaagggtttcagtttcttgacatcctcaccaacaccactacttttcttttttgtacagtagccaccctagtgagtgtgaggtggcatctccttgtgagtttgatttgcatcctaatgatgagcgatgttgagtgtcttttcacatgcttattggccttttgtatatcctctctggagaaatgcccagataaatatttttaagagtaaaattagctaagttaggaaaaatatcacatgatacctagtaagaatggtttcttggacatgagttctctctccactattctctgtggagtcctgctcttctcccagttcctttctagttaggcaagctaagctggaagctttttttggaatagcgtcctgaccagctggtgcccccttctctcccaggggatcagacgttctgagggccgcagatgggcgtccagccctggcccgcctttgagagccgggttcttgagatgctgccatggctggctccttctcacttgccgccatcactccctgagcgctgaggtgctgggccctttctcaggcagactttattcctagaggatttgttcatcgaaatgtttgttgattgtgattgcatgtggttcagccttggggcatcagttgtggttggggtgagtttttcaagaagagaagtccctttgatcttcagttcttgggggtcaacttcaacaaacagagtaggagtcacaagctttttctgcaaagaaactgatagtaaatattttagacttctgtggaccataaagttcctgttgcacctgctcaattctgctgttgcagcaggaaagtagctgcagacaatacataaatgaattgtcgtacctgtgttgcaatactttatttacaaaatcaggcagcacaccgtattttggcccatggaccacagtgtgatgacctctgatgtagcgtttcacttttcaccatctccagtttgactaacctctgtgattttaacataggcagatatccaagtagagcagaaccggcaacacttctatgaactgtctctcgagtatgtgtgtaagctgcaggaaatccaagaaagaaagaagtttgagtttgtggaacctgtgagtattgccaagttgtttgctggtggatttttgcaatgtaagataagtatttattttcctagatctgatttatggtttatagttactagaggccatagtgcataaacatgaaagagacatattaaaaagggcagacacagatagccatgaagtcaaggaattgcctctaaatcagtggttctcagctgtatttgcactgataatacacgtaatattcccattgctacatgatctcaaggaaggcaaccatgtgcaatttctgccaccttagcctatagctctatcttttaaaaatttctctgaaataatttatactagaatgagtgaacatgggttgtttataccggttcaaactttggtactttaaacaatcgtttgtaacatgacttcaaacacaattcacaatgcttatggcaatctaagtttagaagcaggatatggaacatttgagacaattttgtgagttactctaacatttctttttacttatattagaaacacatgatttttgtttgtgattatatagatgttttctagtagcttcagttgtttatatatgaagatgtatgcacatgaatgtatatatcataatgtaaaggatatttcatgtggatttcagcaaaaaaacactggatctcattctcaggattcattttaattttaatatcgacttattgaatggtttctttttcttaaacagctttattaagataatattcacacagtatacaatttactcattgtgagtatggtttatagaaacaagaataaccaagtaatgattaaaaatgagcatttgtggagctatggtttagttggagcgatagtcattaacctaaaccattagagaaaaactcaacctcctcaaagctttctttttaatgtgaaataataataatggcctgcttttattgggcatttataatgctcagtctctgttcaagccattgttctaagtgttgtaccgaactcattattccacactataactcaatgaggagataaggaaatagaagtagagaaaggctgagtaatttgcctaaggtcccataacaggtcatggctgacgttgggaatggagcctgctgggtgtcagagccccagattcctaaccacccacggtgtggcatttggaagaaaatgaatctcaagatttccttaactgtctccccagatcacttctttttacttctagatttattgacttacatgtggagcagaggcaacagccctctaattcagagacaggttgggagttggtaggaaagtaaaggtttaattacgggtttgaggctgcccctggcaagtcatggaatatctttgtcaacaaaacacaggggttgcagtctgctggatgtggctggggagagcctggagctctttgattctgtgattttactttcttaaagattgtgtcaacctatagtgataagatttcaattacaaatattgggattctcctgactaaagaggacaaatggatgacttaataattcaatttttcctgcagaacatgccatataagctgtctaatggctgtgatatttaagggaaaaaagcatcattttctataaagaccaattaatagataatatgtacttgtgtttacttgaatattagtgacttccctttaatcagtttatttcagtggaataacagtgagatggcggggggaacacttggttgtttatatgattctttttttctcctgagtttttttgtgctaatatctcttttcttcctgtgtcttagatgctgtcattttttcaggggatgtttaccttctatcatcagggccatgaacttgccaaagacttcaatcactacaaaatggaactacagatcaacattcagaatgtaaggaagtgaaagctttctttataaaaagatgtttgaaaagtatttttcatttgtgtgttgtatgaaaagccttaattaaatgaagacaatgctgatctgtttgtactgagaaactgagggtatgctgccacctgctggtcaactcttggtgtgaccaactgctctacagttggttgaggcttgggaaattctgccacctggcggcttttcctgcagtttctgggtcaattctaaggataagctttgttatgttaactctaaatcagctatgtctgctacagacaaaagagcactccactttaaggcattgaatttataatgcactacttaactgggcatcttgatttttgttcccagataggcttatcatttgagtagaatttcttccctacattttatgcatatttactaatgcattggtgtttacagttgctattggtcttgaatattttcctttggaaaatgtgtgctttctgccaggtctcggataaagagatttaggagaatgttattaagcagtacactatatgtcattttgatcaggtggtatatgtttttcctctcagtgctagttgatcctggaagcgtcctcactgacaagctggtcagggtatgttgagtgtaatttgaggtctcattaggaatgtagtgagatagctttgtgacagactcacagcacatagtgaaagacacacaggtagatggatgggaagctgtggttgttgcctgctcttcatttctttcacaattagaagttgagagtgggccgggcacagtggttcatgcctgtaatcccagcactttgggaggcctaggcgggcagatcgcgaggtcaagagattgagaccatgctggccaacatggtgaaaccctgtctccactaaaaatacaaacattagctgggtgtggtggagtgcgcctgtaatcccagttactcgggaggctgaggcaggagaattgcttgaatccgggaggtggaggttgcagtgatccgagaccgtgccactgcactccagcctgggcgacagagtgagactctgtctcaaaaaaaaaaaaaaaaaaaaaaagttgagagtgaataccttttgtgtagattttgtttctaacttttttttttttttatgtacagttccttatactaaggagtgtagctgataaaaccttatttttataatttatgtgtcaacttgtatttgaggattgtttggacattcagctgggctaatgatagagttctggagtagattctttttctgctgctgtggtctcacaatttgtgaaaacagttataaaatatgtggtatgactataatgtgacaaaacttaaaaatccaaaatgggtatgtgtggattcattctagtcaccccaaaattgtccctgcaggtagtagaatattgagtctaatgttgttgagttttttttgtttttttttttgagacagggtgtcactctgtcgctgaggctgaagtgcagtggcacaaccactgctcactgcagcctcaacctcctaggctcaagtactcctcctgcctcagcctcctgagtagctgggactgcaggtgcatgccagcacacccagctaattttttttctttttggtagagatggcatctcattgtgttgcccaggctgctcaaacttcagggttcaagtgatcctccttcctcagcctcccaagatcctggcattacgggggtgagccaccatgcctggctgatgttgagattattcagaatatttttgcaggcagcagaaaacagttatgtaaaaagaacagtagatagttcacgtaagtggtccccaacctttttggcaccggggactggttttaaggaagacaattctatagatgcagtgggggtgggagaaggtaggggatggtttcgtgatgaaacttttccacctcaggtcatcaggcattagattctcataaggactgcacaatctagatccacgtgcgcagttcacaatacggttcatgctcctatgagaatctgatgccaccgcggatctgacagaaggtggactcaggctcacctgccgctcacctcctgccatgtgacccggttcctaacaggccatggaccggtacctgtcggcagcctgggggttggggacccctgcttgagattataacttatgttttcccctctgcttactggctatataatctgtggaaattcaccttgtctgtctggacctcatctgttaagtgcagggctggccagaatgagaaccttcaggcaggactgtatatacaacttctagaatcaaggtaaaatgaagaagatagtgccccttatttagagataattaagagtttcagatcagaggcatttgatcattaaagcaagcagaagctcttctgagcgcagggccctgtggactgcataggtgaatgccctgaagccagctctctgcctcagactctggggtgagctgtggggaaacatcagtctcttgggatgttgagtgaaactccttgcacggctcgtttatttgtggaagtgtgtttataacacacctgttgggggggcgtctgtttaccttatataaaccaaaaaactttcagaggcattaaatatttagatgggaatgagcaatattctgtctggaaatcttatgagcaaaccttgaagctaagctatcatttgaaatgtttcacaaaatgacctgattggaatccttaatatattgagaacttacacaattgacaacagtgatcattttctgtagagaaatggggaaatgacagtttattgaaaaaaaaaaagccttttttgtattctctgtcacttaaggatgtggtcatcagtaaatctccctacattctcaactttttctctaaatattcctctcttgattttatttggctgtttcttaataaacactcttacaactcagagtttctctctgcgtcaccttcagtattgagaacacctgatctaggtggcgtctttgttcttcaaaattttagcttttagctaattttttatcagaaacacaagcacttatgaaaagcaggtcactcattctgtatcatctgctatacctcagtgatgttgtaatttgctcatttcttggccattcatctcattccttgatgtcagttttttattataataaagagaaaatgctgggtatataaaacaacatattgttgaaaaaagtcccagtttgtgtgtgtgtgtgtgtgtgtgtgtgtgtgtgtgtgtgtgtgtgtgtttcatttatttgtttgtttgagagggagtctcgccctgtcacccaggctggagtgcagcggcccaatcaatctcggctcactgcaagctccgcctcccgggttcatgccatcctcctgcctgtagtcctagttcatgccatccttctgcctgtagtcccacctgccaccatgcccggctaatttttttgtattttttgatagagacggcgattcaccgtgttagtcaggatggtcttgatctcctgacctcgtgatctgcctgccttggcctcccaaagtgttgggattacaggcgtgagccaccgcgcccggccgcatatatgtattttaggaaacataatcaaatgttaactgcctctgcattataacatcataaatattttggtcatcttttaagtatttaattttagtaaaaaagcaaaactttataatcagaaaaaggtaaaaggtatttaaaagcgaaaacctatttttccccatctgataatacctattgtattgtaaaagtggctagactttttttttttttttgagaaattgagtcttcattttctataatctagagtaataaatggaaatcaagaaagcagcaagatggcttttaggaaatgggttttccagaagaaatttggaaattgcctcaaatttaaagaatattttaagaaactaattttgcacttttgtgatttctgtctcccgaagaatgtggggaagaagagactagaatagaattcttcctggaaggaaatacagtgtgcaaaattttaggatttgtaaagagtccctagaagataacaagaatgggtaggaagtatttaagaatatgggcaaaatatttttgtcgcaatgttctaaggaaagtagaataccaaaactacagactgtgtgtgtgtgtgtgtgtgtgtgtgtgtgtgtgtgtgtgtgtgtgtttgagatggagtcttgctctgttgcccaggctggagtgctgtggcccagtctcggctcactgtaagctccgcctcctgggttcacgccattctcctgcctcagcctcccgagtagctgggactacaggtgcccgccaccgtgcccggctaatttttgtatttttagtagagacggggtttcaccgtgttagccaggatggtctcgatctcctgatctcgtgatccgcccacctcggcctcccaaagtgctgggattataggtgtgagccaccacgtccggccgtgtgtgtgtttttaaaagagattagaaatggccacatcaaaatataacagcagttacttgaggggtgggcttgtggttagctttagtcttacttatcccttttgtttttgccccccaagtaggactattcgtgtccgtctctctattttacaatgatatggtttagtttctataatcagaaaaaagttttttaaagatgttttctctttcaatcagatttaaaatactaaaataataaggcttaatttaaagctagtttatttggaaatgtttaattactaaaggatgtaaagaaaacaaggcagcagtgatcttttattggaaagatagcattagacagtgtcctaccgtatagattattgtgaggattaaagaaccatgtaaatgctcaaatgttacctattgtaacgtttggggtctaacattattgtaattagaagatgccttcatatgtacttggaacttataattggaaattgcaaggttttagccattctattgattttatgcaaagttttcaattcataatttacctaaaaatggtacatttaaaaaatagtggctggggatggtggctcacgcctataatcccagcactttgggacattgaggcgggaggatcacttgagccccagagttcaggaccagcctgggcaatgtagtgagaccctgtctccacaaaaaatagagaaaaattagctggaggtggtggcacatgtgagtagtccctgtactcgggaggctgaggtgggaggatcatttgagcctgggaggtcgaggctgcagtgaactgggattgtgtcactttactccagcctgaccaacagagtgagactcggtcaaaaaaaaaaaaaaaaaaaaagccttccattcccagtgcagaaaataaacctctgaggaagttgggtggtgagggagagggggacctcatggaggcgtctgcggcagggatggtggagtggtgatgagacagaggtggctgctggggcatttgggagattgcttatgctgagcagagatgttaagtgagcacgtaagcagacatgttgagaatgagaaccaggcttcttactgtctgggaaaaaattcacaaatttggaaggagagaggctggaaagaaacctgaagaactggagtagaattagatttcttggtaggaagtcatgggttttcaaatatataggtagataaagaagtagtgattgtgtgtttatataaacacgtgtgctctgtgtatacagttgacccttgaactatgttggggttagcacccctgcgctattggatgtctgcgtgtaacttttgacttcccccaaatttgactactaatcgcctactgttgatcagaagcctcacccataacagaaatagctgattaccacacattttgtgtgttctatgtatgatatactgtgttcttacaatgaagtaagctagagaaaagaaaatgttattacaaaaatcatcaggaagagaaaatatactttaagtggaagtggatcatcataaaggccttcatgtgtgtcttcataatgagtaggctgaggaggaagagttgctgtcacaggagttgtagatggggaggaaaatccatgtataagtagatccacaaagttcaagcctgtgttaaggctcagctgtatgtacatctgcttcctaaggctgtctgctgagaagacttagaagtgagcacactgtgcccagatcttgtcgcaggagttgtagatggggaggaaaatccatgtgtaagtagatccacaaagttcaagcctgtgttaaggctgaactgtatgtacatctatttcctaaggctgtctgctgagaagtccttagctgtgagcacactgtgcccagatcttggtttccaaatattaaataccctccactaaaaagaacaagagctcctttccaggactggcgcagggaaagtataagatgagcctagggtaccttattggaccagaaggtaaggaactggttgaagaatcaaggggaccagtcaaaagacagaagccagttcgaagggacctcctgctgctcaaatctagggcaatttgagcatgaacataaataatagcattattggcttaaatagaagtgtgtgtacatgttcacacctgtgatagcatccatacatgtatggcatgcacatatatgcatatgtgtatatatattatacacacatggggggaaatgagggttgatgagggttggaaggaatctcagcaaaatgaccaaggaggggaataaagtcagggtgaaattattacaaagatggggataagggtgggggatggtggctcatgcttataatcccaacagtgtgggaggctgaagcgggtagattgcttgagcccaggagttcgagaccagcctgggccccataatgagacccctgtctctacaaaaaaacaaaaaacaaaacacacacacacacacacacacacacacacacacacacacactcttggcctggtgtagtggtgtgcgcctgtagtcccagttcctctggaggctgaggtgagaggatgacttgagttcaggaggttgaggctgtgatgaggtattatcatgccactgtactccagcctgggagacagagtgagaccctgtctttaaaaaaaaaaaaaaggggggataagaaaacctggagaaatggaaggcgagagggaacctagccgtcaacaactgagttctactttctttgcgggcttacactttcttacaggacataagctgatatttctcgcagctcttagtttgtgtttaaaaaaaaacaacaaacctctgcagacaggttttcccttttacaatctacatttatcagactctccatccctttacaaaaaagatgtgccattctaacattttgccacgcttaggacccttggcagccccttttattgtagggaggaaagaggagaaatttcaataataattttctgtctcagttcctccacagtttcacatcagcagttttttggtattaatacaattatttttgagcctggatgaaagaagtgtccaggaacacggtggtgctgactcgtcacaattgccttgctaattctgtcacttcaccttgtatatatgttttcggtgtagccgtttgacagatattggcacaccaagtgtcctgggtttcagaaatgtgatttgtctcttcagatatcaaagacattatttgtgtaggtgagattttttttcccccttctgtcttcagggaagaaatgtcattttcaagtgcaattgccatgacctggaaaaactgacacttgtatttattagtttgcaaagaagaattaaactttttcagattctgagtatttacagactgctaatgtaacagtaacaaaacagattgattgagtcagattggttgttgcaaaggaaattcttctcaggtagctatattaaaacctaacttatgttttaaacctaaaatttagtaatagtgtgagacctgaaggcaggaatttttatgttgaatagtaaaattattaatggtgttagaaagcctccaaagtaacctgtagtaaccttggcttatactcctctggtagctattttactgctatttttttttctttgcacatgaatctcaggaggcacactggaaagaatgggggtattttgagaaatttataaaaaagttatttagagttaaaaaatgtaattacatttatgcagagactttaaaatgttcatgagaaaactcatatgagaacttaacatttatgtgtgttttttaatccatttcagacacggaatcgatttgaaggaacaaggtcagaagtggaagagctcatgaacaaaatcagacagaatcccaaggaccacaaacgagcaagtcagtttacagccgaaggctacctgtatgtccaggaaaaaagtaagaggccctccagcagtggctgcgtggctgcttaaaaatgcaaattattgaaaactctgctattcttgccattactgtgacattttgggcaattattcctacctctttctctccctgctcctatcacctaatgggtgtatatttcatgtttaggagaaacacattccagccctggagagagggggtactgtgaggttaggagtggctgtgagcaccctgttcttcagacaccccactagcttctgttttacactgtgtgcaccccaggaacatgcttgtaagagagtcagaatttggtgtaaggctgaaaatgagccagagttacgagggtatgatgttttttctccttccccctcacctctaccctcatcaccaatgcacacaggcacacacattcattcatacacacgtatacgtcctctccctcccataaccctgcctctctgtcatcttaaggtcaagagggacatattagtatttttcttcttccttcataccatttttgttcccaccagtctgagatagctggttcttactaaaatcatcaggaagattgcagatggtgataaaagatattcctacgtggcatcctaacttgtaggctttttagtctttgttgctgtcttagcaaatatgcagtgcatagattgttctcattttgaaaattaaaagacctgtatttctttcagactttgaacatttggtcttattttaacagctaagttcttaacgtttactacgtcaactgtacaacccaattgctagttagcagaagggatgagaatgtgaaatgggtctctttactatttccctccctctccacccttaactgtgattagggtgttttacagttttcacttcatttaagtgtggctgatttacaggactttcaatccgacctaaaaatttagtggtagacatgactcagggaacggttacagggtatctgtgctttgaatagaagttaatgttctatgcaggcagcaggatggttgtgccttttccatttgcccttatttaatctggaatctcgcagccttcaccttttgtgagcagttgtatgatatggcagaagtctccatttttctcatacattatcttcttaatctcagtttttaaaattgaatttgaaagaaataaattaaaactcaagatagggctgggcgcggtggctcacacttgtaatcccagcactctgggaggccgaggtgggcagatcacgaggtcaggagatcgagaccatcctggctaatacagtgaaaccctgtctctactaaaaaatacaaaaaatcagcagggcgtagtggcgggcacctgtagtcccagctactcgggaggctgaggcaggagaatggcgtgaacctgggaggcggagcttgcagtgagccaagatcgcgccactgcactccagcctgggtgacaaagcaagactctgtctcaaaaaaaggaaaaaaacaaaacaaaacaaaaaaccacctcgatagtcttgagaatgttagaattatttgtattatatgcccaagtgaaaatcacaggaaactttaatttttagattcatcactgttgcctttgagagaaattggactgaaacaacataacagtagtggtaaaattctttcctcatttactgtatacccagcactgtgctaaattcgtatacaacttgtctcatttatccataaaacagccctatgaagtataaggtactattactgttgcccatttataaatgaaaatggaggcactgagaggtaaataatgttccctaggtcatacaactactaaatgctggagttgtcattctgaacctggagtctgtgttggtaatgtctcccgtaaattgcttggcgcttgaacaggcgtgaaagagcatcattagtgtgtatgcccagagctggttgaataggccctgttggttgtcagaagggaatggtggcttaagtagtggaaagaccttgatatttggggccagagattctgatttaaggtttggctttgtcattttccaggcatttgggctaagcttaaattttttttggattaaatagacagtatcatcctctctgggcagttttttttttcttagagttaaataaaatatctgtgcaatattttttttgtcaaccatagaacacagtacaaatgctggttctttaaaacacaaagcaatgtttcccaaattcaggtctttggactgatgatggtctgagataaaattgatagtggtctggtaacccttttcatctattacccctgtcccaaataatgtaattagcttttcctaaagctagctaaaagcattccttttacatgagttatttttcccctcctgggcttttttgatttttaggtgtagaaactttgtttgtttgtacatgaaattactgtgataacagatgttaattgcttttttaaaagtgtcttgactcagtaaagtaagaaattgtcaacttctgctgggcctaacctttaatttgttatggttggacttttattggcatgtgaagttccagatgctagaggtccctctgacatacagcattgtcctgtgagccctgatggtggtactgctgacttagtaagagtggaaaaggggttcagagagtgttctggggcatacttggacagtcactcctattgagtcttagatttcttattcttcatactttttttttttttttgctgagattacaggcatgagccacgaggcccagccattctcttggttcttaagatttttttagaccttactgattacagtaatgttaagccagacaataccaatgttattttattttattttttgacagtgttgctctgtcacccaggctggagggcagtggcacgatctcatctcactgcaacttccgcctcctgggttcaagccattcttctgccgcaccctccccagtagctgggattacaggcacgcaccaccacgcccagctaatttttttttttttggagacagagcctctgtcacccaggctggagtgcagtggcgcgatctcagctcactgcaacctctgcctcctgggttcagcctattcacctgcctcagcctcccgagtagctgggactacaggcgcgtgccaccacgcctggctaaattttttgtattttagtagagacagggtttcacaacgttggccaggatggtctccatctcctgacttcgtgatccacccgccttggcctcccaaagtgctaggattacaggcgtgagccactgcgcctggcccatacttcatttttaaaggctagctttcaatcatcagtaagagcagctgcttactaggatgctgttcatggacttaaagcactaggtggatttttagactagatgcttcttagcactatgattctataattctatcattttgagaggccagaattaaatcccaaaccatctcatatatgggatggaacttttgaaacccttgtgagctcttaatacctagaaacaaacaaaaaatagagcttacaattaagagattttcagataggacataactgttgatttttctagcaaactatttaaacagtatgtctttaaatcacttctgtcttgctaaatcttagaggtttgtttcaaagtatctcttattttccttcttcctcttttttttttttttttttttgagtcggagtctcgctctgttgcccaggctggagcgcagtggcgcgatctcggctcactgcaagctctgcctcttgggttcacaccattctcctgcctcagcctcccgagtagctaagactataggcgcctgccactatgcctggctaattttttttagtagagatggagtttcaccgtgttagccaggatggtctcgatttcctgaccttgtgatccacccgcctcgacctcccaaagtgctgggattacaggcgtgagccaccgtgcccggcctcccctcttcttcttagaactagcagtattgctgatttgtttcattgattcagctgtattcgttgctgcgttttagacatttcctctttagtaatgtgtttatagctctgcaaatctgcttatttatgagggaaaatataaagggctgtttttttgttgaagggcctgctccgtttggttccagttgggtcaaacactattgcatgtatcgaaaagcagcaaagaagttcaacatgatcccatttgagcacagatctggagggaaacttgtaagtatttgattcaacatagaatagattataatctgtcagaggtagtgtttgagggtgtcattttaatggtttatattttaatggtttatattcatggatggtaaataaattgttagtattaaaatctttgttttgtttttgagtgaaatgggccagaagacagaacaatatatatgttttctgaattacatgcatgggttttaaaccactagatttttttttttttaagttctgggatacatgtgcacaacgtgcaggtttgttacataggtatgcatgtgtcatggtgatttgctgcacccatcaacccatcatctacattagatatttctcctaatgctatccctcccctagcccccagccccctcacagaccccagtgtgtgatgttcccctccctgtgtccatgtgttctcattgtcagctcccacttaagagtgagaatatgtggttttaaccactagatattttttaggtgaacaatagaatcctttttatgccactgtttggaagataaaggtaacactgacagcaagctttcatgactcagtggttcctcagcatttatacaatggaactgacttgctgttcatagcctgaaaacaaagaagagtgatctacgataaattttactgttgttctgttcatcttacaaagttctcacataggtattcaccatttagttaactgttccccctgaaactaaaacagcaaagcatgatagtaagaaaagagcaagaagacctcacagagttggctgtgtaggaaaggtgatctttatatgtattttaaatggaatctgcagcttattacaataattaatggcctagagacaaagcttcccaccaatgttgaacataattgataacacattttaagaaagcagcttaattcattgcttactgggtgaatgggtatggttttgcttaggtgaataaaaaaagaaaaacctatgttcacttctatttacttgtactatgcctttccctgaaaaatatttaaagcagcttttaataaaaacacatttatataataatgaaacagacatggaaaattagtcatggtgaggagaaggaagtgaggagatggctcttgaagcatcaggtttgagactgagtttcctgtcagagccagttcaagtcctaagatatttctgcttagtgatatctttctgttttagcctccaaataataatgataaatatgttatggaatataactgtgagattttgaatatttgtgtatcttaatgtttgttacttagagatcttcacgttctggaaaatgttaaaatgttcaataagtgtgtactcacactttatatagttgttcttttactgagcacttgtatttctgcattgcaaattaagtaaagataaattcagggtgattcacatagggaagagagaaattgcatagattaaatggttctagctttagattatgaaaatatttaatctagggttatcggtgtacttttaggctgacgtgtatggaattgcaatttttataggccaaaaatagtcacatattttttgtgacatgtggtaagaaataaatttttacactaaaaaaaagagtacaataagagactaacagtattccagtatcttaaaactgtactgttaatctacctttgaaaattaacatttggccagggacactggctcacgcctgtaatcccagcactttgggaggccgaggtgggcagatcacttgaggtcaggagtttgagactggcctggccaacatggtgaaatcctgtctctactaaaaatacaaaaattagccagtcatggtgatgcacacctgtaatcccagctatttgggtggctgagtcacagagttgcttgaacccaggattcggagtttgcagtgagctgagattgcaccactgcactccagcctgggcaacagagcaagactgtcaaaaaaaaaaaaaagtaacattggtattgtctggcataacattaccatcatcagtaaggtctagaaaatcttaagaatcaagagaatggctgggcgcggtggctcacgcctgtaatcccagcactttgggaggctgaggcgggtggatcatctgaggtcaggagattgacaccagcctggccaacatggtgaaaccctgtttctactgaaaatacaaaaatcatccaggtgtggtggtgcatgcctgtaatcccagctactctggaggctgaggcaggagaatcacttgaacctgggagatggaggttgcagtgagccaagatcctgccactgcactccagcctgggtgaaagagcgaggctcccttctcaaaagaatcaggagaatgacaaaaatattaatattttagattctaaatagcatttaaataagccagtttgaaagaggatagggtaaagagaaggacttaagatcttgaaccttgctcccctgctctccagtatagaatggctgagtgtgtatatacttatcctgtaggttttgagaatgttcaaaatgattatttgcagggggacggagaggtgttctttttgaaagaatgtaccaagaggcatactgactccattgacagaaggttttgttttgacatagaagctgctgatcggtaagttattggaattattggacatggtgaaagagtcgttttaaaaaaatgatttaaaaaaatagaggttagttgcaactgtgatttctgtggcctgggagaatgttatcttgctatatttccaggctgtgtgttcattataagctgtttagtcttgatcaccgggtttagctatggggtgatagtttcatcttgatttagttaggagtcattctaaccagggttgtcacttaaaaaataaccttggaggccaggtgcagtggctcacacctgtaatcccagcactttgggaggccgaggtgggcagattatgaggtcaggagttcaagaccatccaggccaaaatggtgaaactctgtctctactaaaaagacaaaaaaattagccaggcgtggtggcatacacctgtagtcccagctacatgggaggctgaggcaggagaaccatttgaacccaggaggcggaggctgcagtgagccaagatggtgccactgcactccagcctgggcgacagagtgagactccgtttcaaaaaaaaaaaaaattgccttggagcttttcattgttgatccaagcctaatttgtagcatgaagagaacaatggcgagaggaactgggtgacaaagctaaaaaggggtgataggtagctagctactaatacagaacaacattcatttgtgtgtgggggggttttcagtgtctacatcctgtacgtgatggagggtcttaggcaaactccttctgtttattcaaaggtgaattcttttttttccttattgcatgacttccagttatttagttgtaaaagaatctttgccagagaggaagaagtagaagagaaaattttgttcatcagtattactacttgtctggcattaatttctatgtcctccagtagcattaaggaaaatcctagtgttcatagaatatttgctttttaatggctgacagtacagtgattccttgccagccctggttttggcagtgatagtttttaggtaaggctgttctatgtttgtataataaaagcttatgagatttgttaaagcaaaagttcaggtcagaacccaggaatacaaaagtaattaatgctgcttcctctcttagatgatatagttgagtctctgggagtagtgcagagaggaaggattagtggttcactttgtaataaatgaattgaagaccatttattgtacataaaaacaggcccttaagcaccatgataagtttggcactactgtgaaaaggacaagtggttaaataagcgttttgccaagataggaaaaatatgaaagagaatgtcagtgaaaaagaggttgggtcttgctatgttgcccaagctggtctcaaaactcctggactcaagcaatcctcccaccttggcctcccaaagtcataggactacaggtgtgagccaccatgcctggcctaaatttcaagccagtaagaactcttccaaactttaagaagggaattagtcagtgtaacacaagtcgagcatacatctgtgcgcacacacccatgggtggcattggattcctttctgagtgccactgttctaaatgcttctgtgttttatctcagctaattccttgccatagctctctcaggtagttgttactgtttccattttatgatgagaaactgaggcacagagcatttgagcaatttccccaaggtcacgtagctagtgggtagttgaagagctgagatttgagcccctgcattctcctcctagagccccacatcttacctttttcttttttctttctttttttttgagacgagtctcactttttttgcccaggctggagtgcagtggtgtaatctcggctcactgcaacctctgcctcccgggctcaagtgattcttctgcctcagcctcctgagtagctgggattatgggggcacactaccagacccggctaatttttgtattttcagtacagacagggttttgctatgttggccaggctggtcttgaactcctgacctcaagggatccacctgccttggcctcccaaagtgctgggattacaggcaagagccactgtgcctagcttgagccctacctcttaaccactgtgccataagtctctgcagattaccatataatcagaatgttttctaaataattgacaaagatgagctagcagtctactagagaatatgttaagtgaggtgaatctgattagttgtgaaagcagggtacttctataatgcaatttaatcattttaatcatccagagtctctggttttctctgagaccttgatcatgcccaattttcttttctttttttgtcagccatgatcctagctatgattggaaccactctccacccctcaaagacattgatgagggattcctatggaggtgcttacacatacgaaggataatacctgtagggagactcttggaacaggggaggactttaggtcagggatctattctagtggttttcaagtactttatagggagactctcttttcaaataaaatttcatgttaatgtgtatataaagcaaaaaaagtgggttcccttattaaagaggcataggggcctggattcctccccaccttttagcttccgtcttttttcttgcaaaagtctctaatttacttccattgaggctcacagctcctttctgggaactcctggcagggggacctaatctagtttaggtggctaaataaaggcacacagaggatctgacatctaaattcataaactaaagggttatctggagtcagctgggattgagagtcatgtgccaggtagagtgagtgtcacatgtggaggcctggagacaggagagagcatgatgtatttgagacacctagcgtcactagtgcaagagccagagagagtgggagaagaggcttgagatggggcaacggcctgaacttgaagtttttgaacttaatccattaaatagttttaagcagggcagtgagtgacaattatatttgtatttctcaaagctcattctggcagagtaagaaagatttggaggtagcaagaggggacaagaggaagtagtttaaggacagggtgagagggccaggattggtgtggtggcagtgggggtggagccaagtggggtagatttctggggataaactggatgttgcagtagagggtgaaggagtggggaaggtttctggcttgagtagctagatggtaccattcactaaggtgggaaacaaagtgggggcataaggatgggggaagacagtaaaattagtttgggtcattgtattagttcattttcatactgctatgaagaaatacccaagactgggtaatttataaagaaaaagaggtttaatggactcacagttccatatggttggggaggcctcataatcatggcagaaggtgaaagaggagcaaaggcacatcttacatggcagcaggcaagagaacgtgtgcagggaactgccctttataaaaactatcagatcttgtgagacttattcactgtcatgagaatagcatgggaaaaacccattcccatgattcagttacctcccaccaggtccctcccacaacatatggggattatgggagctacaattcaagttgagacttgggtggggacacagccaaaccatatcagtcatgttgagttagattgctgtgggtcattatgaagagaaacctgggaagaaattgggtacagagcttggcggctatggcagcatttgatttgttattcacgtttgacctcctgaaactctctatccttttacttccatgacagttaaccattctggttctccctcagatctcttggtcctctccagttcagctgttgctcctttaaatgttgccatttcctatagttgtttttctgtatccatccattctcatggtttcacacttgaaagtatatctcttgtaatatgtagtttccttacccttttctgtgttttgaactgcttctagaatgtttagctccctaatcctaaaatccgagatctataatgcttccaaatgcaaaaattttttagcactggcataatgccacaagtggagaattccatacctgacctcatgtgatgggttgtagtcagaacttcatttcatgcacaaaattattaaaaatgtacaaagttacctacaggctacaggtataaggggtatatgaaacgtacatgaatttcttgttgagatttggtttccattcccaagatacctcatttcgtatgtgcaaatattctaaaatccaaaaaaaattgaaatccagaacccttctcattgcaagcattttggataaaggatactcaaccggtgcattgccaattctgctctttttacaagtcttggtaatttcagtatggcttcagatgatgctttcagcacttggcttcttgacttgttaagttcctctccttcagtgaccttgttctttaccgtacctcagccattctctccggtgttcattccttagactttgtcattgcaaggaactgcagtcctccgcaatcctgattgcaagactttctctttctaccaccttctttcctaataagtacccttagattccccagttaagccctacagtctgttgttcgtcgtgcactcactttcttccttaactagttgaaatttcatagtcactcatcacagtccctttttaatacccttcactccactgcttctttccttctttattttgcttgtttgcacaatcccaacttaagattcagttctgccttctctctttctagagaagcaatttctactgtattcatgggatcacttcaaatacatgaccactgtccaacaataggcggccattcatggtagccactgatcatactgtgttttctttttctttttcttttctttgagatagagtctcgctctgtcacccaggctggagggcagtggcaccatctctgctcaccgcaacctccgcctcctgggttcaagcaattcttatgccttagcctcctgagtagctgggactacaagtgtgtgccactatacctgactaatttttgtatttttagtagacggagtttcagtttcaccttgaactcctgaactcaagagatccacctgcctcggcctcccaaagtgctgggattacaggcgcgagtcaccctgcccggcccatgctatgtttccttagttgctgtatactcccagttgaatattttatattttcctctctctcttaagctctgacactgccttcctttcctgatgactttgtgtcctattttgttgtgaaaatagaagctgtaacaagagctgtttcccgctctagacacccacctccaccctcagtgcccagacaccctgcctttcctccctgcctgtgggagctgcctgtgttcctgatggaggccaactcctctgttcaggtgtttccatttcctcttcccatcttctctccactgctccaggatattactcaagcaactctactttttctttcttgttaacattagttttggctcccggcagcaagtgaaatgctcttatttcattcatcttaaaaaaacaaaagccactacagccaccatcaccaatgaaaccacccttccctttcatttactgcccattttttaactcctataaacataacaattcttcaaaaagctatcatatttatggtctcacatttctttcctggccaggtgcggtggctcatgcctgtaatcccagcactttgggaagccgaggtgggtggatcacctgaggtcaggagtgcaagagcagcctgaccgatatggttaaaccccatctctactaaaaatacaaaaattagccgggtgtggtggcgggcgcttgtagtcccagctactcaggaggctgagacaggagaattttttgaacctgggaggcggaggttgcagtgagctgagatggcaccaccgcactccagcctgggcgacagagcgagactccatctcaaaaaaaaaaaaaattttttttttcctatttcttccctcttctcttttgagctgtctactgaggcctttgccctttctctccactgcagtttttgttgaagccatcagtggtctccctgttgctgtgcctggtggtcgattcccagtgctcatggtctttccctcgcagcatccctgacattgcccatcactctctcctccatcatacacttgcttcaaggacatcacactccctctcgcatcactggcttcttcactttttgtacttctttgccagttcttcatttcccagacccctggatgttggagttcagcccttagatgttttcgctcttcactcacacttttttatgaccttgtccagtcttacgactttatgtgccatccgtatgttgataacttgcaaatttattatctctacctggatcttgtccctgacctccagcttcttatatccagctgcctactcagtattgcttctggggtgtctaaaaggcatttcaaacagtgtcgatgtggtgaatggtgattgttttttgaaagttttccaataagtcttgggagtgggagtgggggtagttacattcctctaacatgttatataggtaaatgaattcattcctaccatataaatactaatatgtaaatctttattttttcttaaaagtcatacatgcttattttaagtccaaaattttctaaagctccttggttaacttggaaaataatttttttgttgtgttcatatcctttagtctaaaagatgaagctgctttttaaaaacaattacagaccccccgccctttaatggtttatttcctcatttctaaacagagaaacatctattctggtttgctgttaccagtagatactgtttggggttccttaatttcctgccattttccaccgtctgtgtcttacagttagtctcatgtggagcaaaatctgctggcagaaggtgaatgtactttgagatctgtgattttggggcttcgaaagcattatttagtgaaaagtgtgaatgagataggctcttctcttgtctactctcctgattcctaggtagaatcaggaatcagggaattataagaaatttgttccttgtctattagattatgaattccatgagggtaggaacactgtcttacttagtgttacttggtatcacaataccacatgtaatgctttatacatggtggacatttaacagatttgtactggattaaacgaaattgaattgttgctcaaaagtgactgaactgtgattagattcaatcaagcaactgtcagtcaactatccttttcttctgcaccacaccgctatactgtgagctctagtgtcttcattctgcttcaagaaaaataaacctaacttgttgtggagtttgtgggtattataaatggatttctgatgcagtttgtacaaggttcgtattgggtaccttctttttttttgagatggagttttgctcctgtcacccagtgtgcagtgcaatggcacgatctcggttcactgcaacctctgcctcccaggtttgagtgattcttctgcctcagcctcccaggtagctgggattacaggcatacaccgccacgcccggctaatttttgtatttttgttagagatggggtttcaccatattggccaggctggtcttgaactcctgacctcaggtgatctgcctgcctctgcctcccaaagtgctgggattacaggcatgaaccaccacacctggccctcatattggataccttcttatagcaatttctcagttgattgtatatgtctaatgtaaacatactttgtcttctttacaagtatctgtttttgctattttttttttatttcctgtgttgggagggcagctgggtagcattttgaagtagatgatatttaataaactgcacagtggaggctgggcttgcatttgatctgtgtagatataaatcaagagcttttacttatttgtggcgttattttagatcagatttggttgcatgtaacagaaaaagtcaaaacaaaatggcttaaacggggttaaagtttatttttttctcttgtttgggaagcccagaggttgccagatcacagctgatataatcctgctctctcgagcatagtttacttttatcagtcacctgaggcacgagacagcatatagcactgttccatttatcacatagcactgtctgtggttgtagggacattttccagtggttgcatagactacttttgctcacagaccattggctggaatggagttatgtggttatacctagttgcaagggaggcttctaaatcctaaggttgggaaattgctgtcttttgttttcagaggtccatgagttgttttagtactttactattactgagaaccaatgggagaatggctaatggagggtggggcggagctcagctagccattactactttgattatcaatggttagatggatgtgtgcttcatttttttctccctcaatttaccaaagggttactttgaatttttcttagctaagagacaccatttaagaccacagatttgaaaataatgtctgataagggacttgtttctagaatatataaagaaccattgtaactcaataatatatagacaaataacaatgaaatggtcaaaagacctgaatttagacatttctccaaagaaaatatgcaagtggttggctgggtgcagtggcccatgcctataatcccagcactttgggaggccgaggtgggcggatcacctgaggtcaggagttcgaaactagcctggccaacctggtgaaaccccatctctactaaaaatgcaaaaattaactgggtgtggtggtgggtgcctataatcccagctactcgggaggctgaggcaggagaatcacttgaacccgggagacggaggttgcagtgagctgagatcacgccattggactccagcctgagcaacagagcgagactccatcacaaaaaaaacaacaaaaaaaaccacaagtggccaataaacacatgaaaaaatgcttaatattgttagctgttagggaaatgcagatcaaaaccacaatgagataccactttatatctactaggatggctataaataaaaagtcagataataacaagtactggcaagaatgtagagaaattgaaaatcctcatacactgagagtgagaatttaaatggaatgctgctttggaaaacagtttgtcagttcttcagaaaacgaaacataacattgccctctgacccagaaattctgctcctagctatacattcaagagaaatgaaagcatatgtttacacagaaacttgtgaatgagtgttcatagaagcattatttataatagccaaaaaatagaaacaacctaaatgtctgttaagagatgaatggataaataaaaggtggtatagccatatgatgaaaaatgaatacatgctactgtatgaatgacacttgagaacataatgctaagtgaaagaagccagtcataaaaggccatgtatatatgattccatttatatgaaatgtgcaggacagacacatctatatagatagagagtaaatgaatgattttctaggtctagaggtttggaaagaaatggggagtgatggctaatgggtacaggttttctttttactccctagggtgataaaaatgttctaaaattgattttggtgatggttatgcaattctgtggatatgttacaagctgttgaactgtacattgtcagtgggtaagttttatggtgtgacttacatctcaatagagctattttaaacaatggaacacagctgcaaatgaatacctaccatagctaaaagaagggtcttaaatcactataaactatcactacatgacgtcagccacatttcagagaccatgggctatgaaatgattaggtctctcatttttttaggttggagacattgtattttgtatggatgttttctccatggcaagttgtagtctgtcaggaggtgtagctttcttccctgaagggtggaatatcacccttcccccgccccaacaattgtgttatataacatgctgttagcttcgctggcatgcttgccacatgccactttgtgctgtgacccccccacacatttgcttgataaataattacccgttctgtgaaagttctcccacacatcacattcaggcactgcttaaagaaaatgcttcccgttttgctctcattaatctgacatttcgaatattatatttggtttcattttgcctggttcccatatcactcttgaaaggatggcaagatgcttctgacttgtagaattcacttatttatatttttatgttgaggaagagaggaggaaatcacctatgtatctgaagcactggcgttttacagtgattttataccagcaactttatttagtatctgtttgcatgatgctgtaccgtttctcaatttaaaagagtgagttaagagcatgttgccttcagaagcccatgcaatttgactgaatatgagaatgtttgtataacacattaactgtactaatatttgtaagcattttatagagcctcacatccaggcacctagacaattgttgactgtttttggcactgaggatacagcaataaactagaaattaaaagacttgaaattgagggaactcacagaccaggaggatttagaagcaagtaacagttcagaggtctaaggtgctgtgggagttgagcagcatgggggagtgtggggttggctgggagtgtggggttggctggaagagcttactaaagaaagtgatttttaaaattgactcttgaagatgaggtaaccagtttggagactcagaggaaggggggcccaaggcaaaaaggaatcacaggaagtatggagaacacatgttgagataatcctttaaatcagaggttctcaactgtgggcgatgttgctcctaggggacactgggcaatatctggagacactgatataatgtattttaactgtgtgtttgggggctgggggttagaagagggcagggagttgctacagacatctagagggtagagggcagctgtgctgctgaacaccctccagggcacagggcaggcttctgcaacaaaacatcatctgctccaaaatgtcaggagtgccactgttgagaagtcctgatttaatgcatgtgataagatagagacccctacaaatacttgtggaattgaatggaagtaaatttttttttttttgagacggagtcttgccctgtcccccaggctggagcgcagtggcgtgatcttggctcactgcaacctctgcctcctgggttctagcgattctcctgcctcagcctcctgagtagctgggattacaggtgtgagccaccatgcccagctaatttttgtatttttagtagagacgggtttcaccttgttggtcaggctggtcttaaactcctgacctcaggtgatccacctgcctcagcctcccaaagtgctgggattacagacgtgagccactgctcccggcaggaagtaaactttttaaatgtaaatttttttttatgtaagtggaattatacctttttattgaaatatatatatttcaatatatatattattattctctctatatataatactattctatatatatagaaatacatatttcaataaaaaggtataataagaatatatatatttcagtaaatatatatcacatgtatttcacatatttcatatgtatttcatatatatttatatatttatataatctatatatagaactatatatatatatttcaataaaaagtaaccatagtttaatttggttatagtataagcaatgaagtaaagccagatggaaagggctttgtgtcttgactcttccatgtgatttgttcaatgatgatcagttactcgggaactaccaagataccagtgtagaaagaagagcaaagtaagttattttaacagaattttagtggaactgatagaacatggagtgggtagaattagaaacagcatttctagtatataggtctctgtgtttttcatagaatgtaagaattttccctaaagatgatactgttgatggtgatgtattgaaagacacattttatatgggctgtgatatttaaatggaaatctgaattgacattaatatggatttatttttaaattgtatgctgaaggatactggagcatgggccatagaaaaatttttagcttttctgaaaataaagccagaataaaaagttttctacaagagtttttgtggagatatgtttttattaatcttgcataaatactttgggtgtgggaattgctggggtatggtatatgtatgtttgacttctcaggcaattaaggttacaaagtaattttaccctcccatcagcagtgtatgagagttctatttgctccacttccttactaacctttggttatgttactctttttcattttagccaattttgactagagatgttgagcacttcttcctgtgcttattggccatttatgtttcttctgtcatgaagtgtctattaaaatctcctgcccatttaaaaattgtgttgttgatctttttgttactcaattgtaggaattatttagaaacaaatcatttaccggatataataatagtgaatattttctctgatctgtggcttgcctatctttttcttcagtgtcttttgatgagaagaacattttaacttgaggttgaatttatcagtttaaaaacattttattaagggcttcttgcaccaagaaatattttttttactctatggttttgaagaaattttctgatgttttcttttaaagctttataattagtccatgactcatgaagatttttggggtatatatggtgtgagacatgagggttgaggtttgtttattttttccccaggtgaatagccagtatttccatcaccatttattgatagacttgcctctcatttaattgttttggcaccttctaaaaaatcacttgactgtgcatctgtaggtctatttctagattctctactctgttgcatctctttgtctgttcttttgccagtaacacacttaccttgattactgtgtcattagtcaggtggtacaagtcctctgttctttttaaaacaattttggctattgtaggtccttggtgtttccatataaattttagaattaatttatttttataagaaaacccccaaaacccataggtcaatattgtgaatatagaaccttacagttcatgaacttgattttccatttatttagactttccatttatcccagtaatgttttacagttttcagcatagaagtcatgggcattttttttttggtgttaaattttcctaaatattttatgtttctgcatgataatttaaaatatttgttttacctttaatttccaactggtcactattagcatgtagaaacatacttggtttttgtatcttacaatattgctaagtgcacttattctgttagttctggcagtttctttaggatttttaaatgtacacagtgattttatatgtgacaaaaacagccttagggccaggcatggtggttgacacctgtaatcccagcactttagaaagctgaggcaggaagatcacttgagctcagggttagagaccagcctaggcaatgtaatgagataatgagaccctgtctcaaaaaaaaaaaaaaaaaaaaaaattagccaggtatggtggtatgtgcctgtagtcccagctactcaggaggctgaggtgggaagacagtttgagcccaggaggttcaaagctgcagtgagccataatcgtgtcactgtactacagcctgggcaacagagagagaccctgtctcaaaaaaaaaaaaaagacagctttatttcttcctttccaatctgtatgctttttatttcttttacttgcctgcctacactgcctgagattgcctgtaaaacgtttggcagaagtggtgttattggccatcttgccttgttcctgatcttagtaggaaaagtgttcattatttaaagtgtaatattagctgaaaattgcttgtagatgcccttttcattttgaggaagtttttattcccagttttaagcatgaattggttggaattttgacaaaatgtttctcagtgtctcttgaaatgatcattaaatatgtttctttaatctttggatgtgaattacactgaattttgtaagttaacctcacatttctgagattaaactctacttggtcatgatgtactagctttttgtacctgcttcatccattttgctagtattcggttaaggatttttaaatttatgttcatgagagatgtgtgcgttatgatcttcattttttatgtccttctctggttttggtaccaaggttaagatggctacagaagaattgggaagttttcccttcttcactgttttttcataaatgtgtgtgtcatattggtattaagtgtttgaggtaattcacctatgaagtcatctttgcctagagttttcttggtgagaagtttaaaaattttaaattcattttatttagaggatataatgatattcagattttctatttttcttgggttttgataaattgtggttttcaaggaatttattttctctaaattgttgactttattggcataaatgtcatatctacttgttcctttcatatctataggatttataatggtaacttatgcttggtagggatttttgtttcatattttcttgataagtcttgcctagaggtttatcaattttgttaatattttcagagaatccatattaaccactttttatttcatttgtttctgaatttattttttttcaactttggatttaatttttcttttcattccctaagttagaagcacagatcattaattttacaccttgtttttgagatgggcatttgaatctataagttttctcctaaggactgtttcagctgtttttattataattcagttaaaaattatttatttccttatgtgattaggctatagatcgaaaacgtgatatttagaagtattttttaaaaattccaaatggctggagatattccacatgtaatattattgctttttttctacttaagtattcttttggtcagagaaaacagtttatagtctatcaatatgtattgaatatcgaaaggatttttttgcatatgtgcataatgacccttttatgaaatatctctgtgctaataattatcttaaactctacctctaacagtaatatagctacacttgctttcttatactgttcgtacagcatgtcttttttcacccttttccttttatctgattctttatgtttaaacttttttttataaacagcatatacttgagttctgtttttaaaaaaatatgctagccattgctttttaagcagagttttagtttatatataataattattattttattattattactatttttttgtagagatggggttttgctatgttgcccaggctggtcttgaactcctgacttcaagccatcttccttccttggcttcctaaagtgctgtgattacaggcatgagccactatgcccagctgatccatatataatgtttgatacgtatgggcttaaatctgccatcttgattttgatttctagtttccatgtttgcttttcttagttttttttgctgttgccttttctaatgatttttagttatgccttttaatgtattttttagatagtgtctcagagtataacatgcattttaaaataatcataatatctgccttctcaaaaataaagacccttagaacagtggatgacttccaatcatcctttcgctctctgtgctcttgttactatatattctaattctacatacactatgaatgtgggaattacatagcatttgaactacatatgttatgaagtaattatacatgactacttttattttatgaaatcagtaatcagtggtcttttaaagaaatttactgtttatttacatacaggtatatgcatacatgtgggtgtaactttttttggctatatgtgtatatttatttatttttttgagacagagtctcgctctgttgcccaggcagcgtgttctcagctcactgctagctctgcctcctgggttcacgccattctcctgcctcagcctcccgagaagctgggactacaggcgcctgccaccacgcctggctaattttttgtatttttagtagagatggggtttcaccatgttatctagaatgggccatattttttttaacactaacgtatttgtcctttatggttttctttattcttttctgcaaaactgggtttttatcttgttccatttcttttaagttccttaggctgccttaggctgcatttcttgtaatgcaggtctgctagagaagatttctttcctattttgtctgtctgaaaatgtcttttatattgccttcatttttgatggatatagaattgttttcatagatttccccttatacatcttaaagaagtcatttcattgtcttcaggcttccgtttattttctgatgataagtcatccatttttcttatcagtctctcctctctcctctgttgtctttctctcttgctgctttccttatttctttttaaataatttttatgatttttttttttgccttgcccagggttccattgaggttcttggatgtgtaggtttgatatttcttactgcccggtttagaaaatcttagtcattatctcttcaaatgtgtcttctactccattttctgtttattttttgggattcgaattaccttatgtcagagcatttgatactgcccctggagatttcagattctctgtttcacttttcccacctgatttccatttgtgtgtgtttggatcatttctgtccatcttcaaaaccattcagtaggaagtttcaaaccttcccacatcttcctgtcttcttctgacccctccaaactgtttcagcctctgcctaggttatctttagagagaaagagagatggggtggggtgggatgggttgaggaactgccaaacacttttaaaccaccagatcttgtgagaactcaatcactatcaggagagcagcacgggggaaccactcctgtgatccatcaccttataccttacaccagatccctttctcgacatgtggggattacaattcgagaaaccctccaggcaggccatgccatctctgagtaggacacagagtaggtggattaggacacagagtagcccattggatccacctcagggtggtctctcagtcctgctctcagacttcctcatgagcgcttgaggtcccacggacaagagttggagggcgggttcagactctctgtgtctaggtctcctaggaattctaaacatcacaccagcctgtgttctacctttaaaattttgttaaaattccactgttttctttgtctgtgatggtttcctctttgtcttgctgctccaccatggatgaaagcagctggggtgtgtgtgtgtgtgcatgcgtgtgtgtgtgtgtgtctgtgtctgtgtctgtgtgtctttgtcttctgtccagggagtggcttgtcactctttggattttcattcattaggtcttttttacatctttgctcttaaatgagtttttgaaaaacaatggtttcataggttctccgtcttgttcttattggtagagtgggaatgatgttctctgataattttttacattccaggtggaagcaacagttctctaatgattaattgcttgaattcactttcattggaacatacaatcttctgactgtcattgctcgtgtgctctattagaaacttttttttttggtgaacagaagaaagaagttactataaagacttgaccttgagtaaaattaggcaacatgcttttatcatctctggaaaaaatgcatgattcatagatttatactttgtttttttcccagaaactctatgagaaactgattacatttctataactttaaaaactttttttggcttcagcagtttccccttctcataataaaatgtagggcagaacttgttacgtgctgggtttttttttttttttccttttcaacattcctcttagaaaagcaatagaatattcctgattgttaccattataagttttgatatctgcttctttgtttattcacttaagagctactctgtttacaataatgtctccttagacttgtgaatgtttctctctgcttttttcgttgtgtattttctgaatttataagctcagtaatctgtcacttaaaacacaagggtaaagcctgtcttctacatggtttgatagagctatagaacatgcagttgaaagagacttaatagatacagagtgaaatgtagaatacagataataggcagtttcttatgcttgggctgagggtggtgcctgattggtgataccatgtatttgtatttgtattttttttctgaatgaatgaatgaaagaggttgagatgctgatttatgaatttaagaattcttttaaaaagaatttatgaatttaagaacttgtttaatattgtttcttcagattccaattcccaaacttaggtactacagataataattagggttttagataaagattatcctggcagcttgccctttttcacttggtttatttttttcgttcatgaaatttatacttttgcctgtgtattcaccaggaatcagttctgacttgctgtatgtgatgagttatccagagcttaaaatggtatctggaacttagtaggtactcagattgtagtgtggtttaagtgaattattaggtgagtgagaaaatggcagtgttctcagctgaaccagtagaatgcattgcagcaatatggctccaagaacccccagtcggaactttctcagttctaattcttgctctaatggagtcactagtgttagcttctccatgaaacaaagatgtgattgctattttttccctccttcctccctttccacccttctctgtctataaataaattcaacaacaacaacaacaacaacaacacgccttgagacaggttcttgttattttgcccaggctggtctcaaactcctgggttcaagcaatcctcctgcctcagcttcccaaagtttattttttatttaaatgcgaataatccaatatactttgcaaagttttctgttctttactattctgagattcaccatatttcctttacatccattaaattttattaataaaatatgtcctttgtttcaaaaactacagaatttttatattttggtttaacagtgtgttgctattgattttggcagtttgaaatgtgtccaatgtttctcaaagtctcattctttcttagtgatgtcctaagcaattgattattagaaaagaaaaacttgagaaatttgaaatggttgaaacatgttctagcaaacgttttatttttcctacactaatactttagaggcagggaatcagtaaatagaaaatgaatatgagcagtctttgtgagagggtgggaacccagccttatttaatactagtggctgatccctttaatgttaaagtaatgcgttgcaagtgtgaagtgttctgaagaatgtagactgtgatgagttaattctcaatagtggaactgttttgagttatcattacattatttgccaaaatataaacaaatggaattctttccttgtgaatgatccatttctacttaatctctcatctttcaacaaatttgttctctgctggcttccacaaagggctgtgtggctcaagtttgagtcgttgtgcttggaggcaagacatataatactactttactttttacgcttctttggatttttatccagaaataatatggctgtttaatctgaagcctgataattgctttttcccttacttcagtatttgtacttctagtcataactctttaagcccttcatcattcaacagttatttctgtgttttaggttactagaatcagtcattcttcctgtccagcatctgtatttgctgctctatgtgtaactggtgaagaatatacaaccatctatcttgagttaatattatttttcctccacatatgagcatcagtggaaaactttaggggaaaacaaaaaggaactagagaggacaaggaatttccttaggctcatggccgactttgagagtgtaagtatatgtaagtatattaggtccttacttgctgcagtggttcgtgattgtcactgaattcctttactagttactgatggtatattgtagttgatctgtcttctatttgttattcttggagcaacagctttcatactcatcattttgttgcccatgacatgtagaagcacttctggaatatttcccaagcccattcattgtttcttttttcatttttgccattttgtatcatccttttagtcttctaatatgtttttgcattcaactcttgcctatcttcagtccattctccacccagcaaccagactgttcatgtgcaattttaacctgatctggctgttcccctactaaaaacctttagtggcacttaggataaattaaatccttagcatggtgtattaattcattctcacactgctgcaaagaactgcctgagattggataatttataaagaaaagaggttgaggccgggcgcagtggctcatgcctgtaatcccagcactttaggaggccgaggtgggccgatcaccttgtcaggagtgacctggtcaggagtttgagaccagcctggccaacatggagaagccctgtctctactaaaaatagaaaaattagctgggtgtagtggctgtgcacctgtagtcccagttacccagaggctgaggtaggagaattgcttgaacctgggaggtggaggttgcagtaagccgagactgcaccactgcactccagtctgggagacagagcgaaactccatctcaaaaataaagaaggggaggggaagggaggtttaattgacttagttttgtaggctgtacaggaacaggaggcatgggtggggaggcctcaggaaacttataatcatggcagaaggcaaaggggaagccagtatgtcttacatggccagatcagggggaagagagagagaagtgggaggggagggcgggggtgtgtggggcaggctatatactttccaaaaaccagatcctgtgagaactctcatggaagcaaaagcaagaagggggaagtctacccctatgatcaagtcacctcccaccaggccccttctccaactttgggaattgtaaatgctacatgagatttgggtggggacccagagccaaaccatcccacatggccagggaggccctgtgtggctggaccccagtctgcctccacagctttctgttgtgccactctccagcaggctcatggcgccagtgaggaggctgatcttagctcctccagagtgtgcttttggtcttctatgcaccttctcagcttaggggacaactctgcattcaaaaaaaacttttctgagagactactttttaaagaatagttttcagttcacagtcagaagaggaagatagagattttcctgattccccccaactcccacacatgcatagcattccccattatcaacacccccaccagaatgctgcatttgttagaactgtggaacctaccttgacatatcataatcacccaaaattcatagtttacattagggctcactcttggattgtacattttatgggtttgcccaaatgtgtactgaatgtatccatcattctagtatcatacagaagatttcactgccctaaaaatcttgtgctccacctgttcatccctttccctccagtccctggcaaccagtgatctttttactgtctctgtagtttgaccttttccagagtgtcatctacttgaatcacacagtgtgtagacttttcagataggcttctttcactgagtagcatacatttaagctccctccatgtcttctcatggctcagtagctcatttctttttagcaccgaataatactccattgtcaggatgtactacagtttattcattcaccttctgaggacatcttggctgcttcaaagttttggtggttgtgagtcaaacataatttggtagttgtgaataaacatccatgtgcaggttcttgtgtagacatagttttcagttcctttaggtaactgccaaggaatgtgattgctgtgtcctacagtaaaaatgtttttacttttgtaagaaacaaccagactttgaaagtgtaccattttgcattgccaccagcaatgaataagagttcctgttgctccacatcctcttcaacatttggtgttgtcagtgttttgggttttggctgttctagtgagtgtgttgtatttcattttaatttgcattgccttgatgacatctgatagggtgcatcttttctttctttctttctttattttattattattatactttaagttttagggtacatgtgcacaatgtgcaggttagttacatatgtatacacgtgccatgctggtgtgctgcatccattaactcgtcatttagcattaggtatatctcctaatgctatccctcccccgtccccccaccccacaacaatccccagagtatgatgttccccttcctgtgtccatgtgttctcattgttcagttcccacctatgagtgagaacatgcagtgtttggttttttgtccttgtgatagtttactgataatgatgatttccaatttcatccatgtccctacaaggacatgagctcatcattttttatggctgcatagtattccatgatgtatatgtgccaccttttcttaatccagtctatcgttgttggacatttgggttggttccaagtctttgctattgtgaatagtgccacaataaacatacgtgtgcatgtgtctttatagcaacatgatttatagtcctttgggtatatacccagtaatgggattgctgggtcaaatagtatttctagttctagatccctgaggaatcgccacactgacttccacaatggttgaactagtttacagtcccaccaacagtgtaaaagtgttcctatttctccacatcctctccagcatctgttgtttcctgactttttaatgatcgccattctaactggtgtgagatggtatctcattgtggatttgatttgcatttctctgatggccagtgatggtgagcattttttcatgtgttttttggctgcataaatgtcttcttttgagaagtgtctgttcatatcctttgcccactttttgatggggttgtttgtttttttcttgtaaatttatttgagttcattgtagattctggatattagctctttgtcagatgagtaggttgcgaaaattttctcccattttgtaggttgcctgatcactctgatggtagtttcttttgctgtgcagaagctcttcagtttaattagatcccatttgtcaattttggcttttgttgccattgcttttggtgttttagacatgaagtccttgcccatgcctatgtcctgaatggtaatgcctaggttttcttctagggtttttatggttttaggtctaacatttaagtctttaatccatcttgaattaatttttgtataaggtgtaaggaagggatccagtttcagctttctacatatggccagccagttttcacagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggcgatgtgggctcttttttggttccatatgagctttaaagtagttttttccagttctgtgaagaaagtcattggtagcttgatggggatggcattgaatctataaattaccttgggcagtatggccattttcacgatattgattcttcctatccatgagcatggaatgttcttccatttgtttgtattctcttttctttcattgagcagtggtttgtagttctccttgaagaggtccttcacgttccttgtaagttggatttctaggtattttattctctttgaagcaattgtgaatgggaattcactcatgatttggctctctttgtctattatttgtgtataagaatgcttgtgatttttgtacattgattttgtatcctgagactttgctgaaggtgcatcttttcttaacgctcctctgccatttgtatattcatatgtatattccatatgaaccattaattccatttcttgatatatacctgaaagaattgaaagcaggggcctaaacaggtatttgtacatccatgttcatagcagcactgttcacaacaggcaaaaaggtggaagcaacccaagtgtctgcggatattgtgaatggataagaaaaatgtggtatatacacacacaatggaatattaggcttttatgtagcaattgaaagttattgttcaacaggtacagagtttcagttttgcaagatgaaaaaagttctgttaatggatggtggtgatggttatgtaacattgtgaacatatttaatgccattgaactctacacttaaaaatcgttaagatgataaattttaggttacatgtattttaccacagataaaagtaaaaaaaaaatggttacaacagttaaatcttaggaaaaacttgccttttagtggccaaggggtaacctgatatgttactggtgtctttcaggcctggcgtttccttgaccatgcaggcattttccgaagaggaaaggaagcagtggttggaagctctgggtggaaaggaagctgtaagaataatcaatggttgagttttatttcaaagcctttagagttgacttgcattcatttttatgttatttttgtgtagtatttgagaaaagttcccttctataacaggtattccaaaaatcatcgtggaagcattcaacattctagtaatttgggttgggcaagcagcagtacatataagactagtgtatcattagtttttatttctgtattttcttgacttgccactctgatttgctttgcttgaggaggtcatctaaattctcaatttcatctttcctacttgacagtactttggatgatgaacacaataaatgcctgcaatgcattttgatctcagtggagatggaacaggaaatgtgagatagtgcaggcaatattataggtgactgctgtaattgttttgcttgatgtaacaatttaaagtttcatctagtagtttacagtatgcagtattatgtagccttagtggatgggcctcggtattcagagtgctttgaggaataaattgaaggtagtggtatagatccagaggcaccaagattcagtctgttggccactattgaaacactactttcattttgatggactagtggcttttgagagttgagaatgtggcagatcatgtattggggatttagtgaggataattgtagaaaacgccacagaaccaatttaaataaactctacttaaagtattatgtatgactctaaataaactgccattgcaggtgccaggcaggcttatctggaaagcatttgccagttcagcattgttgagggaaaaaaaaagagaatggtttgaaagtagaggagggatcatgtagagcagaaacaggtttcagaatagagcttatgaaatgggcaaaagctaatgttatcttgtggtaacagagagcgcattggtgagtgtataggaaaagagagcaaggaggctgatcagtagcgcatgtggcaatcttgaagtacttggaaaatgaaaacctaaattaacatagtataaaaattgatgctatattggggaatgtatcactcttacaccacccccgccaaaaacaaagcatccttggtcagatttgggtgtcgtcttaccatatttgggatgcatttagcctctgtagttttacttctattgattgatcgatggaatctcactctgttgcccagtctgcagtgcagtggcgtgaccttggctcactgcaacctctgcctcctgggtttaagtgattctcctgcttcagcctcccaagtagctgggattacaggtgtgtgtcaccatgcccagctaatttttgtaatttttagtagagacagggtttcaccatgttggccaggttgttcttgaactcctgacctcaaacgatccacccaccttggcctcccaaagtgctgggattacaggcatgagccaccacacccagccttatttctatttattcttaatttgttgttgaaatttttagctgtgaatcaagagtatttacagtgtttatggttactgagactccaaaacaggttatactagtcttctttagtaaagacagcacactcactggaatgtatcgccccagagatgcaggaagtatattggatttgcatccattaaaatacagaaaaaaaataatggtactttggaaagtcagtttgcgtagcgaaaagactaagtcattgaaaaatgagtctgttggcaatgtcagtgtaaccttcaagacgtatataacctctcttttagagtcaggagccaagtgattagttcagagatacacagacaaaggcaagtctgcagaaaaacaatattcagctatgtatttatatggggacactgaagggactgcatatttttggtgggtgttgtaagccttgcaaataatttgccagccttacagttcttaaaggttgcctagaattatcaccgtgctatttctgctgtacttacttaaattatgggcaggagttatctctttaggtaaatactgattttttgaaatattggtgaaaacatgagctccatcttaatggttagaatacagcagtttccttatcactccatagctgtacggctgagtatttcaagtatacacaaattttcaataagtcccttttaaggaccctgccccctttatcttatttttgctcatttggtatacctcagggagagaaaaagtagtctcagagatgttcctttttgttatttatctttgcatctgagcatatgatagtgtgttattaactgagaaaacacagcgcactatctgcctgaagttagtgttggatcccacatgtttagagctcactcccacaagactgcctgagttcaggtgcccatcacaagtctggaccctcccatacttctggctaactggctataaattgggggttcctgtgaacccctcatcagtttaataatttgccagattagctcacagaactgagagaaatacttatatttagtagtacattataaaagttacaactctgcaagggcccagtggaagagatgcataggataaagtctgaagtgaggttgaggtgggtgcacggagcccccatgccctcagtgggtacaccagcctcccagcacttcctcatgttcaccaacacggaagcttatcagagcttgttgtttcagaactcaattgccagctcactgctgaagagattggtgggtagggctgaaagaaatatcagtgggtctttgtggtattcagccccatcctgagatggcctatccaggggctctataagaagtcacctcattagcataaactcacatgtgaccaaaaggatcttgttatgaataacaaaagatgttcttattactcaggaaatcccaagagtttagatgctctgtgtcaggaagtggggatgcagaccaatttcttattctatcacattaaccagaatcaagcttataaaaatgtatttttttttgtatggtcctcagtgtgcctacttgaataatttttgctgatttgattaaaaaattctgtttttccattctcttttattagctgtcccatagttttaatacagccatcatcccaagaccagaaggaagtaagtgctcatttataaaaatgattgtatcctccttttccatctattactttgtgtacattatgcatgtcaagctgttgctgggagcttactctctgcaccctctattagacagaggggtattacacgtaataatcctctattgcatgtgttctgttttactcaacggggacctcctcaacatttcttggactactgtagcccttgttgatctttcccatctgtgggcttttcttttctttttttttgatacaaagtcttgctctgttgcccaggctgcagtgcagtggcatggtcttggatccctgcagcttcaacctcctgggctcaagtgatcctcccacttcagtctcctgagtagctgggactacaggcatgtaccaccatacctggccaattgtttttatttttaatttttttgttgttgttgagatgggatcttgctatgttgtccaggctggtctcaaactcctggggtcaagtgatcctcctacctctgccttccaaagtgctgagattacaggcgtgagtcaccttgcctggcctatgggcttttttgtgagtctttctcaaaaaaaaaaaaattgtacaaaatactttctctacatttactttaatgtttattaacaatcacataagagtttcaagtatgcaaccttcaacttcttgtctgagttaactcctgtgggtaagagctgtttatatcgaggccctgtttcctagccttgatatgctttatctttgtagtgtttgactacaggctatacagatagtttatcagtgcaccttggacaatagcaacaacaattaaatttattcaaatattcaaggacaacgatcttcacatgccactgctgtacttgaagaaaatgaaacatgcccagctctgtacccttgatttttttttttaacttacataaaaacgtgatcagatctgctgggttcctgatgaatttacttttgacatatttggaaaaattaagctacatttatcaaatgtccacagtttgtaaacactgtggttatgtaacataggattccaatataattgtgatcacttgagccagtgtttgaataaaacacaactcttgtagcctggcactggtgatggacaggatgccacaagcagcacatcccctgaggcaccttcttacccctcttccttcttcccttctccctctctcctttgttcttttcttcttctgacaccttttcttccttcctccctcctcctcttcctcccttttctttccctttcctcattccctcctctcccctttctctttccttcttttctctttttcccttcttattgcagagacgttaaaacatgtcttttttagaaaacacggttttgctaagcagaaataaatacttccattttataaagctttgtgaatagtgaattcttgagcagaaaaccactgcccaattcattaaaattctcttcaagcttagcactatgggttatgtatgaagtttatattcatggattgttcttgtaacccttctgagagccaaggattagtgttactgttccctaggttctaaatgcagtggctaagggtacttaacttaatttttgttgttgtcgttgttgttggagacagagtcttgctctgtcgcccaggctgcagtgcaggggcgcaatttcagctccctgcaagctccgcctcccgggttcactccgttttcctgtctcaacctcccgagtaactgggactacaggtgcccaccatcacgcccggctaatttattgtatttttagtagagacggggtttcaccgtgttagccaggatggtcttgatctcctgacttcgtgatccgcccaccttggcctcccaaagtgctgggattacaggcgtgagccaccgcgcctggcctcttaacttaatttttgaaacaagaattgtcattcattaaggatatacagatatgccagcctaatcatagataagcatctatattagaaaaagtataaaaattatatttccaaaatagtttgctctgccatatgaatcatctgttttaaatttattatgaaaataataaaatattattttaaaagcttggagcatggtgtaaaatatcaaaattttaattcaagcttattgcccaaatatttttaaaaagcttttcttaaaatttttcctcctaggttttttttttttaaaggattgtgttcttagattctcaagtaatttaagaacattcacgtgtgtgtgtgtgtgtgtgtgtgtgtgtgtgtgtgtgtgtgtgtgtatagttttctttaactgagctgctgttggaatttttggcaaaatatatcttaactgtgtctagatagcttcccttagagatttgtatcactttctttttgacttttaaaatgaattgtagttattaattttaaaattattttacattacaaatatgtatactattggtaaatagagattctgatattccagcaagtgctctaaatatatgaaattccttccaggcacagtggctcacacctgtaatcccagcactttgggatgccaaagtggtcagatcacctgaggtcaggaattcaagaccagcctggccaacatggtgaaaccccatctctactaaaaatagaaaaaattagctgggcttggtggcgggcacctgtaatggcagctacctgggaggctgaggtggaagaatcgcttgaacccaggaggtagaggttgcactctagcttgggtgacagagtaagactccctctcaaaacaaaaacaaaaaacaaacaaacaaacaaatatatatatatatatatatatatatatatatatatatatatatatatataaaattcctgtgtatattatttaaataggaaatacatagccttaagctttttttttttttttttttttttttggggagacagggtattgctctgtcacccagtgcagtggtatgatcataactcactgcagcctctacctgctgggctcaagctatccttcttcagcctcctgagcagctgggactacaggcacccatcattaaacctggctaatttaaaaacatcttcagtagaggtggggcctcaccatgttccccaggcaagtcaggaactcccagactcaagtgatcattctccctgggcctcccaaagtggtgggattacaggtgtgagccaatgtgcctatctgcctttagctttttaatagtaatctaaaaattagtttggatttaaataatttttcctatttttaaaaggaagagaaatgtgataaataataattgtacacttaatgttttaaactgtttcttgtagatgcacagttggataagatggggttcacaattatcagaaaatgcatcagtgccgttgaaacacgaggtaatatgattgaatcatttcattcatgagaggctataggtatgtaaaatctaaaagtcattaaaaatacttcttgcttttaagtgttacagaatgaaacgtgttaacacaaatgctcattctgagtatcagaaggatcagttattcatttactatgacaatgagggattttcctttttatttacatatttctttcctatatgaaaacatgaggtcagtgttgaaatgagaattgtcttagtctgttagatctgccatagcaagataccacagattgggtggcttaaagaatagaaatttattttctcgtggttctggaggctggaagttcaaaatcaaggtgtcaaattcaaggtttcttctgaggcctccccacttggcttgcaggtggcccccttcccgctttgtccttagaatgccttttttcctttgcacccatgtccctggtgtctcttttacatgtcgaagtttcttcttataagggcctattagattagggcccaccctaaaggcctctttaaagctcccatctctaaatacagtcacattctgagaaactggtgtttagggcttctacataagaattttagggggatacagttcagcccataagaatccttagaagaatcagcagtgatgtacaactcatcgtaatcacttttggttgaagcactctgaagatactctccaccctccattgttgtgtgggtccctgtttaaaaaaatcagcttgccagacgtggtggctcacgctggtaatcccagcactttgggaggctgcggtgggcagatcacctgaggctgggagttcgagaccatcctggcgaacatggtgaaaccccatctctactaaaaatacaaaaattagctgggtgtggtgcatgcatctataatcgcggctactcgggaggctgaggcaggagaatcagttgaacctgggaggcagaggttgcagtgagccgagatcgtgtcactgcactccagcctgggtgatagagcgagattgcatctcaaaaaaagaaatccgctttattgaggtataatttgcagtcagtacaattcactgatttcagctgtacaaatggaagagttttgaattgaaaacatacacaattgtgatactttattacatacacagaaaatttctgtttccctcactgagttcttttctggcacctaccttcctcctttcctgtatttgctgcgttgcatttttatttttatttttatttttttaagatagggcctcactctgtcacccaggctggagtgtggtggtggagccatagctcactgcagcctcaaattcctgggctcaagtgatcctcctgcctgggcctcccaaaatactggaattatagacatgagccaccatgcttgtccctgagctattttttaattacgcatgttctgcgctcccccccccccctttttttttttaacatcttcagcatttttgtacaaatggaatcatgcagttcatagtcttttgactctggctttgtctgtgtaatgcttttgagattcatcggttgggtggatacttagctctgtaaatttctgtttattgcctggtagtattccattatatggatatagaccacaatttgtttatccattcacctattgataaatatttgggttgtttgtgtttctgttttaaatttagggaaaactaattcctccgctgaccaataacccaaaacatttttttttaagtctctaagcaaaaattgggcccttttgctatgcagccattccagcagactttggagatactaaatattaaacattgcaaaacaggctatttctggaggttgacattctctttgtttagcgatctagtgaagtatgtataaatggaatatttaattcactctcatatattctgtattccagtccgactttggatgccttagtggggtgaagtactgccttcacattctctctccaaacaaggtctttgttataaagacaggactgccacctatgaaactagtgtgtaggatatcggcggagtaggagctgttgtatgatttggggatttgcccatcaataacaacaacgtatgccacagaaagccattcttcccacattctcttacagtggcaattcacactggcaggttttcattcatttcaatctgcactgaagctgagctggcaatttgtttcttatcctggtacctcgaaagaatttcagaaaaaatccctgcaattttagtatctttcacttgacactcatgtttctttttttctgagtttcttaagtagaactttgtgtcatttgcatgcttattaatttggataaattctttcccaaaagggcatgttttatacatacttatttctgcctgaatagatgcagatctatctagaaggctttctgattggtatgtgtagttttatggagtgttacatacattgaatggcataaatatatattggaatctggaggcattgaatatgtttttataagtatatagatgttgaataggtctacacattttatgttagcttttctcatttaaaaataagagacaaaaagcatatatttttctttttgaatatttttccccccaaaggtcttccattactgaaacttttgctttcagtggagtaatagactaaaaataagagtttaaaagaatcaacagaacttattattgaaaatgatgaggacagctgggggcactggctcacacctataatcccagcactttgggaggttgaggtgggaggattgcttgagcccaagagttcaagaccagtctgggcaacatagcatgaccctgtctgtataaaaatttttttaaaaaaattagctgagtgttatagtgtttgcttgtagtgacagctactcaggaggctgaggcgggaggatcactggatcccaggggtcgaggctacagtgagcttggaaaacaggtaaagagatggaaatagttggtaaatagcattaataactattgtacacttcttgagtctatgtgactgatgaccagaagcatttaatgagatctaattgaagaattacttctaatcaccgtttccatgttctaaatatgattatctaaaaactagtatttcatatggttcggttaaagccattagcctttttcttaccttttcatttcatgtctttctgtttttgatctgactgcttagaacatatttattggaacataaacataaactcaaaagactactgtgacaatacttactattttatggcatttttcttaagctatctattcagtatgtgtatgacttatgaaatgttccatattttcctcttgtaactttgtcccatgggttgcaccaaccggaaaaagtttttagctttgagcacgaagtaatttttctctaattgtttttgtggccaaaagtttatttgccttggctcagaataaactggagaactggcagtgcccagattattcacaggacaaatactcaggaagcctgaacatcattaattgcattcacaggagcaatttctgtggctctgtagcagaaacttcagtgaatggtaaagatacggggtccatcgctgatgttataaaaggaagtgattccaaaagtccacatccaggaaaatttctacatggtatagctgcgggggcatatctagagggtaaaggcacagtgtactgcctgagaggagctcttttcgcaaacctagagcctggaagccaagttctgaagacagtggaattgccccttgttagtataattaacagattgttagcaaactcccagatcccattctttgcttgcccctacatctgcctcccagtaatggtggccagaggtgaactgaggggagccaggatacagattatgtgtttgaatctctcagcgtattctctgtgattcttttagaaatgtctccaacaaacataactctggtcatcaaaaattagaaattgattgttcctgtgtcaccatcaaagatcgcatgcacttggaacatcagcatcctttgattcaggagtaggatagctctcagctggggctctacttcctttatttggaaactgtcttccccagctggtaattgggcctgatggcattcttcagagtgaccacagagcagaagagccacaatgaacctcccccatcaggttccttgaaaattgagctaatgtattgaaggcagcagacagagccacaatttagggacatgggtttttcaagatacgataaacagacaacacatgtacatctctaaattgttctgtcatagccacttgtctcctccactagggtcgcctgtgtcctccagctgcttccactgacagctcgattgtgaagtgagctccacttacaagaggcttgtatatagagggtcccttcccactgtgttcacattctactaatcctccttaattcaatcagattttgatttaattctgccataagttagtttttttctgaagccatagacagattagcataaacaaaggagatcattttaacttaagagtttcagaaagtagtatggacaaaatattatcttattctagattaggttgtatattttatagatgttgatagaagaataggattatgactaaaacttttgaaatgaaatatttgactttgaaattaatttttatgaatggagctaatttcatgtagtttttgatcatgaaaataaaatctcattttgattaatttatcacatttactcagaggtcttaaagtcgcatttattaaaccagtcctttattcaaaatgatgaataagatgatgaagatacccacttagaagtttattgtaaaaaaatcataaaactgttcacctgcaatcaggcagccttaggagagcctgtattttgtttggttttgtttggttacggtatcaaaaccaagatatttttataatcttactgcttctacaacatatgtatatataaaatgagatacatttatttaaatacactggattttggaggctgaataagaaaaataatttaaactctcattaagattttttttttttttttttttgagacagagtcttgctctgtggcctaggctggagtgcagtggcttgatctcggctcactgcaagctctgtctcctgggttcacaccattctcctgcctcagcctcctgagtagctgggactacaggtgcccgccacgaagcctggctaattttttgtatttttagtagagacagggtttcaccgtgttagccaggatggtcttgatctcctgacctcgtgatccacctgcctcggcctcccaaagtgctgtgattacaggtgtgagccactgcacccagccctcattaagatctttgaataatgtttttatgatcagtgtaaacccatatcgaaaaatgataacacattttgccaattgaaatcattttgacttggttccttttactttatttagtatgactactggaaaatgtataattgcataggtgggtcacattgtctttctgttggccatccctggtctggacttaggggcccttcatctccctagctgtccagcctacctggggcacagacctatcacggcagctgtgaggttgagtaagccagttggggaaatttaattcactatcactgggagtagcccaagctatgattgagtgagaaaagaaagaatatgtcatgtctctcacatgggtactgagaatctagttctgtctgtagctcctagagcagaggaccaagcatctctgaggacacacgttgtgcctggcattgagctggcctcacacaacacttgctctattaactattcaattattgggaccttactctctcatacttaccttttgtagaaaactaagaattagaaattacataagattggactcatttttcctcttctactaaattctcttctggcctccaattgcttccgaaggtggctcagttctccttacctctttcttaacatgttcttttgaaaatgacatttgacgtttttattaaaaactttatttgtgatattattgcagtatttgcaaggcttcagacaaatgtctaaactgtactatcgttctcagtactcttaagatgacatttttagtgtataacatatcttaaataacaaataataaatatatgacctatggatattaatatattttggtaggactggcagttacttataaattattctagttttgagataagaaaaaactccattttgctacagtatcagcataaattaacaaaccatacttttccatagagtagtttgctcatgatgttttggcatgtgtgggagtcacatcaactcgtctttcatccgtttaccaaatatttgctaataatacataccggctctaccactaggaagtgactgcttttttacactgagctaaaagacttcctaaagcagttgttcccaaactttgctgcacattgaaattacctgggatcttttaaaaacaatttttttttcttttttttttgtggagatgcagtccctctctgttgcccagactagagtgcagtggcatgatcttggctcagtgcagcctccgtctccgcctcccgggttcaagtgattcttctacctcagcctcctgagtagctgggattacaggcgtgtgccacaatacccagctaatttttttgtatttttagtagaggtggtgtttcaccatgttggcgaggctggtcttgaactcctgaccttaagtatctaccctcctctgcctctcaaagtgctgggattacaggcatgagccactgtacctggccttaaaaatgttgatgccaggctctcataccctgtcagcctgacttaattgctattggatgtggactgggaagtaggattctttaaatttccgcagatgattctaatatgtagcaaagtttgggagaccactgtcctaatgggagagttgcttgtgtgctggagaagtgggatacaccattgttatcttcatgttgatagtgtcctgcttcatggggagcttttctctgaacgtcttttaaaaaacaacataacctcgctgggcacagtggctcatgcctgtaatcccagcactttgggaggtcgaggtgggtggatcacctgaggtcaggagtttgagaccagcctggccaagatagtgaaaccctggctctaccaaaaatacaaaaattagctgggcatggtggcgggtgcctgtaatcccagctgcttgggaggctgaggcaggagaatggtgtgaacccgggaggtggagcttgcaatgagcggattgcgccactgcactccagcctggggacaagagtgagactctggaaacaaaaacaaaaaacccaaaatccctgcaacctaaatccaaacaaatcatcaaagtcccaaagaaaatagcagaacgttctttttgttccctcaatagcagaagacttatcgtagctaaaccctagttctaatcagaagccagtcagttaaccagtatttattagcatcacaggacatgcatagtcatgctctaggcctctgggatacgtgttcaacgttggttacatacaatccttgatttattagtggctgacaaaacaaaagatttgtaagtaattgaagtgtaccagatgatcaaaatgttgcaaatttgcaccgattaagagaatatgagtgcatgttgaaggattgggaagcatgtgatgttaattgaggactgtctttaggagtaggcttcctcagatttaaaggatgggaaagtatattttggcgtttagaggaaactcagcaaagatacagagaaagggtgactgagaaaagacaaacttggttgtgaaggaaacatggagaaacagtaaaagcaggcaatcaggcttatgcatttgattgtaaaggaactgggtgaatactagaaggtgatacgtagcaaagaaacaggcattcaaaaagtaaatatgaaaactaatattggtagtcatgcatgggatgccccagggttctgcttaggatgcagtatttataagcgaggtaactgattctggataataggtttggcagtggggtagatagtgcagatacagccgaatgattttgctgaagttgtaccagtcacatttagcagttggttgtatatagaggataggaattctgcaaggaattttaccttgaagtgttagtttgggtaatgaaggatgtcaaggaaattgagaggtccatgatctcataacgtatatcaggagcactaggggtgcttcttggaaattcagataactggtctcagtctacatctgttgaatcagaattgttgacgattgggtctctctgctttagacgatgagagatccaataggaatagtcaggtggagagaagaattttctgatcttctgcctttcggggacagaagatgccccaggggctttcctgagagagtagggtttatgaaggctctgggtcatggtgccatatagcatttgggataatgacagagagcatgtggatgtaaggcagaacttctatcctaaaatgtgaggttgagggaagaaataacaaaatggctaaatgtagtcatgtttcattgtgtcagaagccaaaagcagttacaatttcaaatgtgttttaggtgaatcccagacagactcagaagtgttcatggcagctcctgttcactcatcccaccgttttacctccagtccctcccacctgccgtctctgtgtgacatctggcttctggtgcccctgtagtcgtttattcctatgtgggaaaacattccccttattctcaagtagctttacaccacctttcctccactgtcttggtcttgctgaaaaccaacattactaacattactgtgcagccaccatgatttgtagctctctcatgatggagtcatctgctctgcccacatctctggaaaaagataatgggcttggccttctcccctgcccctcctgcacctcctgcacctccgacatctctcactcttgagctgagttctgcagggcaagaggaattgtccaggtttgcaaggatgtggggtgtcagaaggaaggaattttggcagaggggtgaacgagggtcaaagggtagatgatggaaacagtgtgatacatttgggacccgagggccatcaggcaagttaggaggagtggtaggaatggagagtgaagggagggagggaggcaggcactcagattactctgctgaagggttgccttgcctttgagtgataaggacctatcagggttaagttccaaagtggtgcaataagataagcatttggaaggattcttaacctctcagacccttagttcctttaaaaaaaaaaaaaagttggccgggcgcggtggctcacgcctgtaatcccagcactttgggaggccgaggcgggcggatcacgaggtcaggagatcgagaccatcccggctaaaacggtgaaaccccgtctctactaaaactacaaaaaatagccgggcgtagtggcgggcgcctgtagtcctagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaattttattcatactacctcccacccagctttgtgaggattaaagagtgagtctttgcacatagtagatattcattaaatgcctatcttcatttccttcttcatccttctcctgatttgttttaatcttgaaatgtgcatgtgcctcatttggcagttatattgcctggtattttaagttatatttcctatgtttactttgtttctggaactttactgtttactcagagaaaatgtcttatttatcctttgcttgcctcttctcatttctaaatacaggcatgccttgcacacatagtaagcactcagtaagcatttgctttttgcttcagtattcagatttgactaaaattccatattggtaatattgtgtgtctcaacaatttctaaagttattggaagaatttatatgtggttggaattggtactttcacataacatgtaggattgtttttcattcctttatgaatttatgtcagcatctttctgaactgtgggtaatatattagacgtagaaaagtacatcatgttatgtgtgaaagagtcttatagtttcagagattggagtgtaattacatcatttctttgagtaagtacaaatgagccgccccccatgagcagtgcattgtctctttctgggcctgcatgacacctaggtgcatgtactgtatgatatgcaaaaacaaagtaacactcttttgcttaaaaacatcttttagttgctatttttaaaatagtcattaccatttaaaactaaatttggatgccacttttgtttatgaagtttctcttaaaaaatcttccatatgtggataatttgaatattcactttaattttctagagtatggcattaaaatgtcgatctaggcaagctgtcagttatcaaattcagcattgtaacaagctgtgaattcatgggatagaagtaggaagccacatacaagatttgacaatctttcatttgttgcatgtaaaagcaaatttatcttcctttgcaaagcaaagttttagatttttggaaaaccttaccgcttgaagattgctttgcctccagagcactttagaattgtatggggttctcaagatgggctctggtagaagattacaatgtataatttcagtattaatcttcaggggtatggaaaggaagatgtccagagtgaacctgaaacatattttaccaattgcgcattaattttaaattgccaagggcaatgaagaaaataaagaacagctgtcctcagaaaatttacagcaagtaaactagagtttctctctgtctctgttttaatcaaaatgggtgtgaggtgagcgtgggtggaaatagaggacagtcttctgtgggagggagttgaagagtcttgtggtgtctgcagaaatgcaaatgcaaaattgaaataataaatccaggcacatcaggactgaatattcattttcacaattagtaatcttatttgttttaaggaaactctgagaaactatttgtttccaaatgaatggtcacattaaattaataggggcacatccttcctctgagacggcgaaccccgagtccttgcctttacccctcgtccatgtggtttagggtttggtttaggactgttactactttcctgttgtccagtgactgttttttttcagcccatgaattaaaccttcttttctctttgttacctatggttttatacgttttcctcctctttaacgcatccacagaatagaaatgaagaaaattaataggactttattctatccttacaataaatcatcttgcttctgggtgtatttggggttggaggttgggtagttgtcagaaaatgacaatggtatattttcaagtagtgctgaaggtgtttttagaacagaagaaacttggtggaactgtcttgctacagagtaggcatgctaggctttgtttttgcattacattctgatgaggtctgtgacattttatggtacactgttagcatagtggtgaagaacattagcccaaaagactatcttgattgtaatctcagttttactccttattaactctgcctgtaacctctctgtgtctttatcatctgtgaaaagggataaggatcagatctccttcatggggttgttgtgagaactaaaagagaatgcttaggacattggcacctgttgaatagccagtaagtgtgagttgcttatttagagataaatccagtcattgaggccaattataattaagtagtctcattattgatttaaggctctaggagattgaagaactttctatttttttttttttaaaatagcaatttacattgggaaataaatcacccaaattcactttatctgttaattttatatggctcttagaacaaacagcaaaattaactggtttggcttttaacctcttcctcttcagtgatttgtggacatttgagcattaagatatcctgagcagtaaaatagccagaggctcaggaagaacaccacggttttcagattatctcaagcttttcctcagaagccaaacaaacaccacaaaacaccctgaaaaccaaaagcaggcattcttcctcctgggatttagtacctgctgctacagctgctctgaggtggagaggcagagggcagcagcgagacacaacattaggccttttctgatgtttcccatctctgcagcagaggaatgaaaaggaatcttgcaaaaagcaacggcccacttttgccttgagtttgagtctctttttgatttattgtagtaaaattttgctagtacttaaacctgagctacatgagtgatgagcttgaaaatttatttagctgtcccatcctttccagcttactttaatacttacctatgcctgggcacacacatgttagatggattttagttgtaattttggggtatttcttacagggaaggtattagaggaaaaaatactagaaatatggttcctgttcttaaagatgagcttcaatctaaattcaagacagagattttactctactttcatgttaaccagttatcctgcatagttccacggatactagtagaagacacaagactcctggatctttgacacaggacagtttattactgtcagtagctagagcagtgcattttgtgctcattccctgagccctgattcctcagggcactgcaaagatggccaggtgatacttatggatgatacagttggttgtgttataggaggaaaaactctgaatgcagaaaactcagatcttttataatggccagcaaggaagccttttgctctaggagacaccatctctatttgctaaggctgcaagcaaccctgctctttgctccagagggtagatattggaacagagggtgcttccaccatgctggggtggtgttggtagtggtgagtgggtggtatgatgtggggagatgtttgtgagcagttgtatccagagggtggcagatcccaggtgctgtgctgcattgtctgccttaactctttctgtaggctgtggtgagctattgacagatttggatgggagtgtgtcttgagatctttgacagagaatagaattggtgggaatagaatgggggtaagatggaaggcagggcggttgcttgaatttggggagtaattcagataagaaatgatggaggtttaaactagaatatttgcagtggaaagaagggatggataggaagagagacttcgcagacaaacagaatttgatgacctgctggatattggaagtcagggagagaggaaagtgaaaacgaactctaagcctcccagaccaggtggatgagacctttagccaaggcagaatgcaagatgagcagtaggtttgggagggatagagactggttttagatattctgaatgcaagtggcatgttataagaaatagaatgaaagcaagaggagagatggcaggaattatttttaaagaggtaaggttttgagtgtctaagtcaagatgatagtggagaaaaggacagaatctttgtgaatgcttctattttgatgatgagaggaagaagaataatggagacataagacagagggataggaggcgaaggaagaaggatggttgtaagggaatccataagaggggagattccaagaaggaagaagtcagctgtgccaaatactctagaaaggtcaggttggtggaggaacaagaaacaaccattgggtttagtggctggaaagtcaaactagataatagcgaggttgtacttgtttttttcttaggtgttattttctcataagaaccatgtgagacaggtggtattatccccattcgcatgagcccctgaagtgaagaaacgtgatttgatttgtctaagtctcagaggtagagagcagtatactacaacttgcttccaagactgtgttttaaatacccacgctcttaaccacagtgagcatgaggagatggagacactatagtctgacctttttttgaggatgttggagagatgaaggaaagaaaaacagaagacaagctgttaaataacaaagtttaaaagtttgagagtactgtaggaaagggaagttgggagggaagatttaagtatcacccactgaaagtgttcatctagattcaggattaagccattctaaagttagacctgccttttttccataacaactgcttcatggattctgaaggtgcatccttggcccaagagagatgcactgtctttgctgaggattgctgcaacacctcgtgaggtctcttcatagcaggcaagatgtcaatacagaatctgcatatgacaatatattaaaaattttaacgtattgcattttatgtttttggagtatatcacactctctcacacagtctccataaaactcggtagctgagcagatatatattaataggctcagttgcacatgtggtatcagaggccagaacaaggtaggataaacctgtcacaggtcacacaactaggcaaagctggggtttggagcctagtctcccgactctaagccagacttatcctatggcagcagaaacagggtgagaggaagagttggtggacagtgcaacttattggtgataggggagcttgatcctaagggaaggcgcagaggctgtgagatactccttttgccaaggttcatgctgtgaggaaaaactgaagggcacattgagtgagtcacagccagtgcctgtattagatactgggatcgggagacctctgggagagtgtggggccccaaaggttactaatgaaatcggaaactccctgttactccgtcgctttcctctaggccctgtctcggcactttgccagtagcttgggtagaaagaatagcaacaagtctagggcatctggtctgaagctaaaatgctttctcttgtgttgcctagaaactgaaaacgaggccagccacctgtagtatacagtccattttgaccataatacagaggttacagctagtaaactttctacctttcgtatttgagacttggattcgggaggatgagacttagcatcaagtcttaggtgtatctttagaagcctaaaattgtcagtacttccaaaaatacgggtttagacccagaagtgagtatttgctttgcactttttaaaatatttctcacttttctcctgggatgggacagtagtgagtggatgtgacagacaaccccagtgggcacagccacccttacgtgccaaactgtctggtttctgtgttgagtctctggtttgtttgggagtgggaagactgtgggaatgagatcctaagacctttcctgaaagtgcctgctggtggggaggctaatcatcacaatacagaaatgcgtttacacaaagagtaggagaaggcgaacatgccagtgaaagcaagacttatataggaaagggaaaaacagattagttggtggcaaataatagctgtctgtaatgtttttctatctgctgttcaaataattatcatccggggaagaacttacaaatgttattggtgagcaggaattgtatattttccatgagtcattctcgttaaataaattttgactctcttcccagcatgtgctttattttatgaaaatgggcttatagattaaaggccttggttaggacatttatatgtatcgtgcctggctattttgaaattaattttgagttttatactacaattaaagcttgtaatgattgcttggtatgtgtgaagctcatgcacttgctttgtaaacattatctcctttaatgttcacagcaacccagttcccatcattaaccccattttcagatgaagaagctgagcacagagaggctgaataacttgctaggtcacatagctagaaggtggcagagttggaagttttcaggatgtcagtaaccttaacttgtaataatttatattttgtaaccttaacacatttgtatttccaagatatgtttgttttttatttaaatggaggtaccaaggtccagaaagtttaaaatgttattcagtattatgttgaatctcatctttgtacagctctactttatctgctgcctcaatgcttaggaattatcccttaccctgctgcttggcagtatttaatgcactgtaagtgttacaaataatgcattcttttcccaaagctttagaattatgtaaataccgtatcttaaatttatgatggtgaatatgtccctttgatggaatagagagaatcattcttctgtctgcttatatttaaaaccattttaatataaatacacatttttgacagaatgttataatgttatgaattgctgagtatcttggaagagtatctttgtgtatgaacctgtttatttttatgtaacccagtgcagcagatagcctagaaagtgcttactatacttaaacagacatttaaacattagtgcttactgaggactagttataaatatatgtaaggaacacattatcacatttttgtaatccacctatgatctgaaacaatattcatgagtctcttcattgcttttcttaatattaccttcataatacatcattcttagccagattgctaggtatttcctcacaagtttttctaattatttcatgaagagtgcgtttttccttcattttcaagaatatttcaagattagctaatgttagtaattatatatgaaaatatatacatataaggcatctaaaataatgattaatatttttatgtgcataaaagcatgtttgtttgttgtataacccatagagaaatctgtctttacagtgctagagggatatgcaaacctatatttgcatttgtgcatacacatgtgtgtatatatatgcacatgtgcctcattaatgatgaaatgttagacttttgatgtaaatcctgtgaatgccagtatgaacattaatgaccttttgcccctgttgtcaacacacgtgagtgcaaataaatgattcagtccctccacaaatattgatgaagcatctcattccatgccaggcaatctgctggttactagatgagagctgaatgttagtttacagaaccatggaatttgagaatgtatttctgtagaatcatacggctgcaaaatcctttttaatcatttcatgcctgttaccatcaaaggtgtttatctttcactttgagcccttctcctttgttgttgtatctttttctgtcatgtattttatttccgtatttcccttactgattaatcatcaatatattaattgttcatttatttttcaattcatttgttaaatatataccataggctaaggacaagttgaggtattaagaatatggagctatcgggtataaaaactgcccctgaagctgaaaagataagaaagaacttcttggcctatttagtttcaagttactctcttttaattttaattgtctgtttaattttaccctgtgtcttcacttgattccacctcactgcctaaaatataagtactcagcaattcctgtgaaattaacaggaaattaaatgttatgtaatttctagcctatcttctcatttatttccaatttttcctcccttttattttgtattctccctgtttaccatttctattttttaaaaattacctgtcttttctcttctgcttcctttattctaatggtactttgttttcaaattcatcacatttatttgccagctgtagctactctagcctttatctctacctctcttgtttacctgcatttatcagccctcttaagttttatttttcttttgcatctgattttttaactatcccagaacatcttattttctgtgttgcttctccagcccacctacagggacagtggatgcctgctagtgctcagtagttccatgcaggtgttttctggagctgtgtggtctctggctctggtaacaccatttgggtttgagagggaaacagctgagcagagatgatgatgaaacttgactgcttcccactttttgaccctctcctctaggaagatgtgggtgatgtgagtagtgctctatgacagtgttgtgggagattggaggagacagatggtaggaagtaagacacatttgattttaccttatccattttgcccagagacagctgtcatcagctgctcatcactctaatggagataagcttaccttttgtttgctaactatcagaacgaatctcaatctaatttattaagagagaaaaaaaaaaaaaacttggggcctgtaaacacattgaccaggttacaaatttttgttaaaagttagacaatattgatatcaatatcatcactgagcatttatatctgaaaaatcacaataatttggatattttaactttaatttttcagttctaaattgtgatgtccattttggcccaagtctatatctatagttctatatcaaattcaagtcagatcaacctagctatacctattctgtgcccacctattctatacaaggcaccataaaagctattaaaagcaaaaaccaaggttgaccaagtatctttccaggcaatacctctgtatttggagagaaggtggaatacaggttcacgattcttcatctgaaaattccaaggctaggtgtgttttggaattcagacctttttaattaaaaaagataatagatcattcagaacataggcacaggcaaagatttcatgacgaagatgccaaaagcaattgcaacaaaagcaaaaattgacaaatgggatcttattaaactaaagagcttctgcacagcaaaagaaactatcaccagagcaaacagacatcctacagaacgggagaaaatttttgcaatctatccatctgacaaaggtgtaatatccagaatctataaggaactttaaatgagaaaaacaacctcattgaaaagtgggcaaaggacatgaacagacacttctcaagacaagacatacatgtgaccaacaaacatatgaaaaaaaagttcaacatcattaatcattagagaaatgcaagtcaaaaccacaatgagataccatctcaagccagtcagaatggctattattaaaaagtcaaaaaacagatgctggtgagattgtggagaaaaaggaacacactatcggtgggagtgtgaattagttcagccattgtggaagacagtggcgattccttaaagacctagaggcagaaataccatttgacccagcaattccattactgggtatatacccaaaggaatgtaaattgttttattataaagacgcatgcatatgttcactacattacttttcacaattgcaaagacatggaatcaacccaaatgcccatcaatgatagactggataaagaaaatgccgtacatgtaatataccatggaatactatgcagccataaaaaggaatgagatcatgttctttgcagggacatggatggagctggagcccatttttcttagcaaagtaatgcagaaacagaaaaccaaatatctcatgttttcacttacaagtgggagctaaataataacacatggacacatggggggaacaacacacactgggacctgtcagaaggcgggggtgggaggagggagaggctcaggaagaatagctaatggatgctgggcttaatacctgagtaatgggatggtctgtgcagcaaaccactatggcacacgtttacttatgtaacctgtacatcctgcacatgtacctctgaacttaaaagttggagataaaaaatggaaaaaacaataaaaaggtaatatgggacatacactgaatagaatattacatctccaggcaggtttggtgtggaaattacttttaacatgtgaaatatgaacattcagtctgagtggaaaaaatacttaaataacctgatttcaggtcatgcatttatactttttcagcttcaggatttctttttgatttttaaaaattatttcaatctctctgttaaatttccccaataaatttctgaattgattttctgtattttcttgaagtttgttgagaaggaagctcatcttctttaaatttctttgagagattgcatgtcttcatcactttagggttggtctctggtgccttatattgcctgttaggtgaggccatatttccctgaatgttcttttaaaaattgtttatttttttagggacaaggttttgctatgttgcccaggatggagcccagagactattcacaggtgcagtcatagcacactatggccttgaactcctatactcaagcagtccttctccctcagcctcccaagtagctgggattacaggcactcgccactgtgccagtccctgaatgctctcgatgcttgtgacagtgtctgtgcattgagggattagctgtttattttcatctacccagtctggctttgtgcctgttcttcagagggccttccaggattctaagatgactgactcttgggtttcctgagcctgtgaccactgtagctgtctcagcactagaggatgctctaagcccaggcttgccacgagtctcttcaggactcagaagttgacgtggctttctgccccagatggacctggggaagacccaaaaaagatactgggactgtgtgggaatactggccaagacctgagtccagaagactgttctagtggcccagatggatgtgtctcccagcaggtctctgcatgggtgggatgaatttctgactatagcagaatgggctggagttgatatgaggccctcttggtatctgctgtggggcagaggctggagagccaggctctttgggtgtatgtctcatagtaggtctcaacatgagattgttccctgattgcagtgggaggggcgggagctgagcctgggtccccttaggatctgttgtggggcagaggttggcaagcccatctggaagcctcaggctcccaggctgcgagacatgggtgagtttccctctgggtccctgtgcaagcagctctgagttgggaccttggctgaggggccctggagccaagccacagggcaagtctcaggttcactgctgagaccactgttagtatgcagacgaacctttctgccaaagcaccagtgtgcaagattccttttggaccccttggcagatagtttcaactgcaggctcaaggccaaagagggctgtagctaagtcccttggaggactggaccattgtcaagcttgaatctaggagcaagcttgtggcacatcagccacctggatgttggtctgcactctcaaagtgaccctcccaggtcttgggctccaccaaggtttcacaaacttttacctgaatcctgagattcccacagagagactttgatggtggatggatgcagaattcttactgtcatatggggatatgagcaggttactttctgtgccaccatcttggtgatgccactcctctatccgttaacgcttttgattttgggagttgtgactaagattgtggacttgttttaagatgtaccctggtgggtgcagtggctcttgcctgtaatcccagcactttgggatgccctgaggcagtaggaccacttgcaccaggagtttgagaccagcccaggcaacatagtgagacccgctctctacaaaaaatagattcagcctagtgtggtagcatgtgcttgtagtcccagctagtcgaggggctgacatgggaggatggcttgatccaaggaggtcaaggctgcagagagctgttatcacaccactgcattccacctgggtgacagaatgagaccctgccttaaaaataaaaaattttaaatgtaatcaagtgttaaattaaaaggaatcaattatgagttatgtttagaagaagggagtatcactgtgggctggtgtcaaaaaggggatttttatccggttttgaaggtttagatgggaattttactcactgtcgaatcttgggcaaccagaatagcacctggcacatatctgatgaataaatatatgacagttgaataaatctgtgaagagaaggggaagagcattcctgctggggagacttcagcctgaatgtagccgcagaggatgcaatgaacttggttatttgtgggtgatggtcgagctgtctgttgtgattaagttgaatacactgcagtccctgtaggaagatgaggtgaggcccgtcatggatgtgtgcgtgtgtgtgccttacatacttgttaaggctagaggatgtgggctggatctgaaggctggctcttaaatggggatccaggggacattagataataatagtggtttgaaaataaaaagatagaagacagtgttcagaatggattatagttgtgtgtttctttttagggattccgtaataaatgtgtgtgcatgaaattcaggactgtgttgaagaggcagacattagtctgaagtttgaagaaagagtggacattgacttgttgcatttggaaagtgacagggaagaagtcaaagatttcaaatttctaatacttgttgatcagaaatagtgatccctttggttgacagggaaatttggaaaagaagctggaaaaggacatgataaactcactaatatgccttggcatattggttggtttatatccttaagatgtatttgatgccttttatatgaacatatatgtgttcatagataaaaagtatgttccagctctcatttagttcagagcctttgagaacagtgtagcaagaaatagaaaatcgaacaagacttgagtgtatgtattttacgtgcgatttccaagctgcttttgtgcaaggtttatttaaatttcatttaaaaatgtagaaactgtgttgagtagctttaattcccccttgcacctctcagtatgcattagcaattacttctctcaggttgatgaatttgaacttgatcaattatttgatagtaattactggcacagagtgattattattgccgaagtgacattcttatttcatctctccatataattcaggccgttttcacagaggcatgtttgcttgaatgcagagtatgatttgctcttttggcttctaccactgaggtcaaactttttaagctttcttagctagagtagtactgaaaccctctggtattttaaactatctggatgtgcccttctggcttccaaaaagaaggaaggattgaggctcaatcttttttcctgtatcgggctcaaaaggtctctgatttttgtgtttcttagcaactttcttttcttttttccaactcctggcagggctgtgcggcctccttttcctctcttttttttttttttttttttttgagatggagtcttgctctgtcgcccaggctggactgcggactgcagtggcgcaatctcggctcactgcaagctccgcttcccgggttcacgccattctcctgcctcagcctcccgagtagctgggactacaggcgcccgccaccgtgcccggctaatttttttgtatttttagtagagacggggtttcaccttgttagccaggatggtctcgatctcctgacctcatgatccacccgcctcggcctcccaaagtgctgggattacaggcgtgagccaccgcgcccggcccttttcctctcttatagttgctgaatgttcgccctcaggaaggtgtgtctctgatgctgtgactccttagtgttctgagtagacttaggtagactaagggctagcctttgctcttctggttctttaagctctaatgagatggagagtaattattagcttgcttgggctgccataataaagtatcacaggctgggtgacttaaatcaggggtccccaatccccagaccgtggcctattaggaaccaggcctcacagcaggcggtgagcagtgggcaagccttatggcctcagctccgcctcctgtcagatcagtggcgacattagattgttataggagtgcaaaccctattgtgaactgcacatgtgagtgatctaggttttgtactccttatgagaatctaataataaatgtaatgctcttgaatcattctgaaaccatcccccccaccccaatcggtggaaaaattgtcttccatgaaaccagcccctggtgccaaaaaggttggggatgggggctgctgaataaacaatagaaatcaattttctcacaattctgggggctacaagtccaatattaagctatcagcagggttaatttcttctgaggcctctctctggcatggggatagctgtcttctccctgtgtcttctcatggtccccctctgtacatgtctgtgtcttcatctcttcttacaaggcctccagtcatggtggatttgtgcccaccctggtgacctcattttaatttaattactttttttttcaagaccttatttctaaatacagtcacatttggaagtactgaggattaggacgtcaacagatgaatttgtggggatacaattcagcctataacagaaggaaaaataggacatttgtaaaacttaaaaaataaggaataaaaagcaaagaggatttatattcctttgggtatatacccagtaatataaatcgtcctgttatacacacacatgcacatgtatattcattgcagccctactcacaatagcaaagacatggactcagcctaaatgcccatcagtgatagactggataaagaaaatgtggggtcaggcgtattggctcatgcctgtaatcccagcactttgggaggcggaggcaggcggatcacctgaggtcagaagttcaagatgagcctgaccaacatggtgaaaccccatctctactaaaaatacaaaattagctgggtgtggtggcatatgcctgtaatcccagctacttgggaggctgagacaggagaatcacttgaacctgtgaggtggaggttgcagtgagccgagattgctccattgtactccagcctgggcaacaagagtgaaactccatctccaaaagaaacaaaatgtggtacataaagtaccacggactactatgcagccctaaaaaggaacgaggatcatgtcctttgctgggacatggatggaagtggaggccattatccttagcaaagtaatgcaggaatagaaaaccaaacactgcatgttctcacttataagtgggagctaaatgatgagaactcgtggacacatagaggagaacaacacatactgaggcctatgggagggtggagggtgggaaaagggaggggatcaggaagaataattaatgagtactaggcttagtacctgggtgatgaaatagtctgtacaacaaatgccatgacacaggtttattatctatgtaacaaacctgtacatgtacccctgaacttaaaagttaaaaaaaatagtatatgtaactataatttttaaaaaaagcaaagagaaaaagaaggaacaaaacttgacaaggaagaatgaatgcttttgtgtgtgtgctgtgagttacaatctgtaggacatgtgttagtatcatctcatttccctcccagcataacatagggtataggatgcagtccttgatctcagatacagcatagagactccgagaggtttcctctcttcctcatgagtgactgaactgacttgaatccaattctttagactctgactagtattcttttcatcactccgagcagggaggtgaaaagaaagtaaaccctcgtggtcaaattccatggccttttgttgtgttattctgttttggaaactttggggattagaggcatcatctgcctgtcagccagttgtgttcttgttacctttaacattcgtagcggagaaaataaacacacagccagaaagctgcaactcatttgagaagtaaatataagtcacattttttggaagtcattattatgaaaattttcaagcataaaaaagtagagagattggtataatgaattcccatattctcatccagattcaataattatcaagattttgccacagttgtttcatctatccctttttccctcttaaagcaaatgtaaggttacttttaaccctttcaggatgcaactttaaacaaatggagattttcttacccttaatgctactcagtttgctaattgcatcaaaaatgtcttttcgtcattgatttgttcagatcagaatgcaaatgataaggatatttgttcagcataccaaattaggtttgacaatacattttcttttatatgtctcttgttttcagggacaatttgttttcagatctctgtagagagagaggatgcattgatttggttcattttgcagtatactttgtggtgatattgatttgaagtttcacagctcctcactggacaggacatgtaacaactttaaaaaaaattacagttttgctttagttttgaatgaatttctatggttttcagaaatcatccaaacaatgatttctatgtactaatcatcaccgtatttttaaaaggctaaaacttttgaagaaaaatgtaaacaagtaaatacagtaaacataaaagttttagtgcatctttacaaattggattggtattcatttcaatgtatccatgatacttaactaacttactaacattgaggcatttcatttttgtccacatggaacattgtttgctgagattatttttttaaccacaacttacagataaaaagctagtaaaacaagttgttaaacacttgattttttcaaaggttatttttatagttaacaggaatgctgctaatgttagttagcaaagattttgaatgcaactgtttgatggcttttaaaatatgatagtcttctattttgctaatagtttgtttcttcccataggtataaatgaccaaggattgtacagagttgtgggggtgagttcaaaggtccagagacttctgagtatgttgatgggtatgcctcttttctaatcatttttccatgtgttatttgtgtatgttcattgacttcacagcttaatatttcataataatgtagagaatacttgtcattccattcctctactttctacaggagttttctgctgagcagagacaattgacccacagaagtagattagtatttgcatcagcatagattgtctattacctcttattaagaaatgaaaaaagaatgcaccccctggttgactatcttcctgtgcttgcttctcacagggaagtggcagtcaggcctctatgatttgcgtggcttccaaatagcctgtccagaattgtgacagtacatttggttggacaagaccactgggactcgctcatttttatggagcttccaaaactgtcatttgacagcaagggtctgattctcagggattcattggtattcacagtggcttgtttgtagttcacaccaggctctcctccagaaccatgcatgctccatctgtgctgataacacagtgttctttggcatcgcagactagaggaagccagaaagtgaattcatttcattaccccagacattatgtgaatgacaaagcgcttttacattacacactgctgtcagttcattgccacctgtaagacactccacttctcccccaccccaaaacaggctgcctcttgaagagtgatgataactcatcaggctagagggcctgtgtatcaaaccaatctgtcattatgatcttgctacatattaatttatttgataccttactttaattaatcaatattaacaatgccctcaggtgtgctgtgaatgcattccaacctgtctgcatcttaaaacattacagcaaagagtcatttttaggaagcatgagccaagttgaataaaatcaactgccatgctacagataggattgcttgtttgcctatatttgaattaaggatttaataagcaacaatcttttataagctattaaccacaggagaaattgcccgtcatcagttggagagccttattagaatacattcacttccataagctgttttcattttctgcctctctggtttaacttgggtgtgcaattttggcagtcagattttcctttttaccaatagtggtctccaaattaaatagactcaggttgccagtggttcagtagcagctggaagaatttaatgggagtacagcatctgcttttacttaattttaaaattggaatcacttctttcatttccaagatggtgttatgatgattagaactggaagagtatattgataacagaatgggaaatgtggactgaaaggcacattttgctggtaaattggtcctaaggacctggcattatttttattatcatcttgttcctgttcaaggaaagtttgaacaagggtttttctgtggtcaccttgaagtgctaagctgtctcaaaatttgttggtcatctcataaaattctacgtgtacagcattgctaaactcagcgtggtagtttgctctgctcatgggaaatgtcccaagccagtccttaacttacaaggtgtttttaaatatctaaaccctcaaaaaattcgtgacctggaaaactgtttttacttttcatgggcctcagagtagagaagcccaggacatgagtgtgacacaacctcacacatattgctggcaagggaaatgcttatgttttcagtaataccattctgcaatcagaggaaagttagagaattgatgtgagacagatactgacttgttacctcctcattaagccattcatttaagagggttacacaatatacatttgttttgagtaatctataaataattcctagtgtgaatttaagattatcagtcaaaaactttggattttcattagcattaataccattttcttattaccttatgctaccaatacaaaccttagcccttgacaaaatatatttatttgctatttcctaatcacttaaatgtttccttatttctttccttttattctgatggagtggacttgtctcttttttctggtgtgttttttcccttcatattgaacactgattgagtgttcaaatggaaataatttaacgcctcttccaaaaaaagggttttagagttttgaatagtcatgtctacataatcttaggggcatttttttctccaacttttcccattttgctcattgttagagggttacatgtatatcctgaagaggaaaaaattgtgtgggtctgccaagtttttaactttgcttttttaaagcaattagtgtttattattattcctgcaggtaataggtttatttcaaatttgaattttttcaaggaacattttgtttgtaatgcattgtctttgtagaaatgggaaataatttaatttttaagtatttgagaaacagtcccaagccatgtactattttttgaggagagctgccatttatccaattctctgtagttcttgagagctaattatttactttagaattttttattgccatttttacacaaagtactttgtattgtttgttaaagtgttttaagtcttatttaaatactcatgtaaaagtttataatgatttctaaaagggtatatgcttaatctcttgcatgttttttcacttgtctcttttttctggtatgttttttcccttcatatttcatattaaaatagcaaaatgtttctttccactatccttctctccgtcctccttctcctgcccctttgttccctccttatcctctttattctctcccccttctttccttctcccctaattcccagctggcatgaaatagcaatgacattgaccatagaaaactgtctaaatagagaggcagttattctcctcgaggccaggtaaaggagcaggcagctgccttcctccatccggtgatgagagggtattcttagttgtcttcccctctgggagcctaaggcagctatccgctggatttccagcagcctctaagcctttccctggaccaagcttcttaagctgctgaaagaacatgcccatataagcagatgcctgcctttttcttcccctttgcagcctctaagacagggcgcacagatttggtagaagttgttattgtttttgtaaagtagaaacttagcacagtttggaaaggcagggagaaatatcagatgagttgtctttaggtgagtcatggttttttagtaaatggagtgagaatgtaaaatatcaattacaatagttcatggtagattagaactgatacgaggtagaattgttatacattcttccttcttccctactttagtttaaaacatcagagtggaagaagaggaaattgtgagaaaatgtggtagtagtttgtgtggtctggtgagctcagtggttaattctaaatctgatttgcaagaagggctggatgaccttattttcacacataaaaccacagaaaacaagaaatgagaagagttttacttgaaaaccattaccttgtttcctttgtaggacagctttgttgcatagattggggaaaaaagtgaactaacgtagctgaaaagtataaaacatattttcaaaattcatccattcactgtgctttttcaagtactttaaaattggacctaagtcagtgttgagtagggtgctagcagctgcataaaattgcactttgcatttaggttggactgcagattttcagtttcaaaaaaatgaccagtggttacgtaagcgtgaaacattcacccaaataaaaagtcaactctttttatctgtgcttgttagtttagatttttaacaaacccataaagtgtccttccttggtcagaaaggaagcaaattgtttttatctttcttatggtagaacatgtattctgaatgaaccctccaaatgtattttcacatttgaatcccaaataattattaaattctgcctagtcccagtgcattcactgattctaaaggactgctagggatgattgagctatttgaaaacagtgaaaatttaagagagaattagtaacatagacactgtgtagtcatttgcttctgatgtgacagctgctttttattccatgaatttagaatgatggcttatttttccatagacagaatatgattctcaaaatacggaatcataatttggtagaaagctggaaataaaagatttcctttagaagcctcttggattttaaaaaggtggtttgctggtagcaagttgattgaaaatgttatctgacttgtatgttaaaacgagatttaaataattgatttaatgagagagagaatattcagttactgaagtaattggttggcaaagtctttagaacagaattatttagtcctagttataaaggattgcacctttaatcagggggcttaatttgatttcttgaatgtatctgtggcttgtctgacaagctcagtaacaaatgagttcagaattgtaggaactgatcaaaatgtaatcagtgtcaattgccattgttgtagtttattgcatattgctgtcagttgctgtaatcaagaaatgttgaagtgctttaaaagtcttcagacctttgagtaattgacctcatatgtatgatgctatgcctgtgaaataaccatcacttcctgttttactttatcttcagaaagtttcagcccaacattgagttgtcatccacccttcatcatcccaagcctaaaactttttaagtagcatgcacgacttaatgtggtggtaccattttgacaggtttttctttttagtgtttttaaaaaggaaatgctaacaagatgttgccttctctatgaagacaaatacagtataagggagggaaaaaaccctgaaacaacgaggttttttttggtcttagttaagacatcatcgtggagtgagggagaaatagtcttttccatgaacctcttactttctcctttgcatagtaggtgtgtagaaaaccaggcaaattgatattgatggctcaatatcattcgtcgtaacccatttcctgcctcctccctttgggtaggtaccatcactgcttgcttatacttttcagtgactcagcagtggcaataacctgctacgtttaattatttatggaaatctgtatacgttcttcatttgccttgatgctctcaatcgttctgtgagagcatttacattatctccattgtgcagatgaagatctgaagttcagataggtttgcaactcgcttgtggtggtatggctgggccaggttgttagaagcgtgtaagcccagctttgtgatacccatgctgcattcctccctgccgccatgccacagctgagtgtaccagcccagagttctaagagtcaaagaagccatcatactccttaggggtttgcctttcctgccatcctttcattttatttctaccagaattgacactttccattccacaatttactaactctcccatctccttttttttttcctggtgccatataccttttctttagaacttactagccgttttgaattttcttcttttactttataaagaagcagccctattaactgacttaccatttgaaaggatgtttgtaagaaacacataattacacgctatttggataaagaaaactagtttaagttagaatgaatgtctagagtgttgaacagaggcttccaataaatatttcccggatgactatattatagtgttaatgtgaaaggttaactgtaaatgactttttaagtctctgtgtagttattttctgttttggttgatcatatgttaatttcagaaagatagtctaatgaacagaaatcctgaaaatctgagaccaagtttatcatcctttcaccagtttgttgccattctgatagtcatttggccattcatggtgccaccctcggttttctgtgtcatgatgatgcaggatttttttgctccttggttcagctaaatccgtgtttttgtgtcatcaccaggaaaaattagacatgcggacacagtgaagggtgaggagagtggaacttattaagcttaaggggagtgctcagcaaagagagggggtcccaccagcgggctcccacctctcatattgaacgcaaggccaccacacatgaattgaagaggtctggctcctcctttgcataaggcgggaattcccagtagctccaccctgttcccccagtgcgcgtgtgggcccttagtctaagccactccacattgatttatttccctttctaagcatgtgttaaaagaccgaaatttttaccgtgggcatgtataggcaagccttatgtgcacaatgacctgggtggatcggaggttctctggggactctaccctacttagttggctgtctcctgcctctatcaatacacagtatgagggcaacaatgccacctaaaacacctcaaaccatgtgcatacaactgaaagtgccgcttgctataagccaaggctactgagtgatactgttaacgatgatgatgataatagctatacatgaattacattgtggatgttgaaataatatactatgtctaattcttccttactcccaacccatctcttattttttgctttgatctctactacagattttacgaagtgccagaagtgtctagtcatagaacatagcttatagtattttagagaaatcatatatataatgttttcctaggaaactgcaggattgtggtttgcccatttaaaaatggaagctttgtgagctagacaagaggacctttgatgatcaaggttttaattatttttttcttgtttgcttgctcactagatgtaaaaacatgcaatgaggtggacctggagaattctgcagattgggaagtgaagacaataacaagtgccttgaaacagtatttgaggtaagctcctctcagtagcaagaaagaagaatggactatttggatctgtaacataaaacagatgccaattgtgtacataaatatcaatagttaaattaagccttattttaaaaagggaaaatttatcaggtgtctcagtgtcccagaaagaaaggtaactagtagatgcacatcagtaattaagtaaattgcaacagaacagaaattgacatagacttgggttttgaaatagacattttttgtggatgtacattttaggaattaaacactatgaaacaactcgtcgaggctgatgattgaatgaaggctatttattgaattcattgtgtctttatattttatgctgaaatgattttttaaagtttaaatgatttgaacttaggcttatgacaacatgtcaatgcaaagctctttgaaaaagaagtttacttggtgaggttttaagataaagttgttttctatttataatagaaaacatttaggactagagttagagggtagcatttttttatgagtcactgtcttttttttttttttttttttaaagaaaagaacttaatgataagctcagggttagatgaagaacaagtatatagacagttaaaagaaaatgaaaaaagatcacaactgtagtttttttatatgctgtggttctgttgggaacttagattttccatggcaaacgaatggcctaggaccagttctttttttttttaagatgaagtctcgctctttttgcccacgctggagtgcagtggcacgatcttggctcactgcaacctctgcctcccaggttcaatcaattctcatgtctcagcctcctgagtagctgggattacaggcttgcaccaccacgcctggctaagttttgtaattttagtagaggtggggtttcgccatgttgaccaggctggtctcaaactcctgacctcaagtgatctgcctcctttggcctcccaaagtcctgggattacaggtgtgagccaccatacctggcctcaggaccagttctttttaaccatacatagggttgtttttcaggtaaaagttatttgggttccagtggatacattcgaatcaacttatatgacgtattttgtatttttaaaaaattatgaaaaatttcagatacataagatgagagtttagtgtaatgaaccctcatggctctattatcctgcttcttgagttatcaacattccatccttcttaattcattaatcttcctacctgccactgttttttttttttttttgagacagagtcttgctgttggcccgggctggagtgcgatggcacaatcttggctcactgcaacctccgcctcccgggttccagcaattctcctgcctcagcctcctgagtagctgagattacaggcactcgccaccatgtccggctaattttttggtatttttaagtagagacagggtttcgctgtgttggccaggctggtctcctgacctcaggtgatctatccgccttagcctcccaaagtgctgggatctacctgccactttttaaagataatactttaaagattttctgaaacatcatattactgtacccataaatacttcagtatttatctcaaaaagtcatttttaaaaagtcagtcaaaatataattattatgcacaacaaaattaatatccagcattcagtccatgttcaatttttaccaactgtcttcaaaaagtcttttcatatttggtttaaatcctgcaggatttaaactgtgccaacttttcacttggttgataggttttaaggctattttaatctctacatttcctcccttcctccaccactggcatttatttgttgatgaacctgggtcatttttgattatatcttcatgataacatttaacatgtttctttagccatgctgtgtcctgtagataaagatttttcaaatgggctttgttagagtcaggttttattttctttatttcaagaatgcattgtaggccgggcgcggtggctcacgcctgtaatctcagcactttgggaggccgaggcaggcagatcacaagatcaggagatcaagaccatccttgctaacacggtgaaaccccgtctctactaaaaaatacaagaaaaaaaaaaaaattagccggcatggtggtgggcgcctgtagtcgcagctactcgggaggctgaggcaggagaagggtgggaacccaggaggcggagcttgcagtgagccaagatccagccactgcactccagcctaggagacagagcgagactctgtctcaaaaaaaaaaaaacaaaaaaacccccaaaaaacagaatccattgtagtggtggtatattctttctgttgtttcccatcaggtagcctgggttgtctggttgtcccactttttaatgatataaaatttatccgtgggtgatagttatgtattacctattttcaagtgctttgtgtaaagaagatgttttcagccactgttctaaattttttctgaaactgttatgtgcactattgttattcctgattgataaagggatgtatacttatatcagtattgccactgatagtgactaattgtggtttagatgaggattatggtaaaaatgaatcttgttactcccaactctaggataagaatttaagttccctgaagataggcatcttttaagtcttgttcactgcagtatccccagcaacttggagctgtggctgagaaattagaacagtgtttctcaactgaggatggttttgtccctcagtgggatgtttggccatgtttggagacattactgattttcaccattgctggtttgcagtgctcctggcatctggtggcatctgacatcctgcagtacataggacagcccaccctcccccccacaaataattatttgattcaaaatgtcaataattctgagatttagaaagctgtgttagacacatgaaggaaagagtaggtaagggatataaacatataatgaattgcacatattaacttgaccaagagacgtactgccactctaggagatagctttaaatccattttactgtttagtagactcatagctagtgcaggtaaagggattgactgagatgactcagttattggtggaaaactaagggtggaaatccacctttttggcaataaattgcattcttttttcctccattccgtatggttcttttcttttgctgtgtgggaggaatttgtttaataaactagaggccctttttatttagtacataggatttctttttggatcttgatattctcggaagctggttccttattgcccctggtcttgtgttgctttttctgtctttttattttattaccttgcttcatcctatggaatttcacttttaaacaaacattgcctacagaacgacattatgaaatgttattattatataacttcacttctaacaaaatacacattctgcctgaatgtgataaagtgaattatcataagatggcagatgccttgggagatttgaaagttgggttgctgttcttttcccctatgttatttttagcgatggaaaatgcagtaattaggatttaattgacccttttttttctctaaattttggtgatgcatcaaatgggataaaactgggtttttatctacctccattttggcagcagggttctggcccaagcaagtgtatttctttctgcatgagaggtaatacagtgtgatggtcaagagcaggaggtctggagccagcctgcctgccagggttggagccccagctctgtcactcatggcaccatggcgtgaagctgaatatagcttttctcacccaaaaaagctcttgcccttgaattcttctcactgcaaataacccagctatcttattggatgggatgttggaggtggagggaggaaaacagccaaagccccaaagcaccaaactaaaacaagaagcaggtcctccagggtcttggagaaggaaaagtatgtgcagtggaccgatgtgtggcatccctctttttcttctactgacgaggcaatttttttttttaacttctcatgttttagagagctgaataccagccctctgaatgatttcttatctatgcagaccattatttcgattttcagagatgtgttcattacagcagttttctgttgtgaggggacaaatgagtggttttgtgatgtttctagtcaaatgattttacctggaggaaacttcttttaagcctggaaattgtaatgggactttttgggagggaaatgccagcttagataaatattatgatttatatcccccaacagatcccaacgagtggcaaagagaggtggctcaaaaacatgtcgggtgggaggctgagagttgcagtgactcagcataatacattctgtatggggaacttgtcatttttatggctgcttccctaatgttaacaatatttatttttttatgctgcattgcctagctagacatatggcaatgatataagtaacttgtagaagatattcagatacaaattcatttttattggaaaagaaatgtatttctaaggtttctcattccccccctccctcgaccccacttttctttttagcaccctttaactttccttctctgctagataaccatttttcttctttgttacctcctgcttgtctatattttgaaacaaaccccctaaagacttacttctgattggcccttctttctccttatttaggctgtggtatagttgatttttttttttttttcattttctttgtgaaatgggaatgtagggggaaaaggagagggaggggaaataagagcaggactttttcactcatgcattaaattttagtttatggttgtcattttgtgtttgtatgtatatactatagcatcgtaaattgtatgtaaggaatatatgtaccttaacatttttttcttttatttttcaattttcttttcaaaacattaaaaaaaaatagaaacagggtctcactttgttgcctaggctggtcttaaactcgtcgtctcaagtgatcctcccaccttggcctcccaaagcactggggttacaggtgtgagctaccatgcttgacctatttttatttgttgtttaaagacagctttattgaaacacagttgacatacaataagctgcatatatttatagtgtaagtttcggtaagtttgatatatgtatacctctgaaactatcaccataatcaagatagtgaccctgtgcattattaccccccaaagtttcctcctaccatttgaaatctctctcacaccctacggaagtagcctcatccactaaaatgttactttgcaattcctgtaattttatataaatagaattatatagtatatacttgaagtctgtattatttcacttagaatagattcttctatgttgtagcacataccaacagttcattccatctcactgctaactaatggaccattttatagatacaccagcattttaaaaaatcagttcatctgttgcaggatatttaacttgcttgtaactttcggctgttgcacataaagctgctaaaagcatttgtatacctatatttgagtggacgcaggctttcatttctcttggataaatcccaggagtggaatatttagatcatgtggtaattatgcttaactttttgggaaactgacaaactttcttcccaagttgatgtatttctttacatcctcaccaacaatatacaaaggttccatttccttttcattcttgccaactcttaagctggtcaatctttttcattttagccatcgtaataggtatttggtagtgtttcattgtgcttttagtttgcacttctctaatgactagtaatgttgaacttttttccatgtgcttattttccatttatatattttcttgggtgaagtgtctgtgcatatctttttcccaattttttacaacttagattgtcatattattatgttttaaaagttaaaaaatatattttgagtacaagtcctttcttagatacctgctttacaagtattttcttcattctgtgacttgtctttttgttctctcaatagtgtctttcaaagagaagttttaattttgatgaagtctagttcatcagtttttctttttatggactgtgcttttgtggctatattaagaaacctttgcacttattcagggtcacaaaggttttctttttttgttttcttctgtaagttttatagttttaggttttacacttagttctgtgatccattttgagttaatttttacataagatatgaggtatgaattcaagttcatttttgcatagggatctccagtagttctagtacgatttgtaggagtggctatttctcctaaattgtctattgatatgatcatacagttttcttttcatttggtgaagtacattgattttttttttagatattatgctagtattgtattcctgtgataaacccaacttatgatatattattttatttatcttgtggaatttgatttagtaacattttatttagaatagttgcatctatgttcatgagtgatattggtctgtagtcttctcataatgcctttctcataatgtctttaactttgatattaggataaagcttacctcacagaatgagttagaaattattccctcttctattttatggaagaatttgtatagaatcagtagtttttctttcttaattgtttggtagaattcattcagtgacatcatctggccctagagttttcttactggcaagatttttaaccacaaattcaataggactactcaggttatctgtttcttcttgagcgaactttggtagtctgtgtcttttcagacatttgtccatttcatctgagttgttgaatttatgggcataaaattgctcatagtatttctttattttatttttaatatctttagaatctgcactgattctgcagtcacctttctcattcctggtgttgtttgttttctctcttttatttcctaatcattctggctggattgatcaattttactgattatcttaaaagatatggttttggattaatttattttctttatttttctgttttcgatttaattgatttctgcttgatttttattatttctcttcttttgcttactttgggcttaatttacacttcttttttttcctcatagctcattaaggtacaaaatgaagtgcttggtttaccacccttcttcttttttaatataggtgtttagtagcataaaatgtcatcttagtactgctttaccaacatccctcaaattctgatatgttgtgtttttatttcgttcttttcagaatactttctaacttctctttgagttttccagatatctttctgttattgatttttaattcagtttttgttgtaatcaaaaaacaaactctgtgtgtcttaaaccctttttattttttgagatttgtatcatggcccagaatatggttaatcttggaaaataaatggcctgtatgcactgggaatgtgtgttctgcttttgagtggagtgtcatttaggtgaaggacatgccagttggattaagttggttgatatttttgttcaaatcttctgtatcctgatttttctacttgttctgttactgaaacagagaggtgtttaactctctgattatagttgtggatttgcccatttctccttgtagttctgtcaatttttgcttcaagtgttttggggctctcttattagatctgttaacatttaatattgttttggcttcatgatgagttgacacttttgtcaatatgaaatgaccttctttatctctggcaatattctcggctttgcatatgttaaaaaattttgtttgtgcatctttgattttttttttaaacatttgaagcagaatttctgagttacaggattgtaaccttttaaaagttcttaatatcttgcgagattaccctccagaaaggctgtacagaccgacacttgtctaggtattctttaagtgtttataaagctagttgctctgatcttttataattttaagatatgtagcaaggtggactgaactgtagcatttctgttgatcacaggataaaataaactaccttatgtaacttgttttgtagactctgaaaatgctgtgtatatttttaaagttgtcatcaattttatttcatctctcatcttataggaataaagataaattcttatttttataatatatttaatcagagaggatttgagtttgtttaatcttttctatgtattttgtgtggaatcttcagctaatatcttagagatgaagtttcaaaattgtttgcttacatttggttagatggtatgtttggctttaaatacattaatgtgtagaaggaagttttatatataaaaccagatgttcacaaagctactttccgtgattagatatgaaatactgtatgcttaggtctagtagggatttgtggctccctaggctttgatagtgcttggtgccaacagcagttaataaagtgatccgtttatgtatcttttttgatatgtaaaggtattccctagggaagttttacacattaattaagaaatgcataacaaatttaacatcctttcataaaaaaactcagaagtgacttgtttggatttatttgataattctgagctgttcttttcacacaggagtcttccagagcctctcatgacctatgagttacatggagatttcattgttccagccagtaagtattatgtaaaggtatataggaacagttttgtagttggtagtgagcataaacgaaaaatttccatatgaaaaattcaacttgttattgcagtttgtgttaaaaatagaaatcgctttaaatgatgtttggtgcctcccctcatccttgggaggtgaataaaagggacagtatattctttcatttattcacatacattaattatttcctattatgttactggatatgtaaagccaagacaggattcttgtcccatgagacaattctatagcaagtactggggcatacttctcattatactacaaaatgtacaataatggcatgagcaaaatgctgagggaacacagaagtatttaatttgcgaaaggttgtggagatgaacagatttggagagattagtagtttggaggtggcttcacatagacagatactcggatctaaattacagacagaaggaatattatgagataatgccagaactccaaacagtatttgatacagactgaataatatacaatcaaatgttaaatgaaaaaggcctatagttggtagaattttgtgattgaattttttgtgagtcatactcatttgaggctttgttttctgttatatggctcactttctatctttgacacgtgttgtttaatcatcatagtcttctgaagtacactggtgttaggtatttaatagtgaaggaaatgaaggttgagacatgttaagtaacttgccagattatagggagccttatttaaaattcagaaccctagttctactagctaaaacctgcagtattggttttcacaggtgcactgacagtagctgtaattgtattttcatttccttttattttctcctcttggatgtattccatagtttaatctgttgaaaaacttagagcattccctttgggaccaatgttaccgctgcctgaacattgctttaaatgttaccttcttgtgaggtccttgctccagccagtgtaaaggttcctcctgtgttgcaggaaggaggagtgtgtaggccccattagactctacatataaaagaggcttttggaaaagcaaaaactggttctattcgtttttgttttcacatggggagaggattttttaaaaaagagaatttgtgagatcaagggagtgggggaaaattttttcggcaaaaactcaagtaaatgcttagttgttttgatttcttccctgtggcatttttggcaaactggggaaagagaaattaaacttagttggaggacaattgtttcatgttgtttgccttagagactggaaaaagcagaagagtgccaattttaatctagaatcctttgagaattagagaaagataaagtgattatggaataaggtttttttttttcctttttttttttcttttattattatactttaagttttagggtacatgtgcacattgtgcaggttagttacatatgttttaaatgaccacaatcattagtattattacgccccataactgatggcagtgtttttgaaatttgaatatcagtgtgttttaccaaatgaagaggttcctaagaggtaggagcttatatcttaagaggtaataaaatctatggtggtagaaaataagtttaaagagtttgttgaaggcatctttgagcagagtggtgaaaacgattgcagaaacgcagacaagatcatcacctgttggaccagtaccttgtgttttgcttcctgactttgtgggaatgctgtgatagtcttcacagtgatttggatgacaggaccgtcagaaagaaatactgtttctactgtaatcattggcatggatttgcacctaagtgccgttgtggttggaatgggacctgtagtaacttgatttaatgagaaaaagtacatgtactaaatgggtgtattttaggggccaaggtttccaatgtagactttaagtttttattttaatctcttgagtacccttctctgcactcattgcctcttttagagagtgtgggaacagatctcctaatcttttgcatatggacttttaaggatcgaataaaatagttacagaaatcaggtggccaaaattagtctccccttttgaatgctgttggaaaatcgggattgtggttaagctgtcattttccgtgaacagtgacacagcttacctggttttgctcaagtgtctgttagctgagctgactgctaaaattactaagcatcagcagtctttgttaccacctctcacaccaacttgaaaactaatttttgattcttctcagtcatgtgcagtggtttccatctgttctgtggtgatgagatagtttcttctcttctaccctccctgctgagagttctcaaggtttctcctgggtcccattgttttctctcatcagtttctttcctgtagtttcctgttgtgaacctccgtgttaatttctagggttcatgatacaaatataaatttcatttctattttgtcaccacaaaaggcacatttgttttatgttccttgttctgaaaaaaagatcaacttacttttaaaggttgactgcattggaaaagttaaaacatttttttctttgagaaaattaagagagttaatgtaactttctccgttagctgaattccaaactaaacttataaaaggaacccagtagacgatccatcttgggggagactataatggacttttgacatggaaatttataagacgaaaatgtagttacctggtctatggggaatacaaaagattgtgtccaccacaggcaggcatctagctggatgtcttactgcgtgatgtctgttacctttgagaaagttgtaggctatgatctgtgtgtcagccttttggcctcaaagtccttgctgtatcattttgataagagtggactcatgcctcagggttggagtcatggtgcttagtacgagaatgacaactaaaggctgaatgcctgttgtatcagaagaaaaatctcttcactgtcagttaaaccaaaacacttgtgttgctatgttcagtgtatttcttcctgtagtcaagttagttgggaagcaaaatgattaccacaaaggtctttggttatttatcatgagaaacataactataatcggatccaagacattggtgtttacctaaccagaatgttctatcgtttttgataaacatatctgggaagcaagacaaaaatcatgtgattcttgctggggaagggcttaggaacccaggaattaagggaactgaatgcttagtggcatgcctccctcttagcttgatgtattcatttcacggtagatacgaatgccacaggagaaatgcaacacttgatgtctgttgactgaagccctttatcccttgggaagtgcttggatggttactgctaatgcctttctaaaattacagtatcattgacttttgacatttcaatattgaaataatttagcatttatctgcctctgtgtcttcgataagctccatgatcacatctttttcagtttctgttagttggcacagcatcataagcagatggacattacagtgtggtagatgctgatttgtagttacacaattaaaatgccttttccactacagtaagctcctaattccctggcatatttcaagaatttggtattatgattaatttagtatcctagtttttttttttaaggtaggctgttcattctttgtcaatcagtagcaattaaaataaattgcattagcataagcaactttagatgatttatcttcaaaaactttttttggagtaccttaaaggtattatgttgtagctacatagaaatgattgcgaatagaaagctctgatgattaatgtcaaaacaagatagagaaaaaaatggttttatttaaaaagcccagagtatttttttttttgtttttgaagaagagggaaaaagacttggcagaaatggatgtgtgattttaaaatagattaggatgggctagcaggagagagactgaagatagtgaaaggttttgactctatttttctttttttaaattttttaaaattatactctaagttctagagtacatgtgtacaacgtgcagatttgttacgtatgtatacatgtgccatgttggtgtgctgcatccattaactcgtcatttacattaggtatatctcctaatgctatccctccccgctccccccaccccacgacaggcccaggtgtgtgatgttccccttcctgtgtccaagtgttctcattgttcaattcccacctatgagtgagaacatgcggtgtttggttttctgtccttgcgataggttgctgagaatgatggtttccagcttcatccatgtccctacaaaggacatgaacgcatcctttttaatggttgcatagtatttcatggtgtgtatgtgccacatattcttaatccaggttttgactctatttttcaaaatcaattccactattttaagaaatgaagaatgtaattcatagagtgtgggaaactgtttctctagcttctgtttctaaataatgaatcctaaagtatttaaactaggttttcactggaaaaagatgattattaatggcaagatagactcacaagttagtaggtttttagtgcaaagttttccagactttttaatttttgcgatataaaattcttatcctcagtagttgtccttttactcctttggaatttctactattttgcagagtctctgctttaagtctatttttaaaaatcaaagctgtgaattgaaattgttatattgtttttattttctctagtgttgattagtatcttgttttttataccagattaagaactggattataatttattacctaaccctttagacagttgtgtttttgtttctggtgataaatttagtttgtatctagaagtttttttaatgatataatatgatttggttgtgttatttatgtgccttttaatttcttagcctttttgcatcctttctgtttagcaacagctgtcttagtgtcctcagttgtaaaatatcatttctcattctcaaatactattattaggggtgtaaactggaacaaacttgtctttacaaacattggaaacaatctaagtgttcataaaatcgatggtaaggtgttccatttaatgacactgaaaaatatctgtgatacattaaataaaataggttgtttaggcatttcattaccaaaaaaaggaaggaaaactctgcaggatttatacttaaaatttaccagtttattttaggatgagatttattatgggtagctttaagtgaactttttgttgaaatataacatgggctcaaataagtatacagcttaatgaattttcacatgtaatcagccccagatcaagcaatcaaacatcatcagaagccctttctcttgctcatgtggtcattatccactcccatgaagtgtgatcactctcctgacattgtaggttgaggctgcagcatttggactttatgtaaatggaatcagagtatattcttctgtatctggtttcttttgctcattttgtgagattcatctctgttgtatgaaacattcattcattttcattgcattctgtttgaagaagccacaatagatttatctgttctactgttaatggacatttgggttgtttccagttttgggctaatagaacgctgctgtgagtataggagtatgtgtcttttaatgagcatttatgtgcatttttcctggttatatacctacgagtggaatttttgggtcggtcatagggtatgtgtttgttcagctttagtagataactgccaaacagttcttcagagtggttgaaccctttaatgattaccatctagttagcatgtggaagtttcagttgcctcatgtccttgccaaagcttagtattcatttaaagccattctggcaggtgagtattactctttcattgtgttgttaacttctgtttcaccgatataggtttattctgttttcataggttttttggtcactggaataaatattttgtgaaattcctgccccggtcttttgcccttttgtctgttggattgtctcttttttccctgattggtttgtagttctttctaatctgattgcatgctgtttcttatgtatatatgtatttcagatatttagtactttgtactaaggtcattttctctgtgttgtccaagattttagtattacaggtatttaacttttgtcataaggaaaactattatccttttgaaaaaataaatgcccctttcttgatctgctttacctctctttcccattctcttgtttttttttgctttctgaacaggtgttctgaaatcccactcttctccccttctccagcagcttcctctttgtttaacctcctcattttagtagaaaggggctctcagttgataaaactggtgatacccagggccccttaatcccagtgtttccattccttgacctctccttacctctcgagtccactggctgtgcccagcctttgcagatttcttctcacttgccttcctgatgacatcgtacctccctggtcctcccacctcttcctcctccttggctgcattgcctgcttgacttagcccttgacttcacatctccctgtacatctttggagcccttttccccacagtgccctcagttagctttctgtagaagttcggcagctttgtccatgagctagtggtcacacctcctggagaacatttctagccttgatctctaaagcctcctactgtttccagctactgctaaataccagccatttgaatgtcacttcctccattccctccaccatcatctccttcctcaagacagctttggctgctgtgtttctgtctgttggtggaattggccctgttgccagactacccagatgtgaaacactgctcgtctctgccttcttccttctgacccactgctagtctgctgctaaaacctgtcagttctgcttcttccatcgtagcgctcaaataataatagtaacacgaacaacaacagtactaatggctaacagtgattgagtgcccacatgtgccagccacagaggctaagtgctttatgtatgttacagcattgaatctcataatggccttttaagatattgtttcattttgcagatgagggagctgaggcacagagaggttagttaggtaatttgttcaagaccactcagctatcagttagaagcaacgactcccaggtgtagtgacggtcctgacatacaatcttttgactttatgaggggcttattaggatgtccccccatcataaatcatagggcatctatatttctttgttctacttccctctttgtagttctaccacctacctcactccctttatttttatttttttgagatggagtctctctctgttgcccaggctggagtgcagtggtgctgcaacctccgcctcctgggttcaggcacttttcccacctcagtctcctgggtagctgggattacaggtgcacaccaccacactggctaatttttgtatttttagtagagatggtctcactatgttggccatgctggtcttgaactcctgacctcaagggatctgcctgcctcggcctcccaaagtgctgggattataggcatgagccactgtgcctggccaccactcctttcatttcttttttcttatctcccacataactttttcctcctaattagttctttttcctattctaatccatcctttaagaaaaatatcaggcataccttccccaaatataactctattcatatcgctttcttgctttgttttcacttgactaatttagaagccaacagtgagacaacttcttcaaactggcctttgcagaccagagttggcctcgggctacctttctatctataccctcgaagagctgtctctgcacaggctctgtgctttttgtcatgctatttactgaatttggaatgttccccttgcccctcagtcctgcctttccttgaacccttccccgttcttcaggacccaatctccaagggctctccattatgagacccttcctgagcttccctggccagccctaagtgaaactacaaaaccgtttctaaccttcttttctgtcagcagtaaatttagaacctaattctcttttgtcacttctttgacgcctgtgaaaactagcaaaatcttcaacaacaaacattttattgatttatttgatagttttccaatcaagaacacaataaagggaattggggtacactgttaataagagccacgtataataattccaaagtttgggggttaagggattgtgttttccagggctgttggaacaaagtacttactactaaccaagtggcttcaaagaagaggcatttattccgtcacaattctagagtctggaggtctgaaatcaagacgttgggagggccgtgctccctctgaagactgtaggagggatccctccttgccactcacagcttctggtggttgctggccgtccttagtatcccttggcttgtgggtccttcattccagcctctgctgtgacaggacaacctccgctgtgctgcctgtacacggtcactatccctctctttgttttcttgtaaggatgccagtcatattggatgaagaagccccaccctacttcagttatgatctcatctaaactgacatctgcaacagctctcttcccaaataagatcgtgtattaagcacgcctttttattctgatgttttgacatctggggcctcactgacccgaggaaactgcccctcccagggctggcccattcctggagatattaaacttctgcaggcttttcacatggaactctccaatccaaagccccgtgacccccctccctacgagcctcctctgcgggcccttacgctacaggctgtactctcctgcccttgtcacttcagttccgagtatcagcaactagggacagcccttgtgctgcagtgcccactgaaataatttaaaccagccggtcctcaacctgcgcaccctgccttgcccattccttcctgcagaaactacagtagaggctttgcccgcattccccgttcttcctctgcctcttgatcgacgctggtgcttccccacgtggctgtgcacaacatgccatgccttctgtttctagggctctgtgagtctaaacttttcccttcctgacagtcattttcatgcatgccttagcatacctgatgtcattaaatcccaagtacagtttaaaacagccacactgcgagttctaagggctagaacttcaacatattttttgagggggttatcctgttcaacctgtaacatgcaatagcctatttgctgatattttacttgcattccattgtggcgtgacccagtgactagaccccatcgagtaaacgatgaacagacatgaaacacagcatgtcagaaggagaagcttagcagctgtccgttctgtaatataaaccaaggaaaaggcaccgattgcagccacactgaaattacctcattaggggaggcatgagaagattcatcataaggagaaagatttttttttccttttaacggtggcaaaatatgtttacattctccatgtttgataatcttgaacagaggagctgttgtcattgtcttgggaaatatatttgattctgagttctctattaactattgttttctttttctttatttttttctttattattattttttttttggaagaaagcggcagcccagaatctcgtgttaatgcgatccatttcttggtacacaaactgccagagaagaataaagagatgttggatattttggtgaaacacttaacaaagtaagcctctttttcttcgttttaactttcttcactttgctctaggtgctgggtagtgctctgggatttgtgacgggtggaactggggaccacacctggaagggcaggctgaacgtttgactcattgtgtgtgttttggataagactgttgaaatatgctttcatgaagctgtataattatttgcttaacatctctgccagcaactcagggtttgatttgaagtgaaagaagagaatattatacattaccctatacacagattctggaagtgtgaatataagtttgttagaatatttagcttggtttcacacctacctacctctaaatttgaacatgtcctttaagttggcttaattcaataatgggtagttattttatagatttcattcccttttcctcctccttttaaaaaccggcaaaatcaaatcagtggagaaattagccctttctttaagtatagagatcattctaactgtagaattttagacgtgaaaggaagctgaagaacgctatattttagaacctttcttttacatataaagaaaatgaaggtcagaagatactgtgatttgccaagggacctactgctagtttagccatttattcatttggtcaacaaatatttagtgaatgcctttcttaggtgctagtggatacatagttgaataaaatagtctaagtcccagctttcatgaagcttactttctaagggaaaatatgaaaaacagattacaaataaaaatataaaacagcttcagatgataaatagcaaaaacacaaagcagagtaaggggacagaatatattgagtgtgagactataaaaaatgttatgcaaaggctttttgaagatggtatctttgaattgagacctgaattaagttgcagggctgctgagaacagttgtctatgtgattcactgcacagtgatactgggctgaaagagtgattgtgggtgctctgaccaaagtctgcatgcttttacaaaggtgctacgcagtctagtattccttggaagcaaaagtataatattctggggaaagagtgagttttctaagaagaggggaacagtaaactaaggcttttgggggaagcaagattagcacatacagttggctctttgtgagtcctgcatgggcagattcaaccagctactgatcaaaaatccagtattccctgtggacatgagggttgacttttctttatccatgggtttcctgggttgactttagaacttgcacatctgcagactttggtgtctgtagggattctggcatcaattcccaggggatactgagggccaactgtgcatggaattattaagaaagccattgtggttagactagagcaccaaagagagggaagtaaaggagtaggcaggagcatctgcatggagggtttctcagatctggttatttcagaggtagatgttgagggtggttaagtctcttgaccccttgcttttaaggaaatacagagttgcagactatttacagtccacaatttttgctcctttggttaaacagattcctccccccttaccaatttcagtgtttcaaatcactccaagcagaacctgatgactgtggcaaacttaggagtggtgtttggaccaactctgatgaggccacaggaagaaactgtcgctgccctcatggacttgaagtttcagaatattgttgtggaaatcttaattgaaaaccatgaaaaggtaaaattttttttttctttaagagactttgttttcggcttgtcgccatgtactacacaacgatcctcttagatttcccttttctctctctctgtttaaaaaaattctttcattctcactgtgatgagcttggttctaagaagttctcattgagcttctgtcttctgatggagttccataaatctgaaatttatctggtcttttgttatctccctggtttaatgaagaagcatttaatccagatgtaagtgaatatcaaggcaattgtgaactatttaggacttttgttgcttttattcccatctttggatttctcactcaaattctgtgtggcacagcaaccctgtactcttgataaagttagggctttgcaacttacaagagaaaataaggcaaataaggttgaagggatgtgagatggggccagaggaccatgagcatcattgagagtaggggttgaggggcagtgaagccagcccctgctctgcacctgggaaaccgcctgccttgcaaagagtctttctggttacacctagctgttgtgaatgacaagtaaaggaggagaaattggggaagggtaaactcttcaaatatgcttaggcattgcatctggggagcagggaagggtaaatattcctggggtgtggtggatggggttgacccaggtgatccatgttggggtgagcagaaactgctttaatatactcttccctcccaccatacccactcagcatattaactactagaaataagtactgtttatgattgtcactttgggatcactttcccaaattactgttattttctccttgattagatattgtctatggctactcttacgatacaacagaagagtctggtacttgcaacagagaccagatagcccgcaaggcataactatgtactgcctgggggatctgcaaggcttttctgtaaaggaccaatctagagcaataattttcaaccccaacaaatcagaatcacctgagggcctcttgtaagtggctgcatagccatgcgtattctgttaaatttttgccttcccaagaattatgataagtagccagcaagaagaactgctaatctagggaggaaacgtctcttctttattaagaacttaggagaggacttcagtctggaacacgaaaagaaggtttcattaatatttgagagggttttgttcataagagttaaaacaagacctgagtatggcatttgttggtgttagagctggcccatggcagtttgtgtttgaattgagaattgcaaggagctggtgtctattcagtttagctgggcttcatttatatgtagggatgagataatctatgggggaacataaggaaaaaatggttttaggatgctttcggagtgctgttctcaataggaccaccttgagggcctgcctctctcccgctgtctcaagccccctcaaagtaaagcttccacttattaagaaaaatgctgctgactcatagttaaaagtgtacctttatttttataaggatgtaaatacagtttttaaaaacacttattctttagggcagtacttttcaatcttcttgggatcacaggctgctgagaagctgacagaagttattaccccttttgttagtaacccagataaatgcacataaatccttctttccccttaattgttctaacagtttcagtgggctcacctgcattcctgaatctgtggactgtaggttaagtatttctggtttaaaatgaataatctcttaagtgacttgctttcttacttgtttctctgtaatcaagggaaaacatgattttaaataccacattattttctttcaagaacttttagatttttttttcttcagtcacctgtagatgagcactttgctaataacattcctgacttctgcctctaagatggggagcttgaaaactgttagaatgcttggtcactcatttgtttattaaaaagatttttttaaattgagattgcatcatatgccagacatgtagtaggtgccggatgtgcagatgaatattccagctcctgtgggaaagcaggtcgtcatctgggggcggaagccatgttttgggactcggatcctataaacgtaccccagtctaatatgttacataacttattttcttgtctgtttctctctgctaagatccttgaggccagagatctttttgtccacttatagtaatacctggtacatattaggtgttaatacttatggagtgaaataatgaattcaatacattttgagggggttgaaggactgggaaagagacaggcaaacagaaatgtagtccctttggggaaggcatagcaagagtatttcttgggtacttgttgcattggctgtttgctggagcagttctagcttgttgctaatgttgggttctcatggaaaagataagcttgaaagctgattggggattttctttaccattatggtaaaagcagcttgtttatggatgtgagaagttttgttttgcctttttttttttttttttttttgccagtggtggtgaatttatgcctccttttatgatcctgtcaaactgttattaagcctcattagtgtgcactaagccatccagacagctcatggaaagatggctactgttcatttttagaaagaaaaataattagactacaagctttgagacaatgttacagtagctcaacaatcatttgattaaatcctaattaggaaacctttatgcaatttatttgtgaaaatactggctctgggtcttgctcttggataaaaggatctccatttcatgctgcaactgcctgttttcttccctttttgaagctggggagataagtacatgatttgtctgctgggaagtagatagtgctgctttcaccttgttaataaatcttacaggaattttccagtagcgtcggcaagcctgttacaatagttacagcagacgaaagtggcctcgctttcagagctttatagagctaagcagaggtctttcggttttccttctcttcctttctgtggctagatagttctatgaatgcacaaccaacgttaattaagtgctctcaggctttctattcagaagggagcaatggacatcgagtttcagattcttcactgtgtgcttgggtttagggttggaagcagggttgtgtggcagggttggagggttggagatgggggatgtcagtttggattagttaacagttctgagaacctaaatttccccattacctcgccttgtctctcccatttcatctttgaacacttctactcccactcctggctctttgttcctgctcagttggacttcactgcagagtccaggctctgctatgaggaagaatatttttgctgacaagggtgcttgtgcaggaaaacttcatatggatgcgtggatctatgttagccacgggtttccctggcagctgacctaagtatacccttcagaggatcctaacatttgactgtagagtggggagggaaggatctagtccctcttagtgtttcaggacaagatgaaaacgagagagggagtaaggacaggaaaagttgaaaagagtagtctgagaaaggaaaacattacagtaatggatggcggtggggggagggtgcaaaaaaggaaggttaaactggggaggaaaggaagaggcctatgtgtgtcactgacagtggctctgacaggcgaaaaatggcgagaaggaagtcattttcttttcctcagttatttgtttttcctccctaagaatgtgaaaaatgttgactccaggaaagtcactaaagcaaagaggaaacttcaacatgtaattaaagcaagattgctctagatgaatttcggagttagaaaaaggctcctagttaatctgctttggagatgacaatttttcctagcctccttgctgtttttataaatctgtgtatactttataggaaacttaatccatatgttttagctttatttacacataataaagatgtagactgagcatggtggctcatgcctgtaatctcagcacttcgggaggccaaggcgggcagatcacctgaggtcaggagttcgagaccagcctggccaacatggcaaaaccccatctctacttaaaagaaagtacaagaattagccaggcgtggtggcgggcacctgtaatcccagctattcaggaggctgaggcagaagaattgcttgaacccaggaggtggaggttgcagtgagctgagattgcgccactgcacaccagcctgggtgacaagagcgagactctgtctcaaaaaaaaaaaaaaaaaaaaaagagttcctgggccaaaatattattaaggtctttcttcctttgttaacgagaaaattttatttcccaggtggcaaagggtgctgtgaacttttcaaggattttcaaattggggttgtgccttaggatttgtgagttttgcataagttctgttcttaacagagtatacttgttatgcattaatttggtgcattttttcccccagtgcctgctgtgagtcattcatggtgtgagatttgggggaagtaaagacagtccagtaggggaaagaagaaatgtccaaaagtagctacaagatatggcagagaataagcgctttgagagagagacagagagagaatgagcgagaaagtggcggagacttcagaggagagtttatgttcagctgcagggaatctggaaagtttccccagtaagtgttttgaatcagttttataatggagtttgaacaggtggagatgttttaagaggacatttcgggtatgggagaccatgtaatcagagaaacacagagaggaggtacgtgttctgggaatgcagctcttgttggaacatgggcaaatggcaggagatgagattggaaagagattcgggccaggtgtgggaggttgagaatgccgctttaggacttttgcatttacttttataggtactggggccactcatagttttcaagtaaactgcttcacaaaacttaatctgacagcaggatttgcagtaggaagtagaggaatgaaaggctaggagagaggttatttggcatagtcgaagggcatgggagtgagaatggggagttccagggtggacagcatcatttggtgaggtggaataggcaaaacccggggactgggtttgtaaggggtcttggggaaggtgtgatagagattcaatcctgggacaatatgggtgtcactaataaaaggaaggaacaaaggggtttgggggaggagtaagatgagttcagtttgtcacatggtgaattgtagttatctgttcaagataagtccattagacagagatttggtgctcaaacttatgagtgaatttaggggtagaaagtataacgtaaggtatagttaaagacatgagattggcgtaagaaaatatttattggatgctcatgatgttacatgctttgggtctactataaagggtattaatgtaattctagtgtatgaggatgcttctttgtgtatccatacacttaaaaatatatatataaaacataaaattcccattgcataaatatatgtaatagtatccctgtatgggtgaaaattcttatgtatattatctctttatacatctgagagaagtgaggggtgagagcttaacttgctcatgagcacacagctagtaaaagtgaagtgcttgggtttgaactgagattgacccccaaagcctttgcttttcatcactaggagaagacagtaatatccttgagaaacaccaagattttcctgttaggggtaatagaggagccagaagaaacccaggcaggatcaggtcagtgctagtgtcagggttgtctagggccttgtcaaggatgccagatacgtcccatgagatgggcaagtatgaggacaggctagtgatgtgagctcatgaaccagtggcatgagtgagctctttcaacagtgacatttcttttttttttttgagacggagtttcatgcttgttgcccaggctggagtgcagtggcatggtcttggctcactgcaatctctgcctaccgggtccaagtgattctcctgcctcagcctcccaagtagctgggattacaggcatgtgccaccatgcctggctaattttgtattttttagtagagatggggtttcttcatgttggccaggctggtttcgaactcctgatctcaagtgatccaccggccttggtttcctaaagtgctgggattacaggcatgagccaccgtgactggcctaatggtgacatttctgttgagagccagagtgtggatcaacttgtaagatgtatgtgaatgagtgtttcggaatgagtgatattcagtgtcaatttttttttgttgtttttgtcatatgacaagaataaagcaggaggaaaagccagaatagacatggaggggaaggacagagcaggaccactagtgcctgagttttacatggctcactggtcaccctcagagtctagtgacctgttagcttatgtctgaggtagggagttctttagaggaacttaaacagggaatgaaccctctcaggagtcactgagtctgtgtagattgagtctattatttatttttaattttcgtgggtacatagttggtgtatgtatttatggggtacatgagatattttgatagaggcatgccatgggtaataatcacagcaggggaaatggagtctccaccacctcaagcatttatccattctttgtgttacaagcaatccagttatactcttttagttatttttaaatgtgtaagaaattattgttgacttcagtcatcctgttgtgctatcaaatactgaattttattctatctaactgtatttttgtgcccattaaccatccctgctccccccgccactgctcactaccctccccagcctctggtaaccatcattctgttctctatcttcatgagttaaattgtttcagttttttgctcccacaaataagggagaacatgtaaaatttgtctttctatgcctgacttatttcacttaacataattaccttcagttccatccatgccattgtaaatgacaggatctcattcttttttaaggctgaatagtactccactgtgtataagtatcacattttctttatccatttgtctgttgatagacacttaggatgcttccaaatcttgatgattgtgaatagtgctgcagtaatcatgggagtgcagatatctctttgatatactgatttcctttcttttgggtatacacctagcagtgggattgctggatcatatggtagctctatttttagttttttgaggaacctccaaagtattctccataggggtacattcccaccaagagtgtacaggggttctcttttctctacatccttgccaacattttttattgcctgacttttggataaaagccattttaactggggtgagatgacatctcattgtagttttgcttttcatttctctgatgattagtggtgttgtgaacattttcatatacctcattcttatattttatacattataatgtaataaaaacttttgtttgtaatttgactccctcctcatctccccccacttcctaagggcccttgaagattctgaagagcctgtgaaaagcatcaaagatcatattaatcagggtggttttcttttaatatctgtcttaatactgaaaaattggcaatttataaagtaaggaatataatgttactctcagaattacttaatataagaatacaattcagattacattgatcttattgagggttttaattggattttcaatgagatatgtaaaatgtgctttggttgaccttagctttgtgtggtacttcagtgtgctctgatgtttcattgatttcctgatgatcaggaggttttttcctagtactagcctgtattagtctgttttcaggctgctgataaagacatacccaagactgggaaatttacaaatgaaagaggtttaatgggctcatggttccacagggctggggaggcctcacaatcatggcggaaggggaaaggcatatcttacatggcagcagacaagagaacttgtgcagggaaactcccctttataaaaccatcagatctcatgagacttactatcatgagaatagcacaggaaagacccacccccatgattcaattatctcccactgggtccctcccacaacatgtgggaatatgggagctacaattcaagatgagatttgggtggggacacagccaaaccatatcatagcctttatgtattacagtttttgtggatgactttgtgccaagggacaattacatttcatgtacattaaacatttcctggacaaggattctttataactttgtaataagcattttagcctttgtaatagggattgtggtagaatgtgtcttttttttggtgtgacagtggaggccattgtggtggtcttgctttgttgaaatggctgatggccttgtactgcccagaggtgtcttcatggcactttgatttatccttgtttgtaacatgtgcttcaaagtccccgagtagtgtgtgtcctccagtcacggaggagcctagacagagcagtagggagaagggcatatgtgtttcccatatgtcttagtctgtattgtgttgctataacaatacttgagactgggtaattttgaaggaacagagatttcatttcttacagttgcataagctggaaagcccaaggttgatgagctgcatctgccaagggccttcttgatgcatcatctcatggcagaaggacaagagaacatgtgaaaaaggagtgacagacagagtgcatgtgcaagtgagtgagggccaaacttgcttttctaacgaactctcttgattacaaacctatgcctgagataacatgaatccatttgtgagggcagggacctcatgacctaatgacctcttaaagctcacatctctcaacactattacattgaggattatgttttcaacatatgaactctgagggatgcagtcagaccatagcagtgtccaatgtaatcaccagaataatgttacgtgcacatatagaggagtatcacactgtgttgtttcactcttgttaaccctgcaaccaactttatgacctgcatctacctctctttgccacgatcagtagaatgcattggtgctcctaggttcattggtgtaattggattcccattcagtctcaacttgctgctgtcccagtgacagccacatgtgggctgtttttgatgaggagtatccactgcttcattcctgtggctacaaacacaatatatgtcctatccctcttccgtaggttggtctctgtcattctttaatatataaagagattgagtgagtaatatccaaaccattttccatcaagtgcaagagtcttccagtcttacagcatgcttgccatttaatgggaaaaagaaatctctttaaaaaacatctagccaaaaatgcttcttgatttagctttgctggcactgggttgctaggcagcactagtttttatgtgagagaaaaataaatgtcttaaacaacaacaacaatagcagcagcaataataaagctgcaaagtttctaaaagctttgtgtctgcctgagtattgactgttcagtgtagaagtcaaaatcccatagcaagaatatttgacaaattttcagactcccccccatccccagttttcatgaatgttgacttgtttggcattgctatgaaaactttactgttttgtgtgtggtttttttttttttttcttcttctcagcagggctttgcattttctggagtgtttaaaaagagactttaaaagcacaggaaactttctgtcttcctttctctttcctttaaggagagaaggaaaataataatgacattgtcttccttattctgtttttctttagctgtggcattggaagcttctgctgtcatgtggctctgtaaatggtagattgtattttcccttgggaccagagtggtttgataagagcaaatttaggagagagtcattctgcatcattttagtgcccagtatagacaaagcactggggaaaattgaagggctccaatataaagtgtgcatagatttattctgtgttgtctgagaaagcatactgagtacaagtgagcagtacttgccatgaggtgagtttttgattcactagaaagaagaacttcgtaatatttataataatgagaacatgttcatgttagggatgggattgaggtggaagaaagcaggcctctgaggtcctgcccactctgaaattttctgcccaagcatctggagatgcggagctgcaaagagagctcctcggagcctagcttagtgtttagaacttggcattcaatcagtatttgcagaataaaaaatgatgatgaagaatatcaccctattcttcattgcatttttaggttgtttatattcccaggaacaacaagactacttggaagggaagataggaaggaaagaatgagagggcgagtgtggtggcgtatgtgtaggtcggctccagggaaggcaccatcaggtgccttttcttgaggggagagggtagtttgggtatatatgggcttggttttttgccttgagctagtgctcactatgtattttttctttgtaaaataaagcttttagagctgtcttttttgtatctctcaagataaaattgggagcaataataattataatagctaacactgattgaaagatgattgtgtgccaggcactaggctgggctccttatatgacatttaattggacattccatagacagtttagtataatatggcatagtaggctctaaagtggaattcctggagttgaaatctcagctccactcaattgtgtgactttttttttccattttattttagatttgggggtacatgtacaggtttgttacagggatatattacatggtgttgaagttggagctttgatcctgtcacccatatggtgaacatagtactcaacaggaagtttttccaccctttctctctctctccccctccccctccccttttggagtctccagtgtctattactttcatctttatatctgtgtaaacccaagatttagcttccacttataattgaaaacatgtagtagttcgttttctgtttctccattagttcacttaggataacagcttttagctgcatccatgttgctgcaaaggacgtgattttggttttttaactttgttgctgcatagtattccgtggtgtatatgtaccacattttctttatccactccactattgatgggcactctattgattccatgtctttgttattgtgaataatgctgcgattaacatacaagtactgcatgtgtcttttgggtggaatgatttattcatttattttttttggatatatacccagtaaggtattgctgggtcgaatggtagttctatttttagttctttgagaaatgtccaactgctttccacaggggctgagctaatttgcattcccaccaacagtgtataagcattccctttttttcccacaacctcactagcaccttattttttgactttttaaataatcgccattctgactggtgtgagatggtgatatggtttggctctgtgtccccactcaaatctcatgttgaattgtaattcccagtgttgagggagggacttagtgggaggtgattggataatgggggtggattttccccatgctgttcctgtgatagtgagtttttctcagatctgatggtttaaaagtgtgtggcacttccccccttgcttgctcactctctcctgctccgccacagtaaggtgtgcttgcttttccttcgccttccaccatgattgtaattttcctgaggcctcccagccatgcttcatgtacagcctgtggaactgtgagtcaattaagccccttttcttcataaattacccagtctcaggtagttctttatagcagtgtgagaatggcctaatacagatggtatctcattgtggtttcaatttgcatttctctgaagattaatgatgttgaacaattttttcatatgttttttggccatttgtccgtcttcttttgagatgtgtctgttcatgtctcttgcccactttttaatggggctgttttttcttaattattcatttcagttccttatagattctggaaattagttctttgtcagatgcatagtttgcagatattttctcccgttttgtagattgtctgtttcctctgttgagagtttcttttgctgtgcagaagccctttagattaagtcccgtttgtctgtttttgattttgttgcatttgcttttggggtcttcataaattttttgcctaggcgactatctggaagagtatttcctaggttttcttctagaatttttagagtttgaagtcttacattcaagtcttgactccatctttagttaatttattgtatatgatgagaggtagtagtctagtttcattctgctgcatagagttagccagttttctcagcaccatttattgaataggaagtcctttcccccttgttttttgtcagctgtgtcaaaggtgacttggttgtaggtgtacggctttatttcaggggtctgtgttctgttccattggtctatatatcctatttttgtgcccatactatgctgttttggttattgtagccttgtagtattgtttgaagccggctttgttccttttgcttaggattgccttgactgttgaggctttttttttcattccatgtgaattttagaaaagtgttttctaattctctgaaaaatgacattggcaatttgatagaagtaatgctgaatctgtggattgctttgggcggtatggagattttaatgatactgattcttccaacccatgagcatggaatgcttttccatttatttgtattgtctgtgatatctttcagcagtgttttgtagttcttctcacggacatcattcactttcttggttaaatatatgcctgggtttttgtgtaggtgtgtggctattgtaaatgggattgcattcttgatttacttctcagctcagatgttactgatataaagaaatgttgatttttatctgttgactttgcatcctgtatcctgaaactctgctgaagttgttaatcagatctagtagtcttttggcagcatctttagggttttccaggtagagaatcatattgtcagtggagacagataatttgacttcatcttttcctatttggaatgcctttgctttctcttgcctgattgctctgggtaggacttctagtatgttgaataggaatggtgagagtggacacccttgtctagttccggttcttaaggaaaatgcttccagcttttactcattcagtatgatgctggctgtgggttcatcataaatggcttttattattttgaggtatcttctttcaatgcctagtttgttggtttttttctttttatcataaagacatattggattttatcaaatgctttttctgtgtctattgagatgatcatatagtttttgtttttaattctgtttatgtggtaaatcacatttattgatttgggtagatgaaccactgctacatcccaggaataaagcctacttgatcatggcaaattaactttctgatatgctgctggatttggtttactagtattttgttgaggatttttgcatctgtgttcattggagatattggcatgtagttttttgttgttgttttgtcttttccagcttttagtgttaggatgatactggtttcaaagacagggtttggaaggattccctcctctattttttggaattgttccagtaggattggtaccagctcttttttgtaagcctggtagaatttggctgtgaatccatctcgtccagggcttttcttggttggtaggttttttaaattactgattcagtttcattactccattatcggtctgttcaggatttctctttcttcttgattcaattttgggaagttgtgtggttgtatgtttccaggaatttgtctacttcctctagattttctaatcagtgtgcatagagatgttcatagtagtctctggagatcttttctatttctgtggtatcggttgttatgtcacctttgttatttttgattgtgcttatttggatcttctctccttttcctttgttaatccagctagcaatcctatcaatcttgttaatcctatcaatcttgtttatcctttcagagaaccaacttttcattttattgatctttagtatggtatttttgggtcttggtttcatttagttctgctctgattttagttatttcttttcttttgctaactttgggtttagttcttgtttttctggtttctttaggtacaaggttaggttgttaatttgagatctttccacttgatgtaggtgttttgtgcagtaaacgttcctcttaacattgcttttgccatgtctcagagattttggtatattatgtctacttttgtttgtttcaaagaagtttttgatttctgcattaattttgtggtttacccaaaagtcattcaggagttaagttgtttagtttccatgtatttgtgtgttttttagagttgctcttggtattaatttctatttttattccattgtggtctgagaagatgcttggtatgatttcagtttttaaaaagtatattgagacttgctttatgattcagcatgtgttcagtctttgagaatgttacatgtgcagatgaggagaatgactattctgtggttgttgggtattctgtagatgcctattaggtccggttagtcaagtgttgaatttaagttcagaatttctttgttcattttctgcctctgtgatgtgtctaatgccatcagtgaagtgttgaagtctcctcctattattatgtggctgtcaaagtattctcttaggtctagaagtaattgttttataaatctgggtgtgccagtgttgggtgcaaatacatttagaatagttaaatcttcttgttgaatttaaccttttatcattatgtaatgctcttacttgtccttttttttactgttgttggtttaaagtctatattttctgatatatgtataagagtagggacctctgctctttttcgattccatttgtgtggtagattttcctccatccctttactttgagcccaggggcgtgatcatatgtgagatgggtctcttgcaaacagcagaaggacggatcttggttttaaaattcaatttgccaccctatgtcttttatttttagtcttttttcaaaagacagggttttgctccatcacccgtgctggaagtgcagtggtatgagtatgggtcactgcagctttgacttcccaggctcaagtgatccttttgcctcagccccctgtctcttctggtttataaagtttcttctgtgaagtcagctgtcattctgatgggtttctttttataggtaacatgatccttttctgtagctacctttaagattttttcttttgcgttgatcttggaaagtctgatgactatgtgccttggactcggtcgtcttgtatctcacaggagttccctgggtttcttttctttctttcttttttttttttttttctttttgagacagggtctcactctgttgcccaggctggagtgcagtggtgcaatcacggctcactgcagccttgacctcctcccaggctcagacaaccctcccatgtcagcttcctaagactgtagctgggactacaggcatgtgccatcacacccagctaaatctttttttttttttttttttttttttggtattttgtgttgagatggggtctccctatgttgcccaggctggtctcgaactccttggctcaagcagtcctcctgccttggtgtcccaaagtgttgggattacaggtgtgagccaccacacctagcctggatttcttatatctgcattttaacctctcaagcaagattggggaaattttcctgaattttatccccaaatatgttttccaagctgcttattttctcttcttttctctcaggaatgccaataaggtatacatttggttgttttacataatctcgtatttctcaaatacttacttactttcttttttttcctgaattttcgagacagggtcttactctcgcccaggctggagtgcactggtataatcacagctcattgcagcctcgactttctgggttcaggtgattcttccgcctcagtcttcctagtagctggactccaggtgtgcatgaccatgcactgctaagtttttgcattttttgtagagatgggggtctcaccatgttgcctagcctggtcttgaactcttgggctcagaagatccacccgccttggcctcccaaagtgctgggactacaggcatgagccatggtgcctggctgctttgttttttttttttttttgaagcagagtctcactctgtcgcccaggctggagtacagtggcacgatctcggctcactgcaacctccacctcccgggttcacgccattctcctgcctcagcctcccgagtagctgggactacaggcgcccgccaccacgcccagctaattttttgtatttttagtagagacagggtttcaccgtgttagccaggatggtctccatctcctgagctcgtgatccgcccgcctcctcctcccaaagtgctgggattataggcgtgagccactgcactcggcctgttcattttttaaaattctttttttttttttcaaatttttgtctgggttcatttgaagcactgatttttgagttctgaaattctttcttttgcatggtctcatctgccgttaagacttccaactgtattttgaaattcctatagtgaatttttcaattctagaagttctgttttgttccttcttaacatagctatgtcatcttttgaatcttgagtcgtttttgtgttgtttcttgtcttggatttcaattttctctttgatcttgttgcatttctttgctatccatatcctggattctttatatgtcatttcagacattcattccggttagaatccattgctggggagttagtgggatcctttgaaggtgacaaaacagtctggctttttctactgctggagttcttatgctggtttcttctcatttgaaagaactgatgttttcttttttttgattttgttattgtttggatgagagttcttgatttttttattctttttgtccttggggctgttactgtggtgtatattgtgtgtgattgtttggctacgtttctgggtattttcagagttccaaggctgtttatgagttccttggttgcagagaggttcctacagtggctttctcctttgttgcttgtaggggtgtaattttgtttggtggtgttgtttaagctgcagtccagtagatggcgcttaagagtaatagctgcctggggaatgggcagagggaggcaacagagaagcatgaaaagcgccctcccccagtacacattcgcgttcagcggctggagccactggagaagccccaggaagcagtttctttcagcccaaactctccaggccccagcaggaggacgcactgccaagtccgccacagcacattgaggaggcgggaagggagtatgagacgaccctctctccatgttcgttccagggctgtggtggtgccacctttagcggctaatgccatgcccgtgtttcctttgacccacggtggcctttggaggctgtgctcccacctcccttgtgggaggaccacaccaagagttgggtctccagatctggctgttttcactggcaaggtgtctgtttgagttctgtggttataaatagcatttctgtggtggcttgtgagcaggctcactgcctcctgtaggaccagggggcagtggtctcaggagactaacctcgttcctgagtgctgtgtgcttatgtctgatttcttattgtgttgtgccattcaacgtccaggccaagaagtggcttttgggttaagagccagctgtggccaatatagttgagtagaaacttgatccttgtttactggggaaactctctgttgcctcagggccaatctgtggagtgcacagtggtctgagcgccctgctccaacctggaggagggcttcaagatgggcaggccagaccaggcaggcccacctacaggtcccccaatggcaggtccgagcatcagctttgaggggtggtccaatgggtggctactaggcacatagagatgtgcctaggtgtggagctgggaacctcacctggtctcaagttctctgcatgaggcagtggagctgcctaatctcatccaggagagtgggtcctccaggtgccaggagatctgcttgggtatggagcagagagggccctgctgcaccacagtctctgcacaagaagggaagggtagctctggctgcagatccaggcaagtgggtgctctgaatgcctggagatactcctgggtgtggggaagagagggcctcactgtaccacggtctctgcacaggaaagatgggtggctcaggctactgatccaggtgagcaggtgctctgaatgcatggaaatctgcctgggggtggagtgtagaaggccctgctgcaccataacctcaggagaggaggctgggcacccagcagggacacatgcaaaccagttccaggccaccaagctggctctgtctgcacgcctcattgcccagataaaccatggctacagcgactctcctcttacttttggacctgtgatgggggagagcacaattctagtacctactgttgggttactttctatatttgttgctcagttttggctgtggaggcctttcccctgctgcagagcaaatgctgcaatatttgatccaagactaaattgtctgcatgaccacactgccaaattgctgaagaatgactgccttgtttgagcctggattaaaaatggcatccccttgtcattcctggttctgagaaaatacatgcagcttttctcagtgtgtccgtctcagcgtctgtaagcttttccccaagttagctccaaggctgaagagaaacaaagtgctctccctcggcctgggttgcgcggatccctagcagtaagggaaatgacagcgggaggtcctctgcctcttatgtattgaggcttcactcacttttaccagccagatgccatcatggaggctgtttgcccaccttctcctctctggagtctggggtgtcctttgctgttgaagtggatttccgttttcctgtttgaattaaagctcacagggtttatctttatgcactattttgctatttgcaagtggctgaggtatgcggaaagcctctcatctgccatcttgggaaaaaaggtcatgtgacttttgagggacttaagtgaccggtttaacctcattatcagtttcctcatctatgaaataagaaaaacggaactacctccctgatggagtggttacagggatgaagtgagctactccatgcctctcactgccatttccaaatgagacacatgaagctcatggagggtcatcaacttgctcgaggttatagaactaaaaatggccaaactgggatttgagcccactctgtttccaaagcctgtcccttagctcttccactgttgttgtctgatgaagtatatacaaatatatgcatttaatattaaatgactgcaattacttgtttgcttttcgagaaaatcaaggggttaactgatttttacagctagagggtaatgacaggaaagcaaactcctctcccctggtcacctaccctctcctcatactgcttttagtgtgctgtctccagggtgacgtacaccccacagccaagacagtctctctaggatcttcagacagtgtcaggcctctctggttaccatcttcctcctcatcttcatcaccatcaatataattcatatagaataagagtatgtctcacatttactaagtgctcatattctgtaaagtacatcatgattcagatcctgctcaacaactctgaaaggtagacattactttcatccctgctttacaaacggaggaaactgaagtttaggtgaagaattttgccaaattcacatagttggtaagtggggattcagacccaggctgcctggctttggaggtggattcttaagccctagactctgctgctgctccttccattcgaaatggctttaggtaaaaaccttttgtcttcattgtgactgtttaataggctacactgatcctcagaaacagcagataacgggattattgcggattgaactgaatcactgaaaatagaatattttgatgtctcaaatatattttcagaaatctaaaattataccagatagactaagtggggaaagataaacatggagtatcacataatatatgaaaaactaacttttctaaactgtaaacaaatgtattgagaataagctacatgctttcagcaaaatcattgtaattaagaatgataaagtatacattaatacatatactgttgaagcttctataatcatatagccatttacatcagactaggatacttgtagagaagtttttaaaaaattttttctggaatgatttccttccccttctagatcggcaggattgggagaagggtatttttctagactctgaacgcatagccacttcctctttttacctttttctgggtccctcctcagtctgtagtgccctgtagtcatttggtacaagtatttccttcaggcgacagcccagcagcactgagaactgctcactgtggacatgaacccctcctgctgtgttagtgaggcttggtgcctgtcttctctgggtctgctgctgacacagagctaagcacatgaattatcagactgcgatctgagctgagacagattctctctgctagaaattgagaattaggatttggggagactgagccagttactatgaggttgtctctgggctttggggctgaagacatctctgtgctgggtcaggtgtaggcagaacagagaaaaggcagtgatggggagagaatctggcagctcctcaggagggagaagaggagtgggagagaagtggagacttgctgccttgactcttgatggcctctcattactaatccaaggcagtcttgagtcccagctcttgttacttcctgctgattccttttaataaatccacttttacttatgccactttggcaaagttttggttgcaaccaaatcatctctccagcagtgtgagaaaatacagagtgtgaggcacttgcagttcaataaagttacagatacatagtttactcagtgagtttggtttaactcagtgtagtttttatttcccttactgcaggtgtctcctgcctgtccctgaggctggctgcttcttaggcccagtccttaggaaaacagatggagcgtgtgtgtctggtcaacatagttttaggtagaaactggctctttgaagccattcaaacctgagcctattggttgactcccaaaattttatggctaaaacttgtttaactttatttttcagttttctcagcccacagtttaaaccagaagtagctttcctctgaacttccactaatttcatttactagatcatgttttctgagatcttagtctctattctgtgccttgcattcttccacatctcctggctggtcctctggcctgccggtcctttggtcaggtagcattttacagttccctcctccatctgacagccttttcctctatctagctctgaagctttagtacattaagacccactttaaaaatgtgatgagagctttgggttctgtttccagaaaattgaatgtttatatatacacacacaccaaaaagtgtacactttcaggaattttggggacttctcaggttaggaacctagaaccctggggaaaccaagagctgcaacatgatccataaaaaaatggggtctagaacatttcttcagagtcagcctttgtggccttttagtgttgacttttcccccacacttccgtgtaggaactgagaggagaggaggtaaagatgcccctcacctcagactcatgctttattctgtcagtgatgctgtgttcctttccccacctggggccagccaccaaggaaacctcctattaaaataatcattcctgagtttggccatggaaggtatgagcctataccaaaagacgttctacttaaataatgtaagatacccaccttccattgttttggatgctccttatcggggacctgccccgataatcacgtaggttcttctctattttcctaagtgtcgactggcttgagaaataaaaggacagagtacaaaagagagaaattttaaagctgggcgtccgggggagacatcacacattggtaggatccgtgatgccccacaagccacaaaaaccagcaagtttttattagggagtttcaaaaggggagggagtatacgaataggtgtgggtgacagacatcaagtacttaacagggtaatagaatatcacaaggcaagtggaggcagggcgagatcacaggaccacaggactgaaacgaaattaaaattgctaatgaagttttgggcaccattgtcattgataacatcttatcaggagacagggttttgagatcaaccggtctgaccaaaatttattaggcgggaatttcctcttcctaataagcctgggagcggtatgggagactggagtttatttcacctctgcaatcttgaccataagagacaggtacgccctggggggaccagttcagagacctacccctaggtgcgcattccctttctcagggacgttccatgctgagaaaaagaattcagcgatatttctcccatttgcttttgaaagaagagaaatatggctctgttctgcccagctcaccggcggtcagagtttaaggttatctctcttattccctgaacaattgctcttatcttgttcttttttcagggtgcccacatttcatattgctcaaacacacatgctgtacaatttgtgtagttaacgcaattattacagggtcctgagatgatatacatccttctcggctgacaggattaagacattaaagcaaagacaggcataggaaatcacaaggatattgattggggaagtgataagtgtccatgaaatctttacaatttatgtttagagattgcagtaaagacaggcataagaaattacaaaagtattaatttggggaactaataaatgtccataaaatcttcacaatccacattcttctgtcatggcttcagctggtccctccgtttggggtccctgacttcccgcaacactcctgatattcagccttctgcctgaatgaggaggaggaaagaaattgattggagggcagatgaagaaggcaccccgtccttcaggtcaggtcttcatggtgcaacctcattatctcatttgaattcttacgaatgtctcccaaattcaaaacattcagaagcacaaatgctgcatttagttagtgataaccagtaggtaagcgtttgcacaaatctcagttcctgtatctttggaatggcaaacagtaacatcctacctaactaaacattttgacgaatgaatgttagccagaaaatggctaaactaagggctaacagtcttagctcaggcacactggggcatgacagttctagttctgctagacttcaattaatcttccaatttccaagataactaaaagtcagagtgggcaacgtggccacttgatgaagcgggcctctacagagggtcctccaaataggagtctttcgatggaatcaatccaaatgcccatgagtggtagaccagataaagaaaatgtggcacatatacaccatggagtactaaaaagaacaagatcatgtcctttgcagcaacatggatggagctggaggtctattaagtgaactaacataggaacagaaaattatcacatgttcttacttatgaacaggagccaaacattgagtacatagggacacaaaaagggaacaacagacgccgaggtctacttgagggacgagggaggtcggagcacgaggatcacaaaactgcctattagaccctgggcaacatggtgaaaccctgtctctacaaaaatacagaaaaacgggcctggtgttgtggtgcatacctgtggtcccagctacttgggaggctgaggtgggaggattacttgggaccaggaggtcgaggctgcagtgagccatgatcacaccatacactgcagcctgagtgacagagagagaccctgtctcaatagaaaaacaagaaaaactacctattgtttactatgcttttcaccttggtgacaaaataacctttacaccaaacccccgtgacacacaatttgtctatataacaaacctgcatgtgtacccctgaacctaaaaaaaaaaaaaaataaataaaagaaaacaaatagaagtctttccattaggtctagggcccgcttctctgggtatgttagcggtccttagggccacgtctttgtctggagatttactggaaggacccgtgagactctgcatttagttgcactcacagttagattgaaggcagccctgtagtgagaatatgcagccagatcataagagaaaaagacacaggtggcatctgcagcaatccaaatccacatcccggcttcctcatgttttttcccaggaggggccttacggagcttactcttccccagcaacaaaaatgtagccccaagtggatgatgtttcagtccaagaaagcccaggtattagagactaagtgcccaaggtttttgttgggagatagtcacatgcgcatcctttacctagtgtgtaccaaaattccaggctcccagaaggcgaggaggtattcagcatgacaactgcacatgcacagttttgtacaaacagtttgggcacatgggatacaccctaaccatttagggaatgttttatatcagtttatagaactgtgtaccagccaagttcccagatgccaaaacaggtccaagtttgcaggcaggcctttctaaggatagtaggctcaggcctgctgtgtttactctttttctgcacgctgagtaccttttaactgccgtagtgaggaacttaggagcagggaagaggatgacattctggttctcctgcaaggatgctgtcataaagattcatagcctttcctcttttgctttggcagggtctccccgttctataggtgaagtgcgaattgtcagccacattcaaaaagtgcaggattaacttcagtgtggagcctgggaatccagaagaatgtggccattacgggttaaggaaattacaagccatgcagtcttatgtcactggattaatttggcacaggatgaaaagtccctcaaaagcgctccttgttttagctttccagttggttgatttctctttgagagtgaccctggagggcagaatcagctctgtgagctttctttctccttccacccctaagcctgattgcatgctgtcgttcggtccccacattttttggagaagccaggtgttgccacgtttgtcctgctctctcgtctacatctggtcaaacttcccccttcacactgagtcacactgaccacccctcccagatctgctccctctatttgtcttttggatttttctctaaaaagcgttttattttgtatttttaaatttaattttttttgtggaggagtctcgctctgttgcccagcgtggagtgcaatggcgctatctccgcttactgcaacctccgcctcccgggttcaagccattctcttgtagccctcctgagaggctgggattacaggcgcccaccaccaaccccagctaatttttgtatttttaatagagatggggtttcaccatgttggccaggctggtcttgaactcctgatctcaggtgatccacctgcctcggcctcccagagtgctgggattacagacgtgagccattgcacctggccgaaaaagccttttaataaaaaggtttaaaacaatttctagacttctgccatccagtattagtgccattttcctcctcccatgagccatcttcaattcatttaagatggccatggaaggtatgagcttgtaccacgggactttctacttaaataatgaaagacacccatcatctattgttttgcgatgctctggtattcagccttctgcctgaatgaagaagaaagtaagaaactgattggagggtgtattgaagaaggcacctctgtctttcaggacattattagtcattagtcattactacttcttatgcagatatttgtagaattaccttctttctaatatcttacctatgcatacctaattcataatgatttgggagcagggtttggcttttgcttttgtttatatcttgttctttcttgaccagatagtgatgaattcttttgattgtcatgcagtattctgtaagtttttcttgatatgacagagatacatttatctagaattctagagcagagtcaaacctaatcattggaagctctaaagatctgtactctgcctggaatttgcttcacaataattttaagggtgggaatatagatgaactaagattggtcatgagttagtaattgattcggctaggtgatgatgtatgtaggagttcattatattattctttttccttacatttatgtctgaaattattcataacaatagttaaatgacctgatacttgttgctagcatccttgtatacaattattaatttattcagcaaacattaagctgctatgtgaacaggtacaaaagattaaaaaagcatgtcatgctttctagaagtccaatatttagtgagaaagtcagctgtgcaactgtgacacagtagaaacccagtagcatggtctggagatcgtctgagtttggacctacaaggagcctgtcgtttgctttgttcaaagccaggttaacaccatttctgcaatttaaagacttcgtgtactaagcatttatttgtgagtcaacatagttgtgtcttcagaagatttacctattccattcacagtagtaggcctgcagaggatataatggatataattatgaaatacaaaactctttttcctaagcattctagtctgcttgggggagagggtaggcattaaaggctcagtgaggagctggtgtttcagacatgggcaagctctagttcatgcaaaccgtgaatcaacagccaaccctgaaagggtagatagtattgatgtatctgcagtttacagatcaatgcaagaaaatgaagcttggagagctgaaattaacttgcccaaggtcacacagcttgctttattcatttatagcctgacttcttccaaaagggatttcgggcagctaagccacacagttagaaagttccttgtggtctttctactgtcccaagaaaaacaaggctgtatttttttccttttgagcttaaatgatgcatagtgtttcagtcaacattactacatggatggcttcaagtttaaattgcacaaaagtgcttatgtatgtctctgttggaatgtgtgggagtaagaaaggaaatccctgtatttgatttcataaagtcatgagctttatatagttgcttgagccacacatgccggtgcctggctgtgtgcacaagaaagttcttgttaatccttgcacagctggtgtggtgtttgtcgtcattattacttattcttaattaccagaagtgcacatgggctacagattttagcctgtgccaaagtaaatctctaaagtagttggattaataggttatggggaagatttataatcctttgtgaatgatactaattctgtatatgttcatataaagaaacagttgacatcagaaactcaaaatgtagatcgtaatctcaatgttattctcaatatccatctcctgtactctttaatttgttgctgaatcaacattgctttattcgtagattgaaaatggaatttatttctaggctatcccattcttaggcaattgtctgtctttctctgccccagcaatacgtaaaagttgaaacattctcctaggaaaggcttcaaatacttgatttctctggaatgtcatttatgtttaggtggaaatggggggaaatgaccgctaagaggattagtcattattttcatcatttaatgaaggaattagattatttgtgcttaatgtgctaataagcacagagtaagctgtacttattgatgggtcgacgtggaaaggtcctctgagtgagaattgtttcttgtgtgtaatcgtattattctgtggttcccgcagaactgtgtttctagggccacagacagatccacagtgtaacttttttggaagtctatgtgtttttatccacattctatgtaacttaaaacccttttactttattttattattgagatagatccaaactgttataaattgtttttcattctccattgctacccattcttggcagccttcccattcattcctctaggtcagtgataaccagtttttatgtttcacatccttttgaggatttgatgaaaaataatccactttctgaaaacataccagtgcgtatacaccattcatatacgatttaagggcacacagtacctccaaagtctatgaatagacttggttagaaaccctggctctaggtgaaaacagcaagggtgatattaaaatactgtaataaaaatatgtgatctacttacagtgtggagtgtgggaggagtagggaagcttatcaagttagagcttgccacatgttaccgtatattatgttttccttatgtatttaccagcattatttcttgtctacttattattatctaaaacagatatctcaaacatgttttaagatgacagagtaaagacagatttgtcagccttacaatacagaccaccagtaggttagaagaaaaaataataacctggtatcagtcagagacaaaggctagagaccagcaaacaaaatttccaaaaatttgcatggtccatctctctctctttttttttcatgacggagtcttgctctgtcacccaggctggaatgcagtggcgcgatctctgctcactgcgagcttcgcctcctgggttcacgccattctcctgcctcagcctcccgagtagctgggactacaggcacccgccactacgcctggctaatttttttgtatttttagtagagatggggtttcaccatgtcagccaggatggtctccatctcctgacctcgtgatccgcctgcctcagcctcccaaagtgctgggattacaggcatcagccactgcgcctggtggtccatctcttttatactcccaacttgaccttccacagggggcctgtatgtgtgaaatactcaaaaagctcttctttagaagtaggtgcaggagatggtttgggcagctttgggtaaagacttgcaacttccacaaaggtacagtctcctcctgattgtcctcctcttttcagagaaaggagagaatagctaggatatggcctatggaaacctctatcataaacacccagagttagccatctccagcaataaacagaaaggcagtcgaaaacaaaacatcaaaatggaaactaaataaaaaatgaattgcctcaggagaggaaggtgggaaagatgaaccctgagatagagggggatgttttgtttcctaccctcataacttccaatgtgattgtcttaacatgaccatctcatactctgtccatcttgtgccttgagaatgctaggaagtggatgataaactggcccagactggccatctgagactgagactccctgggggactgaaggaccagagcttctgttggaatcgtgtacagcccagtcaggggagtgaacacagcttgaagtgtgttagcaaaaccacagcaatgagggcaatgaccaggctgcatagatgcctggctgaatcctcatcctccctgtacccatttgttatggactaaactgtgacccctcccaaaattcatatgttgaagccctaactttaaccattgtaactgtatttgaaggcagggtcttgaaggaagtaatcaggtgaaatgaggtcatgaaggtggggtcctaaccctataggcctggtgtccttaagaggtacatgcacagagcaaaggccatgttgtgagggaacagggagaagcagccatccacaagccagggagggaggcctcaggagaagctagccctgccagcaccatggtcttggacttgcagcctccagaagtgtgagaagataaatttctgttgttaccctgtctgtggtattctgtcatagcagccccagccgactaataaccattctctcatgtgacagaacactgagcaggcaaaactgtagtgcacggaagaataacacagatatccaaaacatgggaagagattcaagaagttgtcacccctggtgtagtggtgtgaataaaaagtgttaacaaagctgtccacttaaaatatttgtgtaattgaaattaactaaccaaaatacccagtgtggaatctacaaacgtattgcagcaggagggaaaaatgtaaactgtacatcaataatctattttggaagaaataactgatctaagaaagagaagaaatgaacttactaaaattaatctctatagaactattcagtaaaatgggaattcaaaaataaagtgactaaatatgattctttaagggagcttgctgagctaagacaacagacatccaaaacaacatttcaaaacaaatgaacaatttaaaaatggaaatgagtagaatcaaaagttaaaaaatgatcgttgatgaagcagtcacagtgaatgaaaggagaaagacagatgagaagatggagaaagcattggatgtggaggacaaagatggcccatcagaaggcatcaacacaggtatagaaccagacacgtagaacagaaataactttaatggtaaaacaacagaattttttttgtcagaatcaaagaataacttaacctggtcaaagaatccactaaatttcaagaaagattaattctgaggttgataagtcttgagtatcaatttctggccacaaaggaaaatgccagatttcaaaaggcagaaataatcacttttttctcatccataatagttctcaaatttaggaattaccaacagtaataataggagcaaaaaaattagtcccagtaataaggaatttttaaaactttcatgtttcatggattgaagtagaaaccttaaaaattatagaatatctagaaaaaatattacaaaaacaagcatatcaaaactgaaatggcagggcaaaacttacattctgagagaagtttatagccttaagtaactgtatagctgagtcagaaaaaaatgaaataagcattcacctactccccaaattagaagataataacacatacaaaagcagaaattaatgaattaggaaagagaaaaaaagtagcgtttatgaatcctaaatttcaggggggattgggaaggataaaagagataaactgtgggctagtcaaggaaagggatggggagagagggcctacatgtataaaaacaaatacagaaataatagatatacagtgcatataattttaaaaatctgaatgaagttagtgaaataaactgagagaattttcaaagagcaatcatctattccccaaaaagcaccagagtcagatattttcactgctgaatgctttaaaactcagaagaaacagttaaatctttggatattgaaactggtctacaccatagtgaaggaaaactgcaaattctttttgtgacgtcagcagggcactaatgccaagtctgtgaaagataaagttgtagatcagttttacttaccaatattatatagagttcttaaataatatttcagcaaatagaatcaatactttataacattgcagtttaggtcgttttcatccctgaaaggggatgatattgagccacaagcatggctcaggatttgaaaatacattagtatatcctactattaagtgaaaagagaaagtcagcagattcctaaaagcatttgagaaaatttacattaattcgtgataccatacttcaatgaaacagaaattgtagctacttcctaaatatatcttaaaatttgtattttagcccttaatttagtattctgtttaattgttgaaatgtttataatattgacaacatgacttactatttctattaactattgccctggaagaactagacaagaagagagaagagagggaaacgaggtggtatctaaaacctggaaggggaaaattttgcactatccacagatatgattgtgtacatagagagccctggaaaacaaatggaagaactgttatgctaacattgagagacaggactagctggatttcctaggtggactaagaatccctaaacctagctgggaaggtgagggcattgacctgtaaacacggggcttgcaacttagctcacacctgaccaatcaggtagtaaagagagctcactaaaatgctaattaggcaaaaacaggaggtaaataaatagccaatcatctatcacctgagagcacagcaggagggacagtgattgggatataaacccaggcatttgagccatcaatggctaccctctttgggtaccctccctttgtgagctctgttttcactctattaaatcttgcaactacacactcttctggtccgtgtttgttacagctggagctgagcttttgctggctgtccaccactgctgttcgctgccattgcagccccaccactgacttccatccctccggatccggcagggtgtctgctgtgctcctgatccagtgaggcgcccattgccgctctggatcaggttaaaggcttgccattgttcctgcacagctaagtgcccatgttcgtcgtaatggagctgaacactagtcactgggttccacggttctcttcagtgacccacagcttcgaatagagctctaacactcaccacatggcccaagattccattcgttggaatccgtgaggccaagaaccccaggtcagagaacacgaggcttgccaccattttggaagcggctggtcaccatcttgggagctctggggcaaggacccctgccctgcccccctcgtttacaacatgatgggggattaaaaggaattaccagaatggatagcttccttactacaagaatcagaaaatacagtgggaaaaatagctcctattaacagtgtttttttttttttttaaattatactttagtagggtacatgtgcacaacgtgcgggtttgttacatatgtatacatgcgccacgttggtgtgctgcacctattaactggtcatttacattaggtatatctcctaatgctgtccctccccctctccccaccccatgacaggccccagtgtgtgatgttccccttcctgtgtccaagtgttctcattgttcaattcctgcctatgagtgagaacatgtggtggttggttttttttgtccttgcgatagtttgctgagaaggatggtttccagcttcatccatgtccctacaaaggacatgaactcatctttttgatggctgcatagtattccatggtgtatatgtgccacattttcttaatccagtctatcattgatggacattggggttggttccaagtctttgctattgtgaatagtgctgcaataaacatagtgtgcatgtgtctttatagcagcatgatttataatcctttgtgtacatacccagtaatgggatggctgggtcatatggtatttctagttctagatccttgaggaatcgccatactgtcttccacaatggttgaactagtttacagtcccaccaacagtgtaaaagtgttcctatttctccaccttctctgcagcacctgttgtttcctgacctttttaatgattgccattctaactggtgtgagatggtatctcattgtggttttgatttgcatttctctgatgaccagtgatgatgagcattttttcatgtgtctgttggctgcataaatgtcgtcttttgagaagtgtctgttcgtatccttcgcccgctttgtgatggggttgtttgtttttttcttgtaaatttgtttgagttctttgtgattctggatattagccctttgtcagatgagtagattgcaaaaattttctcccattctttaggttgcctgttcactctgatggtagtttcttttgctgtgcagaagctctttagtttaattagatcccatctgtaaattttggcttttgttgccattgcttttggtgttttagacatgaagtccttgcccatgcctatgtcctgaatggtattgcctaggttttcttctaacttaggtttaacatttaagtctttaatccatcttgaattaatttttgtgtaaggtgtaaggaagggatccagtttcagcttcctacatatggctagccagttttcccagcaccttttattgaatagggaatcctttccccatttcctatttttgtcaggtttgtcaaagatcatacggttgtagatgtgtggtattatttctgagggctctgttctgttcattggtctgtatctctgttttggtaccagtaccatgctgttttggttactgtagccttgtagtatagtttgaagtcaggtagcgtgatgcctccagctttgttcttttggcttaggattgtcttggcaatgcgggcccttttttggttccatatgaacttcaaagtagttttttccaattctgtgaagaaagtcattggtagcttgatggggatggcattgaatctataaattaccttgggtggtatggccattttcacgatattgattcttcctatccatgagtatggaatgttcttccatttgtttgtgtcctcttttatttcattgagcagtgctttatagttctccttgaagaggtccttcacatcccttgtaagttggattctaggtattttattctctttgaagcaattgtgaatgggagttcactcatgatttggctctctgtttgtctgttattggtgtataagaatgcttgtgatttttgcacatcgattttgtatcctgagactttgctgaagttgcttaccagcttaaggagattttgggctgagatgatggggttttctaaatatgcagtcatgtcatctgcaaacagggacaatttgacttcctcttttcctaattgaataccctttatttctttctcctgcctgattgccctggccagaacttccaacactgtgttgaataggagtggtgagagagggcatccctgtcttgtgccagttttcaaagggaatgcttccagtttttgcccattcagtatgatactggctgtgggtttatcagaaatagatcttattattttgagatacatcccatgaatacctaatttattgagagtttttagcatgaaggctgttgaattttgtcaaagaccttttttgcatctattgagataatcatgtggtttttgtctttggttctgtttatatgatggattaagtttgttgatttttatatgttgaaccagccttgcatcccagggatgaagtccacttgatcatggtggataagctttttgatgtgctgctggattcggtttgccagtattttattgaggatttttgcatcaatgttcatcagggatattggtctaaaattctctttttttgttgtctctctgccaggctttggtatcaagatgatgctggcctcatcaaatgagttagggaggatttcctctttttctattgattggcatagtttcagaaggaatggtaccagctcctccttgtacctctggtagaattcggctgtgaatccatctggtcctggactttttttggttggtaggctattaattattgcttcaatttcagagcctgttattggtctattcggggattcagcttcttcctggtttagtcttgggagggtgtatgtgtcaaggaatttatccatttcttctagattttctagtttatttgcgtagaggtgtttatagtattctgtgatggtagtttgtatttctgtgggatcagtggtgatatcctctttatcattttttattgcatctatttgattcttttctcttttcttctttattagtcttgctagtggtctatcaattttgttgatcttttcaaaaaaccagctcctggattcattgatttttttgaagggttttttgtgtctctatctccttcaattctgctctgatcttagttatttcttgccttctgctagcttttgaatgtgtttgctcttgcttctctagttcttttaattgtgatgttagggtgttaattttagatctttcctgctttctcttgtgggcatttagtgctataaatttccttctacacactgcgttaaatgtgtcccagagattctggtatgctgtgtcgttgttctcattggtttcaaagaccatgtttatttctgccttcatttcgttatgtacccagtagtcattcaggagcaggttgttcagtttccatgtagttgatcggttttgagtgagtttcttaatcctgagttctagtttgcttgcactgtggtctgagagatagtttgttataatttctgttcttttacttttggtgaggagtgctttacttccaactatgtggtcagttttggaggaagtgtgatgtggtgctgagaagaatttatattctgtcgatttgggttggagagttctgtggatgtctattaggtccacttggtgcggagctgagtttaattcctggatatccttaactttctgtctcgttgatctgtctaatgttgacagtggggtgttaaagtctcccattattattgtgtgggagtctaagtctctttgtaggtctctaaggacttgctttatgaatctgggtgctcctgtattgggtgcatatatgtttaggatagttagctcttcttgttgaattgatccctttaccattatgtaatggccttctttgtctcttgatctttgttggtttaaagtctgttttatcagagactaggattgtaacccttgcctttttttgttttccatttgtttggtagatcttcctccatccctttattttgagcctgtgtgtgtctctgcatgtgagatgggtttcctgaatacagcacactgataggtcttgactctttatcctatttgcccaacagtgtcttttatctgagtgtaagcctaaatcagcaagtgaagaacacctatgtgaagaaagctgcaaaattatgctaagagacgtgagagaaatctccttgaggggaggaactacgtggttttctgtactgctggcgggggtgtgaactggaacatcctttctgtgagggtttggcagtgtctatcaaagcttgaaatgcacttagagccaggtccagtggtgcacgcctgtaattccagctactcaggagactgaggctggaggagcccaggagtctgaatccagtctggacaacatagcatgaccctgtctcaaaaataaaaaattgacttaagctttgaagggcatctctctgctatcaaatactctacagatattctctcaaaattttgcaaaaatgcaaagcaccttcactgccacattgtcttttaatgcaaaagtcagaaacaaatagtcttcaacaggtggaagaaacattctgtagccttttgaaaagaatgaatagatttaaatagtgatagtgattgtggcagactcaccctaagatgacctccagtgacccaggcccttgtgtgcaagtacctgtaacttgattctacccagtagaatacagcagatgtaaatcttttattatataagattgtcttagaccagagagagaaattctcccatttgcttggaagtaatcaaccacgtgaactgtctgtggagagggccacgtggcaggaaaccgcaggcatcctctaggagctgaggcagccgccagcccatagtcagcaaaagccacggcctttagtcctgcaactgcaaggaaatgaattctgccaacaacctgaatgagtttggaagcagattgatccccagttcagcgtccagaatacagcttggctgacaccttgattatagctttgtgggctgaggacctccagagcagaagacacagtttagctgtgcttagcctctggacccatgggaactttgagatcattgatagctttcttatttaaagcatgagtcagaaaatataataagagtaagcattttgttttcagctgctgagattatgctaatttgttgcacagcaatagaaaactaatacactgaaaaatggaaccatctccaagacactggtatcctgtctcactctgcattaaatttaaaaaaagaatctcatgccacttgctgatccaacttgctcttcataccctcacttattacacttcaggcacactggcctatttggtattcctggaacatgctaggcacatttatgcctcagggtctttgcacttatttgtttattcccagtgtctataacgctgcatgtcccatattaggcattcagttagtgtgtgaataaataataaatatttaagtgtggaaccgtatctactaggatcccttgtgtattcacatacatatataagctaggtgtgctggctcatggctgaaatctgatcactttgagggcttgaggcaggagggccacttgagcccaggagtttgagaccaccctgggcaacatagcgagaccccatctctatttaaaaaaacatatatagaaatatatatacaatagtgaattttacaatattctgtatgtatcagtattatcaattattatggcccttttgtggttttcttctttgactaaaaagccaactaaatggctattaaaatgtatattaaaaaacaaatattctagttctgtatctcagagtgtagaaatatgtcaatttgactaatctgttgggtaaaactagaagttgctggagggaccaggttttaatttgaagaaactttaaacagtgaatctgattcttctttgagtttgtacaccttaaattcttatgtcctttctctttcatgattgaggttcttgtgtcttgtccttcgatgacaaaaacgtgaagcagtgagagaagtatttacatgtgtatgatctatttaatgtattatgttaattgtgaagcatttacatgttgaagttactttgggaatgattattttactcatgcaaattaccgtctcattacacaatattaggtgaaacaaatacatgtatctcttagtgcagattaaaagtagccacaaatttctttcacactccttccgcagagatatgggggtctaagtatctctttcccttaaacctgagtagaactcgagactgttttgatcattatactatggcaggagtgactcttaattaaggccctaacactggcagctgccacttctttcctcctggaacgttcttttctggaggaagccagctgccgtgttaaaagttcagccaccctgggcctgccaagcattgaggaagcccatgctcaccgtgtagagaggctacagagacggggagagatacccggcctgccctagctgttccagctttcctgtccaggcactggacatgtgaagaaacctcttggtcatcccagacgttagcagacatgacgtggggaaaacggaggcacccagctgacaacgaaaatggtgggaacgtcaaatatatgacccttgtcagcctgttccagctatttcccgtcttttgcctgaccccagcagcgtctgatcattgttgctgtgccatgcccacattcccaagccagaatattcctagcataataaaatggtggtggtctgccactgtggagcattagagagctctttcatcaacatacagaagctatgtcccacagtttcactgaaaatgaattttggttttgtgaatttgatttccctgttgacttacttcctattgacttccagaagagagtacttttaaggggaaaaaagggaacattttaaaaagattatgtgtttaaagaagaataaccatgttatctgcatcttttcatgtgataaaaaaactctgacagtgaaaatgcagtgagaacctgccaggtgattagttaccctctcttcatattgtctcaccctatcaacagcatttgggagagtcagctccatggctaagatttccatgcaccctttccttcctccccatcagcccaccccagcacacatgctttgcttatcagtggacctttgtggcctttttctgaacagcactcagcagtactatactacctggatagcttttcttgatttacatatttttgcataataggatgtagaaaaattagacgaaattgcctgtaggtgcggtgggagttagcgcacttcaaggaggttaatcatcctattcttggacaaaaatctgtatagaagaagaaaagggttactgtttagagagctaaataagaatgactttaatatatgtgtttgtgaaatggttacagtttattaaccttttttgtgtacttactatctgacacgcttttctttcggaaagagataatcagaataaaaggaacattaagatgagatgagatgactgttacaggtcctccctgaaatgatcagggcaaccccattggcatgttcacatggttactctgtggatgtcatcagggaaggaagggagctcggattccagcatggtacagggagtgtttatcagggatggaggaagaagagtgtgacaggtcagcttgacaggattgctcagtagcgagaagtatgagtcacttggcttacgtagcttgatgaggatatcttctggggatgggtatgtattttctccttcagcgattcatgagtcagctattcaagcccttcatgcggtgtgtgaacctctttggaaagctcccagtcttaaccttgtaaaactttgctgacacagaactcgctgtctcccaagttaaactgctcaagcattgtgtaacttcagcaattcggaaggcttttcccctccttacattcagctgagatatactttcttctcaagctaaattcccagttttaacctctggggtcaaatacaaggtttacaaggttattcctcttccacttgatatggttttggaacttaaaaattgatactgtggcttgctgggtttctttctagttccttcagttgcatgacttagctttgaatgttcccggtcacagtcttcggagacacttccgtttctcagtaattctcttactgcagaactgaaatgtaatgccctagcatgtcccagtcaatcaggactgcagttgggttagcatcttcctccttctggatgtgccctgtgtttgttaatcctgtctaaaaggttatcagcttgcaatcatggcctgtggtggcctcatcctaggcttcctgtttatgttgaccttttgcattgctcctcctgaggcatacagtctccattgcttgtcttgtgtagctgctttttaaaacataggaactgcttgatagttttttctgttgaatctagtattactggtctctttgtttccaacctgctgaaagcatcttggatgcacttcttgctcaggaaattaatcagtatctcccccagtttcatgtcctctgctgatgaaaacaaagccggtgctaacagttactgaattagagctctgacacatgctattagaaacatttttgtagttttaaagtggtggatctcaacctcaagcaattttggcccgaaggggacatttggtagtgtctagagacagttttggtgatccccactgggggtggtggtactgctggtatgtatctagtaggtagaggccggggtgatgttgaacatcttacagtgcacagggcaatccctccacaacaacgacttagcagtccccaaatgctaatagtgctgagattgagaagccgtcagcagattaatgtagttctactaacagtgtctgttgggttggatgtttttaatcttgttaatcagacgtactatatcagcatgtaagactgaattctcaaagtgtgaactggggtcacctgagaccttttcagggttctgtgaggtgagagctatttttctgataattgcccttttcactcattccttaagattgtagtgtggtgttttccagaggcgatgatattaagacattgaattaaaacattgaatgcagaaggagacagagagtccgctgtctactgttaagtcggacgttaaagagatttgcaaaatgtgataaaatgcccttctcactaaattatttttgctttggaaaaatcattatgttaatatgtaatggtttagtattaaataatacatatatttaaaagttttaaattttttttactgtcaagatcaacagataatccacatgatcagaagttctttgggggaaaaaaacaaaaaagttatttgagatcctcaatacttctcttttttctcttttttttttttgagatggagtcttgctttgtcgctcagctggagtgcagtggtgtaatataggcccactgcaacctctggcctcccaggttcaagtgattctcctgcctcagcctcccatgtagctgggattacaggtgcacaccaccatgcttggctaatttttgtatttttagtagagacagggtttcaccatgttggccagtctggtctccaactcctgacctcaagtgatctgcccaccttggcttcccaaagtgctgggattatagccatgaggcgccatgcctggccgagatcctcaataatttataagagtataaagtcttgaggtaaaaaatgttaagatcctctgatctaggctatatttcttcattttatgtgcaaggatataatgtgttaacaattttaaaggccttgttagaatgtagatgtacagaattttgatgtttcccagtctggaagccctgtactgaaagaaattaattcacatgtttctagtgaacttgtagtagtttctggttatctttttctacatttccagatggtcaccgttttttaagtaatcaatccagagcctaatttgggatctccatctagtcagatggactaactcagcttcaatttcctctcctcactttgtgcataatttttgttgcagttaggaatgagtgtttgaaattgcctttggccctttgagtcgagtttccttttgggacctcaagtgttggaagcgtaggtgactttattcagaacgttgtgaaggctgcttttgtgaaacctcagtttctggtatctgaataaggaacagttctgttccttagagtgaatatataccttgattcccaaacatttttaatttttgaaattaaatttcctatagttaactaatcaaaacttaatagatgtctgtgttttggtcttagtttaagtatacagtttttagttatgttttccattcccctccactttttttttgtcatgaggttggagggagaatgaagttctgccctatgaatgaagtaggtgaggaatatagtgattaaatggtatacctgtgttaataacatgatgttggagattccagatatctctggtctggtgcaccccttttagctggatcaggagactgagctatagagaagttaagttactctttcaagaccacagtgcatttaaatagcaatgaacattatgatcttgtgtccttttattagtaatattgtgtaccagtgtttaatccctttaaccattggttttttcatctatatcattagaataaaactatcaaccttgtagggttgatcatattatctttcataccctttttttggttgaaaaattttagacccacagaaaggttgcaagaatgtttacaataaacattgtataccctttatagtataattctattattgctatttttgttgaataatttgagactaagttcctttatatcataacccttcatccctaaatatttgaatatgtgtctcctaaaaacaaggacaaattcaggaaatttgacatggtcacaatactgttatctatatatcatgactctaattgtggcccgtagtccaacacattgacattaactgggaatttgttagaattgaagactattgggctgaatcagaatctgcatttgaataagaacaccaggtgatttgtgtgtgtgtaaatgtttgagatgtactgctctaatggtagtccatatttatacttccccgttgtcaaatgacatttttaatagaaaaattgccccaatccaggatcatacattatatttaataattgccatgccttcttagtctactttaacttagaatagtttctcagacttagtctttcatgacattggcacttctgaagtgtacaggacaattgttttataaaataatcattactttgactcttcacaattagattcaagttacatatttttgggaggtacatagatgatgctgattgttctaagtgcatcacaacaagaggcacatgacatcagtttgttccattattggtgaaattgatcccttggttgggtgttactctggttatttatcagagcatagcacatcaccccaaaatttagtgttttgaaacaatcttgttattttcatgattatagagacaaattcaggcagggcagggcgagtttagcttgtctcttctccttgatgtctagagcttcagctgggaaattttgaatagctgtgggctggaatcatctggaggcttctgcactcacatctggtgcctaggctgggctgactcacaggctgggctcccctgggactgttgagcacggcacctatgtgtggcatcttcatgtagcttgagcttcctcacagacatggctgcctaagggctccaagtgagtgttccagcaaacaagctagagactgtagggcctttcatgattgagcatcagaagtcatatatagttcactttcacatcagctattgattgaagcagtcaggagcctgtgcagatttgggaaatctggggcagggagatagactccacctcttgacggaaagagtgtcagagaatttgtggccatgttttaaaattgccacaggtagtgactgctttatttcctaattgtaaatatagccattttctctttggaattaactgtaatctatcaggagacaccctgagaatatttaagaatcctgttccttggcatctttagccagttagttttagcattaattgttggctcctttatgtttattagttgggatttgaattacataaaaatctatgtgctaatcccccagtaactaaacgcgtaagaataacagatagtgctgggttcttaaaatcccttcttggacaaagataagcatgcatgacccaatttgacaggtgggccatgtcttactgatgatagtgccaaacaattattagcatgtcgacagtaatacagatgaaggcattctaccttcctgtgtgtgtggttctatgcctattatcctgactgttctctctcctttcagttaaggggatgtgcctgacagtgtgtcattacttcatttattatgattgcaaacatttatgtcaaagctggtccaaggcctaagtgaagtgatacccattgagagaactctccccctgtgcttttgagacatggctgctatgtctgagaggcagtgagttccaaaccaataggtcatccaagaatctaagcaggaacatttataccttttaaggtgcaggagcgaggtaaagattatgctttgtcgtcatatataagacttcttaaactgaattgtgcagttcacactgaaggagaggctggtgcctggcaccagtatgtgtgacctccacatagacttaagttgacaggagtgagagggggaacagtgtgctgtttgaaatgtttttaaaatgtattactgcagattttctaagcccttgtttagaaacatttcggttggatggtaagatctacctgtgtcctaatgtgtttagaaattgaatcttgcctcaaagtttagtcttaatagatatattaagttggtgtaaaagtaattgtaaaaaccacagttactgttgcatcaacccatatattgcagaggccacgtctcatgtataaccaggggctgaataaattctaggaacctgaggtccatatatagttgtattaaatatattgactgttttcttccttatgatgacaaaatgttttaagaaaagaaaaagaccctaaagaatagtcaccaaaattttgtagaaatgttcctttgtaggggatggtgggtatctgtctggttttttttttttttttaaaccttctttaaagagctgttttgtgtttgccaacatttctacaaggaatataatgtgtattatcacctttgtaacatgaataaattgtaatttgggaaaaaaatgtttatcaattaaagcaaagtgttcctataaattttagaaacagtaattcagtatgaaggctgatactaatctgccccccaccttcagggcagcctgtcctaaagtgccaccattgaccactttcaaaacatggatttactttaggcattttatttttattagagctgaaatgcaaatggaaaaaagaaagtattggattctctcttaaatatgtaagtcattcctgtaaacgtgtacttggaaaaggtttcagatgattctgataaatacatatacctgccttcaggggatgtgttcttcattgtgactaaaattcacacatttccttttggagaatgaagaggtccatggcttattttttctttctaggaaaagttatgcctgtaatcccagcactttgggaggctggggcaggtggatcatgagggcaggagatcgagaccatcctggctaacacggtgaaatgctgtctctactaaaaatacaaaaaattagccgggcatggtggcgggcgcctgtagtcccagctacttgggaggctgaggcaggagaatggcgtgaacccgggagacggagcttgcagtgagctgaggttgcgccactgcacttcaacctgggtgacagagcgagactccatctcaaaaaaaaggaaaagttactctagcctacccaaatgactaggggtcatggcttgtattccaaaagaaaaatagcattcacgttggaaatttcatgagatgatgagtcagttaattctaaatgtatttacttatactcagtttaaagtttcaccagtgtcatttaaggaagactcttttttatcagggttctcactagcccaggagaggaagtcctcttcttgggtatcctcaggactttgggactgccaattttacatttactactttttgatcttctgtgctgctagtggcacccagtgatttttaagggaaggcttgaggctctgaaagaagggtgaaaagagaggagaaaaggaacctcaaaagaagttgtaaccaacatcaaagaaggaggaagaagaggagaaaaaaaggaatgttgtgtatggactataccttatagttgacatagagtatattttattaatgttagtctaggcgtttattactgaaatgtaaactttttgtttgcatgtgagcaaaggacacattcaaaaaaggctttggctttttactcagcgaagagtatttgtagacatttgggttatgaaagtcaacattacagctatatttggggaagtgtattcttctgacttcagaaatcgtatgctgtgttttccaaatgtttgcaggtgcaaattgataaaactgcacctggagtgtttttaaaggtttgcaaaccagaaaacaacattttataattggggatatatgttcacaccgtgaacataacagtgatgcagctttggcttaatcaggagaggttcacctgatatagatggggagaaagtttacatagtgaaaatttctttaatgccatttggttctgagcgtattatcaaagttattattccttctgttggtctttgtgaaacactggaagaagcagggcactgatgttgcatccctagttagtggcactgaaaatgctatgggtgcaataggtagttctggaatgtgttgtactttataaagtctggttgataaagattgtcaatatgctgaaacctttaatgcaaaaaccaaagtctgctatgcatcactatttagcgtatagagtgctaccgaaatcaatatggtatgtcccactggaacttgggaaaggagtctaaaaatgtttcctgaaataaaacataaacaaaattagaaaaacagaaactctaccaatttgatatattgtagaaaagtacttttttcttcttttagttttagttgtaaacctaagttgaagttgttttttgaaaagcttatgctgagtcagggcctgagcctgtgggatgggtgaccactggcagggaaatatctcctgttcccttattccctctcttttctcctggctgcctttctctagtctcctgtgacatggtagagagggcctcatactgataggtagcagcaggactccaaacagggcccttcatttgctctaatgtcagcctcttgcgtctgtaatgcataggaaatcactatgaggaatttcagctattcagcaaaatctccccagaagaggaagtacatgcatgaggggtactttgttggaaagaaggggtcaaagccggcaagataggaagtagcagttggctgtgaggcctgttctgggagtaaggtctgactgccactgactagtggtatgaatatgagcaaatctttaaccacagggcctcagtttgctcaactgtgaaataatgggcttggcctaagggataactaggatactttccagctccaagattctgagttttagtgaaccagaacaaacgtgaaactgtagaatatttccagcctcaagcctgaacccgactggtattttactgtcagaccctgtcgtcaattctagttaaattttctagaaaagaccctcatttagtcatggtgattcaaggacagagagtcggaaaaggttttcattgctttctctctgtactgttcacgtggtagctactctgaggttaagtcgtaggtcgaagttcaggttgcctgggagtgaacctagtcaaacaaccccaaggtgatcagggtttgcttaaacctgtagactccaaagctcaaagttgtatttggccattttgtaactatgctcttttagaaagaagatcggacattttatttctgtccctcctttctatgttaacttaggagagcctgcgttgatttctagctgtcttctggaagtacctctgtctgcttatggataagtgtagttctgtgaaataagacatcagcacagaggacacactgtgaatggggcttggtatgactgggtgatgttggaggcaatggaacacattggtcaagacatgtacagtggagtgagggaagtgggttcaaatctttgtaagtcaagcacttggcataatgtcaggcatgtggcaagtacccaaaagttgcaactgttattatttgagatcataggaatatacaaacataatcttctatcataataaagaccagtgaacatgttagtagaaacatctttttaaaaaagaattactggagctggatgcagtgactcatacctgtaatcccagtgctttgagaggctggggtgggagggtcacttgagaccaggagtttgagattagcctgggtaacaaaacggaccctgtctctacaaaaacgttaaaaattacttggttgtggtggcacgcgcctaaagtcctaattacttaagaggctgagacaggaggattgcttgagctcaggagttcaaggctgcagcgacctgtgattgtgccactgcgctctatcttgggcaattagagcaagaccttgtctctgaaagaaaaaaaaaattgagggaaaaaatgcaaattgtttttttctctgttcttataacacaacaatcaacacagaaaacctttgtgtccagatgtgtgggggtttttcctacacaccaagcaagcagtcagctctgcagcaagcaccagctaggtgtcctcccattcagttccaacaccgtctacctggaggtagtgccagatgccacagattgagggcttagtccccaagactgcccccttttcagatgctggtcgcaggtccgggcctccagaaattctgactggcttccacttggggttcccacaacccctgctttggttttgattaatttgctggagtggctcacagagctcaaacacatttactgatttgttataagggacattgcatactttgggaagctgcagcaggcagatcacttgaggccaggagtttaagaccagcctgggcaacatggtgaaacctcatctctattaaaaaaaaaaaaaaaaaaaaaaccagctgggcgtggtggtacatgcctgtaatcccagctactcgggaggctgaggcaggagaatcgccttttatggagacttcattggatgggcatgattgatcatcaagcagaaatataattgtacaaaaagggtctgatctaatgctaatggactgaaagagaaacccagcaatgcctgactgttcagattcttcttggcctctctgtgcagcattccctcctccagaatatagagcgagatgccttccgaaatggaggtcttacgacctaaagtcagacaaggaaggtcagagaatttatttttttaatagaagattccaaaataaaatctctgattaaatttaagtcaaagcaacatcaaatcattatacatcaaataattcattccaaaactaaacaagtaaaactatgtttaccaggtatagacagtacctgataccccctcacttgtatcaaaggttgtgtgctactttttcttttaatataaataattaataggtaagccaggaaggccagctctttaatgcaggggaagatacctactttggggagagcagagagagattctgttttctgaggcctgcttccaaggcctaaagcatcccaacattataatgagagctgtgacagttatgagccagtaactatatatatatatatatatatatatatatatgtgtgtgtatgtaaaggaattcagggagaggaagtgtgatatcattacatagatagatactgtggacttaagtatttattaattcagttcaatcaaatgcagcaggtttaagttgtgtgctaaagcaaaatttgcagagaccatcttatatcctgttattggcaaagtatttctggcagaagtggtgtagtcatttccacatgtggtccctggtaacagagcatgaaggacttggggagggatttatataaatggctgagtcccatgagcataaacatccattgtgttgtgtctgaggaatctgtcactctgaacagcggtgccagacttctgtttgtgctggcactcttaggagacccgagtaagcaagcacttccttacctggcatgcctacgcgtggagtgttttttgtcattggattgtcagacttgagtttttcttatgttgtaaatacgtaggtgctgtgaagaaattttcaccctgtggggaaaaagttttgaatagatgtaatctcttgattctcaatattgcttaagatgagttcatctctcttagaacaaaggcaatgagaggtttgatgccaggaaagttgggagagctgggcaatcttagaaagagacctgggcactaagaggaatttgcatccaggcagtagttccagaattggcaaatcagtattatgtttgtgtatatattatatacacatcttggcaatgtagaacaagataagctacattttatcttctagaatttgatagccaaaatcacaggtcagaattttaaagtaaacagttttactatttcctcttcttgtagatctaaaaacagtgtccctttaagtcattcctggtgtttcagagagaccatcagagcatggctttgtatccacaaaaaaaaaaaaaaaggcttcagaactgggggcactggaagacaaagtaaatgcacataaaggtaatgcattctcagaacatgtagaaggggatggtgaatttatgtagctattccccattttactctttctaaacagatataagacagtactagctggtagtatttttccctaagaattaaatgttgtttgtttcataaacctataatatttttatagtttggcagcagtgactttggaatgaaagccaacttcagatgccaactctaccattttgaaaccgtggagacttgtgctaattgtttaatttttgagctttgtttatttgtaaaatgtgtggaacagtacttacctcaaaggctgttgagattattaaactgcttatgagaaagcttgctacctagtaggtgtttgttaaatgttaaatgtattcaatgaattaggaagtaatttatatccaaaatttcagtgctaaagtgcagaaataaatacaggaaacagttgtttgattccaggttacttgggaattttgaaaaggtgctccacttgttacttttctttagcctgttacttgatgtccttttccagagcactttagaataacttggctcagagcactgaatttggggaatattcaagactccaagaaattagtgccctctaaaatagcagttgagtggagtcatgaggtctgaattcatttttgtaattatttgctgttacaattatattatgaatacaaatagctactatttatttctggctactgtgtgccagggactgtactgaacactttataaacattatgtcacttaatccctgtagtacaggcattatggttctcattgtgcacatgagaaaatgagatacactgtgttaagaaataagtctggcccggcatgggcatggtggctcacacctgtaatcccagcactttaggtggcagaggcggacggatcacgaggtcaggagttagagaccagcctaaccaacatggtgaaaccccatctctactaaaaatacaaaaattaactgggcatggtggtgcgtgcctgtaatcccagctactcaggaggctgaggcaggagaatcgcttgaacccaggaggtggaggttgcagttagccaagccgagctgagccgagatcgcgccattgcactccagcctgggtgacagagtgagactccacctaaaaaaaaaaaaacaaaacaaaaaacaaaaaacgtctaacctaaccttccatagctgttaagatttaaaagccaggatagtgctgtctcagatgagcatctgtgatttgctacctgtgttaatcgggatgatagcttagctttctgaaatgctaatacaggttgagtatcccttaatggaaatgcttgggaccagaagtgttatgaatttcaattttttttgagctttgaatatttgcattatgtgtaatagttgagtatcccacatctgaaaatctgaaattcaaaatgctccaatgagcatttcctttgaatgtcatgtcagcgctcaaaagtttcagattttggagtgtttcagatttcagatttttggatttgggatattcagcctatacaacatagagcttattgagggtgtggtgtgtatttagaatctttgacatattttatacctcagggcttggcaaggttcaaggaattgattatatatgtacagtgacaaattttatgaaataatttttctggtgttttttttcccttcagcttttaagttctggggctacatgtacaggatttgcaggtttgttacatgaacgtgtggcatgctggtttgctgcacgtatcaacccatcacctaggtattaagcccagcatgcattagctattcttcctgatgctctccctccccctgccccgctgacaggccccagtgtgtgttcaccccaggtgtccatgggttctctttgttcagctcctacttataagtgagaacatgcgttttttgtttttttttttattcctgcattagtgtgctgaggataatggcttccagctccaaccatgtccctgcaaaggacaggatcttgttcctttttatgactgcatagtattctaatatatatacaccacattttctttatccagtctattattggtgggcatttgggttgattccatgtctttgctattgtgaataatgctgcagcaaacatactcgtgcgtgtatctttataacagaatgatttgcgttcctttgggtatatacccagtaatgggattgctgggtcaaatggtattaatatttctgtttctaaatcttggaggaatcaccacattgtcttccacagtggttgaactcatttacactcccattttctggtgttttgattttgacttttgttcatccaagataagtgtaaaatagctgtagaatacctatatctaaatcactgtttcttagtcttggctacacaaaagaatcacctgaggagctttaagatgtaaaccaaagaaaacaaaacagactccaaagcctgttactcattcccagatattctgatgtgagctaaacagtgccttaagtcttctggagaccaacccgggttggacccagccctgagatttggactgaggtgctgggaaggactgagatcagtcctctgcagggtctcattttgcttggtagtctggctctgcagtttggggttgcctccacacctcaccccccacaccctttccccaacaccctcacttcaaactggaggaaagaggtggggcagttttcagcatttgcgctgttccagtcagtatgatcctgtaagagggtctgtttggaaggttttcatctgtccatcaccagttgttgggatataactttttcattgctaatttatgctttggatatactggctgtgtgtatggtttggttttctattctggtgacatcctagaggcatctgccatatttgtaaacatcaaacatattagtaggtaagccagggagctgttttaaatgtcacaggtgccattttttttatttttccagtggagtcatatttcctggcttttcttctctccttcactgttatcggacttctcaatttaactgctctcctgttcccaccaccccacaaccttcttacatctgaacaatgacagatgacagtaaatccagctgtggataatagtccaggcagcagaggattttttaggcagataagtagtttgctattggccagagtggtctattggaacacagattttgtggaaacatggtgttggcaggttaccagttggagcaataaattaaattttcactagcacatatttgtctacagtaacttaaatcattttttaaaaatttcatttacacatgagggggcagtatgggactataaagcaaatgctgtctttgaagtagcttatttttattggtatataatagtttttaggtgcgaactttttgactgtgcaattaaaactccagcattgttgttagttgttcagcaatacacatatgtaagtgatataccctcacttgtatcgaaggttgtgtaccacttttaatataaaaaatataaaacagtgagacattctcacagtgctttttgtttttaaattatacatgtgcagaacgtgcaggttctgggatagatgtgcagaacgtgcagatttgttacataggtatacatgtgccatggtggtttgctgcatccatcaacccgccctctaggatttaagccccacatacattaggtatttgtgggttttatattcatgttttgtttaaagctggctggctttcttcctgttttctgcttccacctgaggaacgtcagccctttggagatgcagcttctattaggttgatatctctaatgtattttactttatgactttattgaagaatgaagggcctgcagcattgctggaaggaagcctctgaactggggtctcacagctatggagggtctattatcagtcacctctgtgtgatatgctttctttgtggcacaaattgcttttctcaaaagaagaaatttgctaagcaaaggagcagcacattttaattaatgttgttattactgatctgtgaatgacattatagatagatcaaggtgctaatattctaggtttcataaatgaaaggggaaataaaagaggggttagagggtattaaatgaattgataaaatccagaaaacattttatgaaaaatgtaaatgggaagctagaaaggtaatttcataagcataggctatttttaaatgtgtaaaaagtatttgcagtcatatgtttctgtttacgtagtttggaaaaaattgaggccaacgttttggtgtaaatataaccttccataaaatttaatggaatacttgtttttactgttttatcctggctgcctcctttggagatgaagggctgtggtactgtctatatctgctaaagatagttttatttgtttagttttggaatgaattatttgatatataacaatctgatgttgttttgatttaaatttaatcagagattttattttggaatcttctgttaaaaaaataaaaggctatgacctcttcccttcattggaaggaatggattttgggctctagcctgtcttgaatgaactccaaatcaaatgttgtggtgctggtttactggagtaacacacaggtttctgttcatggtaaataattcctgtcctttatgctttgttggaagatttttcggacgccgcccgatactacattccctgagcccacctgcctgtcagcatcacccccaaatgcgccaccaaggcagtcgaagagacaaggccagagaaccaagaggcccgtggccgtctacaatctttgtctggagctggaagatggtaagatgttaatgatattttttgcttgatagcatgttgagagtatggcgtatcatatgtcgtcagggcaggccacagttttctgtcatctgtgttttaatttcttcttcccttaagattataattttgagatttacagggagggtgaagcttttttgtaagggagaaaacgcaagtttcggttttgtgtttgtctttgttatgcatggttctttttttatttttaaaagacagcttaaatttcttttttgggagacttgtgtgacctcctgtgaggttacataaccctgagacaaatggaaggggaactaaaattaaagcagatcttttatgagaggagcggatggagtctcatgttaaatgcatctagattaaaggcacagttcaccatcgctctggggtttatggcttgtgtgccttacttgccccatttttctgacttgttcatcaggcagaatgcttcatcttatggcaggggtggcaggttgacctgcctacctgggccaggcttgtgggaactgggctgcagtggaactctggccagtggaagttctcacgtcccttccgagccatgctgttcagctaatcgttgccacgtggccctgttgtttcagtgttgccagattgcccagtttttacaaagcctagaaatctgagttttcaacactgatccatacaaaacaagactgggagctgtgcacacgcctcccattgctaatttgtaatcatatggttattggtgtggagaataagatgattctggtatccaaacctgcgttttcagtatgcagcctgaagctgtgactcgtgttgtgaggccttcctcttattgagaacatttgctgaatttgaaagtagtcttcattcttcttctagtcctctttttcaaaaaagagaatctttcatttattatccttgagctacccaggttaccttagttgggaagtgtgagattagcagagtgaggaaggggatgaggatggtgacagataccatgccttcatcataggcagctgcatgcacacaccaggtggttaatatccagagatccacgcaagcaggtgacaactgtcttcagcttacctgacttagaggtatctctaggaagactcggaatgcctcctgtaatgacacagggggactaaaatgtgggattcttttatattgcttaagacgtaggtacatatgatacaaatattagttttacaattggatagttaatttccagaggaagggcatgaatcattacaattaagctataatttcagaacttccttttagacactcatttcaacttctgatcctagctaacttttttattctgtctctttcttacgttcattctttctcagcagagttgttaataaggagtaaaactgactgttttgaattgcaccttctcttacacctcacttgtcctctgatggaagtgttaataaatagtgaaataagcaaatgttggaaagtaggaaaggaaaaagaaatcaagaagacacagaatacctcaaatggctcattggcccttgagcaaaatggaattgactgtatttcatgaggtagatgactaaagaaggacgttttggtcttaggatcacgtctactattttgatgttcttagcaatggaatcgtaatatccagtcaaatttatttagtggattaaccttttgatcattggattgctaagtgattattaatggtaagaagtttctgtagtggtatttagcatatctcttatgggaacactcaagctagtgtacaatcacagccttcctaacttgtaggtgataaaataattcgttaaaattacttgatttttaagggaaaggattgtcagctacttaacttctttagtctggtttttatgttcattatttgcatgatgttttgttctacattttgtatttcatgaagtattttatagctttatattcatccttggttgcaactttgggatttttttttttaagttgtcagaatcaggaaaactcttaagtttggtcatagtgatttaatcttatgttagaggttatatgataagataaagcaacttaaaactattattctcccttgccctcagttttttgtagttaagttttagttgtgtgaaaaaatagttatttcagagagaacagagtagggtctatattttgtcataggctttttatattttacatattctaaaaaaaaaagaaaagtgaatacatttatttgaaaggaagcatataggaaaagaatactaaaaaaactttcatgttattgaatgtcacttagcatattgaaaattttactgccagaagaagatgtattcttgtcattacgacttaattttttttaaagtagcttgaatcatataattgtcaaaacgacttgaaggtttcaaaaagtttaatttttttgtatttttttcttattttagtagtgaagtgacttcccatgttaatctagtttgtgttaaaatatgcattattatagacaactttggttgattatttttccaaatgttctagtttatatgggacagatagaaaatgtgtatacaaatatgcttctctcttccctgcccccgccccgtgactcattgtagtgtaagttaatttgaattaattaaatacaggatgaatagtttttgcttataagttaggtgtagactatctgccaagatttgaggaactggattggatgactggagatgttcttcaggcctatgatttggtcagagatttggtatttgagtgaagtggtttgtggtatgttatttcttcttctgcactgagtagagtatgaaactgtgtgatgtcccaaacagccagtcttggaacacactcggaattggtttcagttcagcatcaggcagatcaaaaaagcatcagcgaagagtcagcaagcctgttagcatgtgtcacagtaggatgggcctggatgcagaaaacccagcatgaagccggaggggagatcctctgctgggagacatgttttctgttatgttcattcaacctcacccccactcccaattgagagatgaccagtttaactaaataaaccgagtgtctttactttagtaaagacttccatcggcattggcgcatctagccatactgtgtatgctcattatttttctttgcaatatatgattaaatgatattaaatttatttgcaaaagactgtaaaattctagttacttgcttaagcttctttattgatgattaatatgaactaaaatggatatagtatctggctagttttcttaaattagagcagctgttaaatctttgtgagattctcatcttttattttgttgaagccatattgctcatttttcatataacatttaatctcaacatcaaagctgagtagatttggctaagtcagttatgaaaaagcaaaatatgacgtaggctgctaagtgctgaaaagattagaaatcaaaggtttgctttcatttcattttcaagttatatcccatgtttttatttctttagaactactagtaagataactctaaaaatgttaaatatatgttatgtgtttattttctcctgcccccactccaagtgcatgtccttacaatctcttacataaagaggggctgttgtgtttattgtaattcccccaaatacaaggaaagttcaggaggctatatgagatcaaagtgatctttgttatttttcattcaaggcagaagaaattttaagcaaaggtctggggagtcggggagaagaggattaccatctgaatctctttcttcatgctagttctaattttaaacaaaactagacatttacagaactaggttttatatgtatcttctggtgtaattaagtattctttgcctgtcttcttttgtaacatgatacagcagcttatttaggcaacttaaaaaaatatgacttatagtgagttgaaaacaaaatcatcttgcaagccaattggcaagatttaataacatttgagtgttggtcttacttgggtatcgtcgggttggcactttaacatttggatcacgaatgtgctaactgcagcacattttgttgagcatgtgttattgtagtcctacagcgtggtagataccgtgatgaggatacagagccttctcagcaaaaaaatgaaaatactactgttgagcggggcagagatggataaacaatgacacgtgatcatttccttgtatcctaagtaggaacatatcttgatctaggtgagtctctaaaatcagagtaggacaaatatgtcatatatagatgtcctttcagcctgagtaatatcaaattagaactttgaataattagctaaaatttaaatgtcacacgtcaacgagagcaatgctgatgatataaattagccgtcttaggtaggttgaaagaatttggtttgattttgaggcatgagcaagagaacagaaaactagaaagcaggccactgtgcggtctttttaaatgtagatttttaattctaaacgatggaatgctgttagccatttggaagttttttttgcctctaccatttattagtggtttttattatactagatatgaaaatcagaattatactgcatatcaattgaagagcttttatatgctccacatcctgccacatacggtttttcctttaaaggagctaattttctgttcccattctgtttgtcactgcagtgaaataagaaacaacgtggcagtaagtgcccagtgctagctctgaggaagggaagtctgtagggggtgctttctggtttccttgaaatgagctgtttcggcagttgggtgggaaagggtttcaggtaaggggagtagcgtgactgaggcatggcaggagcagagagccggagccaggtgtgagggtaggagattccctgattagaaggggacagtgttgacagttgtgaatgatgggcggaactgatgtgaaagacttagacccaggagagacagcttaagggacaaatgggtggattggagcctgggctggggaatatgtatcctgactgtatactcatggacaaattgcttaccctctctaaatctattttattagctacaaaatcagggtaataatagtatctaccactgaggatggttgagaaggttcagttgttaatgtgtttagcctaacgtctggcacatagtaagcactcgaactctagctgctgctgtagggtagtattcttaaagccagggaaaggtgctttaggtttaaaatgataagaggaaccactgaatatttttcagcaagggagaagagttgtaacattttgaaaataatacttaagaaacttaatctgacttaatctgccagtagaaatctgaaaggcagccatggtaaaaggctgatgaagtaatttaggctgaggttgaagtgggcttgaattagcactagaaagcaaaaataaaatggatatctgggagagatgttaaagcaaatcggggacttctcaactgactagatggagagatcaaggcagataaagtggacattattcgccacagattaggctcataggtaaatctatcattgtgtttatgtttttgtttttatcttcagttttttccttgcagcttaaaaacagaccatctttccatcaaaaggaaggaaacatgccattttgttagtgtgttcaatacgtattcttatgcgtaactgctttgaaaaataggtttagtaaaaaatggtgtagaatgtcttggtataaatagtgtatatggaaatagtgtatatgggaaagtcagtagaaagagagaaatagtaaatagttactaaaatattccatgtgcttagaaaaagaacagtcctataactatgagcaaagtacagctcatttttctccaatttttcctcacaggcacatatatccacgttcatccataggctcatattaagggatgggaggccactcactctagtgagacccttcattagaagccaaggatagctcacattcacggcagcggtgcactctgtaatctcagctcccaagagagcatctatagaatgcctctttatgaaaatgtgctttcataagtgaattgtaactactctgtctttcccacgatgttagcaggacacaaactatgtggaggtgtgagaaggacaactggaaaaccattgttggcatggattttcgttgacattctgtagctatagatgtttccttgtaaacatgtgatcagcttgatgcagattataatcaatccaggtaactggactaagcagacctttgcattaagatgggcagtctgtcttttctccatgcttaccaatttttttttggcatggcatttcatgggtgggctctggataataacttcccaagcccagaagccctttgccatctcctcacagcagtgttatgattccttgacatggaattactgtgttgtgaagtttaatctaagaccaggcttgaatgtgtgacagtatatgtagacagattatttcttaactcacttttacaatgatgagatcaatgggttggaaaaggcagccagaagattcagggctgtaattgagttgtggcgtgcctagaaattatgtgggatgcctcccctgcgttggtgtctccccagaaacctcccgtgaggctcagcatccccccccccaccaaccccaatgctagtgacaaagtgaaaggcaacttcttctattgcttcctatgtaattttaactgtgcttctgtgtgggatgaacatttccccctttctgtggaggaggaaaaaaaaaaagcttatttaatgcctttaaaaaaaatacatagctgcttctgtggtgaaaataagttcatggcaggtaactcagatttatagaagagagaaaaattctttaaagcttctctccctgtggagtgggttttttctccacttctaatagcttttattttaatttctagttctgaattcaagcagctgtcactctctttatagccccctttgaaactcttgtggcgtaggaggtagctgggctgtctaagaaacatcttttcaaaccaaccaaagtattgtttatcctgaatgaaatggaattttaaggctgtcaagagtgactgatttgaaacgttttctttgatagccaggaagatgagcagaaatcttgagggagaaggtatttctctgtgtaaccaattccaagtgacttctgttgctctgaaaactctatggcccatgattaaaatgaccatgatctaagagtgttgtgtacaattaatagaacaaagccaacctgtggccagttcatttttacttactgaattcttaccagctgttgaggaaaaagaaatgatgcaagactgaggcaatgccagagaacactccttgtatttatcatcagttgtcttcagttggcttttcttagttctgggttgcatctttgcagcctggttccctctgcatgctcattctaccttcctttgtgccctcctaggctgtattaagaagcagtacagggtcacctttagatgaaagaaaaaaaagaaaaaaaaaaaccatttaagcctattaaaatgaaatttggggccaggcctagtggctcactcctataatcccagcatgttgggtggccgaggtgggaggatcagctgggcctgggaagttgaggctgcagcgagccgtgattataccactgcactccagcctgggtgacagatcaagaccccatctccaacaacaacaacaaaaaaatgaattttgagactggcattttggatctactaatagtctttaaaatcagcagcacaagtttttgagcatgaaatgtgcttatggtaatgatttttatttttaaagagaaatagtgattatttaagtctgtttattatcttggctattttttaaaaggtatattctttttcttaaaatctttagtagttcatgcaggagtatgatacaaaattcagagagtaataactttgaacagttatgtattagcatattatataccaagtactgttattggcaatatttattaaacttagataatatccagaacaatcctataggtagtattattatccctattttatagttcaggaaactgaggcatagagaaggccaataactcacccacatctgtgacaaagctaggatggaacccaggcagtctgattccagggtctgggttcttaatcactctactagagtgctgaacataagggcaactgtgaacttctcttccctggagtcaacagacattgccatttgtcttgtggttcctttcagagttactctgtgcatttctaacaatgctatttattttttaattttaagaatgattcttagtttttccatttaaaaaacaaatgtttagtgttgtaagggagtcacagctgtggtcttgatccaggagataaaggagaaggaagagccagagaggactatggttttcaatgtgggacataaaacactgtaacaagcatgggccctccaggagaaaaatccaggcctgtttttttatgagagaaaggggagggaagtgacccattttatttcagtgatattaagtactgcaaaagcattttattgtaatttatgccaccacttacctaaatgaacaaacatctggtcatggattggttgtagtgaggatatctcaggtaccttatgctttaacaggctgttagaaagtgaacacaatttggaatttgatgctgcccaaatatatgagattttgctgttgcttttctgttttctcctcccactcctctccccttctttctttattaaaaataatttaaaaaataaataatatattaccatatatgaaaactcaaaaagtataaaaagatacaaagtggaaagatctattccatcccattgactcagtgcctgcgtctgcaagccagatctgtagccattgatgttcatgggttgaaccacataaaattgccatcttttaggtaaaaaattatctaatattggcaatttcaactgtcccccccccccccccccccatattgtaggccaaacgttgtaatcattgagaatttcatgtagttcaacttgtggtttctcaaatccttctagagttgagatgtaaattggattgatgatcagttattagcaagtctgtaccttgtgaaactgctgtaggtatatgccaaacatgattgaatatcatcatttttatatggttcaacctatagtttcctgtccttctagaattctttatttttatatataagtgtattagggtgctctaaagagatagaatgaataagatagatgtatatattgaaggggagtttattaaggagtattgactcacatgatcacaaggtgaagtcccacaataggccatctgcaagctgaggagcagggaagctagtccaagtcccaaaacctcaaaagtagggaagctgacagtgcagccttcagtcggtgaccaaaagcccgaaagcccactggtgtaagtccaggagtccaaatctgaagaacttggactctcatgttcgagggcaggaaacatccagcttgggagaaagatgacggctgtggaagattcagcaagtcaagtcctccaccttcttctgcctgctttattccagctgctctggcagctgattaggtgttaatctcctttggcaacaccctcaccgacacacccaggaacaatactttgcatccttcaatccaatcatgttaacactcaatattaaccaccacaataagcaaatatgaatatggattcttatttattctcttcttcactgaagagtcagtttggtaccttttttgtttttttcaaattttatagtatatcttgtgttgctttttatgtcagtacaaagagagctttctcctttcttcactgctgtatagtactctctgcattctattgtatggatgtacttataagaggaccttgtattctacagcccagccaaacacagtcagatgatgcagatgtcttactcatcacacataggcttccagccatcctgggatgataaagatttgtccatagaaataatgtacagtatgcttttgaatgaaaaaagcaagttttaagatggaattttcaaaaatattctcacttttaaaggaaaacctatatatttaaatataagcatacaagtaaatctggaaaaataatcagttataacaatggttatccttaggtggttagagttggtgattttctttatacatatttgtatttcctatcttgtctatagtgtattacttgtaatacatacatataaatacacatatacacacataccgcatacatttatatgtgtttagtttacaaatgtttcagcttaactccgaagcaagctgtgtttcatactagtgtgttgggtatatgtttaatattttgtaatggaaggactgagaaacagagtctagaaagaaagggaatggagtccctttagcatgagctggcctggagagacttcattggcactaactgagaatgactgtctctcactgcttagtgttttcctgttagacttcacgtgactttcaccttttgcccaggctgctttctcatggttacgttgtcccggcgttttggggatccctattactggaaatacttaggcagcaaagagttttattgaatggttgacttgcttgtaacggttaagtttggatttaaatttcttccctcctcttgatgttgtttatgatctcagcaaatctctctctaagcctcacaaatttggacaataaaactttgacatggtttttgcctggaacaactgagttaatggatgtaaaccagccaatatatggtaaatattgaatagttttcgcttatattttcttgagagcctgatatctgaagcagaagagcttcagatacgctttcatgtttggtatgctttcaaataaaatgtaatttagtcttttatttctggttatttttgtccaacattatacctaagtttgttggtaactagcatctccctctggcaattacttatttatttttttgagaccatttcgctcttgttgcccaggctagagtgcgatggcgcgatcttggctcactgcaatctctgcctcccaggttcaagtgattctcctgcctcagcttcctgagtagctgggattacaggcccctgccaccactcccggctaatttttttttttttttttgtatttttagtagagacaggtttcaccctgttggccaggctggtcttgagctcctgacctcaggtggtccacacacttcggcctcccagagtgccgggattacaggtgtgagccactgccctggcctccatctggcaattaataatgaactttccttcttcttagatgagaggaataggggaggacaggtgaaaagcaaggagtctggcaatcctcattgtctcagctgtactggaggttgtactctgagcacagtgctctaaatttcctgagctgtcaaactggcagcttcctcaaagtttatggaagacagtttaagtatctgagtagttttgggttcccaagaataataacacatggctgttatattttttgtttatatgggcaaaaattttagtctttaaacaatgccccaggactgtgattatgacataaaaatgctctttgctttgtagagtaaagcaatttgctttgacttctattgacattgcaactgaactggtcttacttgctttataattgaattgctgcagatttccatcgacctttgcaagaggtagaggtggttcctggagttgtaacctgatgcctattagctgttgctataactttataatggggtctttattttttgtcatgtgattggttttaacagctgattctctcatcagcttttcctggcatgtacttttggcatattttagctgtcatagtagctttttgggcaagcattatgcttaatttctttaaatctttgggcaacagaaaataaaatgtacttattaagtttatggcaatttcattacatcttttcatgccttaatgtgacattttaatttatagttcaggagttgcctttttagttttggggggaatgcagagctgtatgtagttttgtttctgtgcttttgggattgtggagtaggaagctcttttcttgagaagtcacatttttctttttctagagagaatttcagatacattatattagccaagtgaattattatctagcaactgactgtcattcatctgtacattatttggcttcattatagttcccattttgtcttgccatgtttcagagggaaaatgaaacgggaggagtgaggtcgttctgccccttaccctggatggcattacttgagcttgcagtgtaactgagaattggactaagtggaattttaggaagctctaccatgcggcagttataacctgcatctcagtgcacctgcccgtgctgagaaacacagttagcttctttccttaatgggcagttggcagggttaatgtcttaatctttctccctttttccccctaatgtaagacttaaggaagattttctgatcaaagaatctggacttttttctagcagtaatcatgcaatacttactactctatggacagtaaagaagaatttcctttggatggtagggtagagttgattttcttttttaaaaaagatatctctaggttcacagtttttaaaaggtttcattttaatgtcaaacttagtattccgtaacctatctttactattctaatttgtttaataaaggagctgcctctgtgtgtgtgtgtgtgtgtgtgtgtgtgtgtgtgtgtgtatacttttccagttaaggaaaactaatgtataagataatatgatataattccgtgacctaggttttatagaggatgagaataaatacctgggctgaaaaatatctcaattttaatttttatcttgctttggactgtttctttctgtagatcttatctgtttggtgcctctgttgatagtgcttcatgaagaaaattatctcactcagttccttagccatttcagttgaatttgtgatatgatttggtgtgtccccgcccagatctcatcttgaattgtagttcctataatccccacgtgtcgtgggaaggacccagtgggaggtagttgaatcgtgggagcagttacctccatgttgttattgtgatagtgagtgacttctcacgagatctgatggttttataagggggctttccccttttgcttggcacttctccttcctgccatcatgtgtagaaggatgtgtttgcctccccttctgccatgattgtaagtttcctgaggccttccagccatactgaactatgagtcaattaaacctctttcctttataaattacccagtctcaggtatgtctttattagcagcctaagaatggactgatacaagttgactagcatacggatagatggagagggagtgccaggttttctttggcttgttaggggttgattgggttttggacctgactttgacccttctcagccatgctgctcagactgctctgtgtgtactggtcattccatgtatagattacaacttctaggtagatgaggtcctggaacaccatgacattttggtccagccaagcatctgggtaagctgtgaagaaacaaggctgttcagttttcttcaaaaactgaggaatgagctacttggaaaaaaaacagtcttagataatccagctaggtgagataggtggtttttctgtgttctttggtcatgatctttttcagtttccctcagtcttatggtaactttggggatctggtcacccagtttctgaaagctaataattattggagtactagtgacaagatgcaaaatcaaaattttggacaaaactgtaatcctgcctttggggcagtaagaaatcataagctgttctggaagtcatgctcctttcctcagaattggaagtcttgaatgttccactgtccatgacaaactgctgccccagtagtttcaaaacaagtggatgttatgatgtacttctaagtcttgggtagggaggaagaggctgtggacaactaaagcatctttggatgtccttgttaaaacagaatgccatacaagatgagtcattgttctgatccaatatgacagtctgagatgtctctttttgcagggagtaagtaggatactttgacctgtatgtaccacatttgaggaaacagtatggtgcactctactcttcccaggcactagatcattaaagaatggatgttggccgggcacggtggctcacacctgtaatcccaaccctttgggaggccaaggcaggggcggatcatgaggtcaggagattgagatcatcctggccaacatggtgaaaccccttctctattgaaaatacaaaaattagctgggtgtggtggcgtgtgcctgtaatcccagctacttgggatgctgaggtacgagaatcgcttgaacccaggaggtggaggttgcagtgagccaagatcacgccactgctctccagcctggtgacagggtgagactccgtctcaaaaaaaaaaaaaaagaaaagaatggatgtcagctatatcctttgatctctgtcaatcttaaaattcaattgttggttccatctcatatgctggctgaagcttttcaccagctcctagacagatttaactttatttatataggtcacctctggattcattgttaagaattaggttttatttacaacatcaagtccaaaaacatttgaactggggtaggaaaatacaaattttggtttattttagttttcactattcagtgtagcattaggtactactttttgacatggtatagcaacccagactttattttagcagagtagaaattatgctagaatatatatgaaatgagtttggcagttctgtttcttggtactagataccactctccttttcagtggcctgaatgtcctgggtaacattaggaggaaaggctgccatggttaggagattttattgtcatagtatttgccatgtggtagaaattaggacatgactatctcatgcttagttcaaagattatgttttaaacaggcttatactaattagccaaacaaaactctcatcctactgcaacattttataatcccccccatttcaggttcttcctgtagattttcttctcagagctgttagtctgccactgtgacttttacccagaggtgttgattcttgagggtatcctttctcctcccctacctcctgaaccctcgtcttccaatacagacattcagccacattgtggttgctttagtcctccttgggtacagcatcattagaagagacacatcatttgggcagagaagccactgaaatactcaaagcaagagattattggttttgattgggtggccctatttaaaagatagaaaatgcagggtgacaggaggatgaattcaggcacaaggggatataggggcatgaggtggatgttaattggagcagttgtgctcaccctccgctggtgaaagagttcatttaattttggttgaagtctgtttttcccttaatgaattttgatacaattgctgccttctcttcaaagaagcaaatgttcttctgctttttaaaatgacagttttttttgtttctaaagtggtgcctttgttttgaaacttagtgttatttctctgttactttcttaaactatatttctctccccacttccaataagacaaataatttaatgggctatcaactccctctgatctacccacccccaccatgttggtattttccagaatttcagttctggattattttggttatgttattttccttttcttttgtcttagattttttaaaagacaacaatggacatgatcaagttagctgaacatcttatattgcttcttttatttaaatacttaaggaatttctctgagagtgttatcagtatagttcttcgtgtggccatcctttggggatttttatatctggtaatagttttattatgccctcacatttgaaggcagtttgaatatataattctctgctcaaattttttttctttaatactttaagaatactacttcaatttttttttttttttttttttttttttttgagatagagtctcactctgtagcctataccattacaggcacccaccaccacgcctggctaatttttttttctttgtatttttagtaaagacgaggtttcactgtgttggccaggctgatctcgaattctggacctccagtgatctgcccacctctacctcccaaagtgctgggattacaggtgtgagtcaccacacccggcctaggatactacttcaatttccttctgcacttagcattgctgttgagaagtctgatgccaatctgattctttttctttttatatgatctgctttttccatatgggtgcttttttctttgtatttgatattattaaatgttaaaataatatgtcttacgtgcaggattttccttactcctctgtttggcactctcagtcctttataattgaggtctttgatgtttctttaattttgagactttgattattatttaaatatttcctcctctgaatttgtttctgggatctagattctggcaatttcacttctattctctatattacaaatctctaaatctctgagttttcttattcattgagtttgctgtcttagttttctgtttttagaagttctcatttacaagtccatggtgaaggaggatttttttgtgtgtatgcatggttagggtgtgttggatccatcttctcccctttcttttcactgtctggctattgcctccactggggtcacctaggtgctggttcagagccaggtctattattgccagcacaatgttcttgtccttgggataggccaaatcatcccccaggcaagtggggaacttggttataggttcttggcctccatctagggtggagggcttctcccagtccctatttccacatgaagagcctggctgtagcccctctgccccatgcttggtatattattatagatactaggaaccctacaggtttttttgttttttgttttttgttttgagacagggtcttgctctgttgcccaggctggagtacagtcatgcgatctcagctcactgcagcctccacctcctgggttcaagcgattctcctgcctcaacctcctgagtagctgggattacaggcgtgcaccaccacacctggctattttttgtatttttcgtagagactgggttttgccatgttggctaggctggtctcaaactcctggcctcaggtgatccacctgcctcggcctcccaaagtgctgggattacagacatgagctgcagcgcctggccagaaccctgcagggtttaaatgtctaggtggttctgttggtttcagttggtcttggaaccataaacctttggctaatggtccctctggttgtttcttttttgtttctgttcgacagaaatgtgtaacaagtttatcagggaagttatgtatttttatttattaaaaaagatttggggggggttatttggtgtatgtgtgagggagaggtaggtttctccttaatattccgtcttggctgaacattttctgaatgaactttatcacaagagtgtttctgtgttataattgcagttactttgttctcagcaaaactttcttttgatcctattaactacttgttaattagaagtaactaagtttattctgatctgacaggaagagtatttgtataccaaagtaggtttcagcgtcccccagctagccaaatgcatgactgtgaggtttgcttaaattaaattcaactaatatattagatcttttctttttatgcatttttctttcctcttttctgtcttctccttttcttccttactcctgctaatacataagctagatgtttaagaatgaggagcatgggatagctttgctgatgtgggaatggtccatctgtgaggaataacagaaactgtctgtgattttataccatgcccaaaaaatcttcagctacgtggaagaacagcagggaagggatttcaggggggaactatctctgacgtaactgttaggaaatatatttgaaaggagacaaagaagaaatgaatgaaatggcagggaagcccaaagctttattccttccaacaatccaaaagcagttctgttcaagtgaaatgaccagaaaatgaatgaagagaacagtttgtcatcatcacaacaaaaagttaaactacctgaagtgtaaaagcttatcattagattaaaataagatataaacatcctctaaattattagaaatggtagaattatcaagctcttgtttcctcctcttggtctaattttctgccaatctttgaagatgattttagtctgtcctgaaaataaagcacttgttcatgtgctcaggctcataaaaaatcagattaagtgaaatgtggtagctatcaccaaagacatgtcctcttgaccaattgtggtcagtttttatgagaattgatgtttgttcaggaatcctaaatatttgcaaaagaacactgtgttgtatttaaaacaacaaaacaacaacaatattgctttaaagaaaagccagctctcttggccgggagatccctcaacgttcttttacttttccgcatcttcttccttgctctctccatccagtgctgtgacttcaactctctgtgcgtgactttcagatcaataaaactatcccaggcttctcttctgagctctagggttgtataagcaactctcccttagatactgccacgtggattttttattgacaccccaaacccaacatgcctacaaccggtcttattatctccctcacccagtatgctccttgtttttttattccctatttcagttaatgattctaccatacacccagttcctaagccatgaacctgaggctcatcttaagtttctctctcacccttcacctttgttcactgagttctaatgactgtcataactgaatatcttttgaagctgttctccagatcgtatcacttccctgcttaatccctgcaataccttcccagtgtctgcagagtaaattcatatgcctttacattagatacaaagttctttaccctacatcatgcacctgctttctgcatttgaccctgttctccaacaaaatccaacaactactgtggctctgaaaatggccacatgctctcctgtttcttttctttcagttttgatactttctcgaccagaggctttttccttgaaactggcaataatttcttccctttcctgttgctgcactcccacctgtctttcgctcctgacactggtaactctgaaaactcctttttctgggtctgaaagctccttgacataaccatattacagcaaacaccaccttgtttgtctttgcctgtcttctgcattatactctgggcatctttgggttagggactgcttgtctgcctgtataattcagcatctgtggtatgcctttgtacataaggagaagctcagtaaatgctagttgggtgaataaagtggattagagatgcttgtggctcaaaacgggagaggatgagaatccaaaactgtgtgcaggttttgtaagaatatgttggggtcttcagattttttttccctcctcaatttgtagaggcagtggctctccatgctgatgctatttcttgtggcagtggcagtcctgatgactcctggattgcctggcactgctttgtgttctctaaggcttcccaagaccaagacgtggtctgcaccctgacaaaatgtacaagggaaatgggcacctaaaaccaggttataaaaccagtatatgatggcgaaatgcaaaattgatggctgcagacagctctgagaaaggagaaaagaatcaggagaggaggggtttggcaagtaccttgtgggagttaaatctgaggatgctgcaaggaagtcattttctcttctaatcggcggtagttcattttccagagtgtcttagagtctgttcataaatcctttggtaccatttttgttcactcactggaacaacctttttacccagaggtgatttgtctgtttgtagatgcctgttaaagggtaacacctaagggaagagattgtgtgatcactcagaagaaatgataggtgaaaaataatgagtgtatctgactttaattctcaattttaagttagctttgtgggatttaaaatctttattcccagccaggggtggtggctcatacttgtaatccgaacactttgagaagtcaagacaggagaatcacttgaacctagaagtccgagaccaagctggacaacatagggagaccctctctctaatatatatatatatatatatatatatatatatatatattttaggtgtataaatatagatatgtaagtatataggaaaaatgtataaggaaaaatgtatatgcatttttcatatatatatgtgtatatatatgtatatatgtatatatatgtgtatatatatgtatatatatatgtatatatatatgcattcattccagaagttgttgaacatagaatattttttaagttttattattttcatagtagttaaaaaatgctaatttgatttttggttaactaaagtttcagaaatggttgtgagtatttaatgtttgtgtacctgatgatttattctccctcaaattcagtgattctctcaagtaggtaagctcattcctgaacagtgaaggaggaaggaactctatacacttggaaagtagggtgaagtgtcttctcctttgatcaggctgtgtcaacattcccttctaccaatgttattttcacttgagggttcaaattgccactgtttggcaggaaggaagagagaactctcttaatagaatgtgatttaatatgttgaatgacaatttgtgctgtgtcagtctgcttgggaaaaggattagaggcagtgtaaatgatctgctctatctggttgtaaaaacatttcaggcatctttcaaaagtaacattaaacccctggtctccagttccccaaagttgcttctcattgacaggtttctctcggtaggagtaagtcagggaataaaccggtcccagactctcctttgctgcttctgccatgtcatgccttgcccaactgtcagggcacacagcccagggaggactgagggcctgggtccagcctcctgcagccagggagctgctggcatctgacttgctgtgaaggtgatcctgttctgcttcagaactgatgacagtttgctatgtctagctgagcactgagggcagccgtcatgccaggtcaatgttcaggtttactctggactccgttctggggttccatttgagattctcttaattttgaggggagtcattgctcatgatgaatgaaagacacagggaggggctggggaaagctggaggccagcccctcgcgtcacttgggctctttcacagaaaagaactggacggagttgagctcgctgggcacaggggatgatgtggtctttgttccaaagtggatggatcccagaaagaaaatacattaaaaggaaatcatagcagtggtctaccagtgggttttggtccatttgcctgaaaattggcccttctattggcgctgagtttctccaattagctaaacgttttttgtggtgaagcgctgtggaaaaagtggcttcactgaaagagcaatcatagtcttctagactttataaatagactcagacaagaagaactgccctgtggagatacggttcatctcttgctcagccatctcccccaccctccccgggaacacacttatgaaataaagagctcagaaaactcttccttggagtttcagtggtacagttggttagtgtgcagcacttaaacagaaacctcttcttaacagaatgttctgcacagtgtcctccaggggtccccctcaatactcaccataaacaatttcttcttccagccatcaccaccatctctaactcctgcttgtctggattcagttgttctagatctccatttctgagattttctctcttaacccttagttgtaagctgggtcaggagtcaataataattattttgtacaatcagttttcaagattcccctggagtctggggagctagcttaatcagagcctggaatttctcttatgcttcgtttttaggagaattgaaatccatctggctgggtgcagtggctcacgcctgtaatcccagcaatttgggaggctgaggcaggcggatcacctgaggtcaggagttcgagaccagccttaacatgaagaaaccctgtcgctactaaaaatacaaaattagccgggcgtggtggtgcatgcctgtaatcccaactactcgggaggctgaggcaggagaactgcttgaacctgggaggcggagcttgcggtgagccgagatcgcgccattgcactccagcctgggcagcaagaacgaaactccatctcaaaaaaaaaaaaaaaaaaaaaaaaaaagaaatccatctaagatgttttttgagagcaaggtccttgctgttgctggtgttcttgcttgctttgtttctaggacctgggagtgaggaaacgtgaagctttaatcagctacaagctgttgggggctggggttatggacctctatgtgtgtcacatttgcttccatagcagtttaggaccatcacctataaaattaaggccaagtcagtgccatctttgtagaacattgctgcctctgcagggttgcctggagcagttaaaatttaatggggactgaggattaggccaaagggccaagccttgatgggtgcagatcaggtgcattttatggtagctgggaggactgtgaaagcaagaagaccaatagagggaaataactgctcttgtgagctctcttgtccgtcttctgcattttctacccaagcccacaatgtatacaaatattatactaaacatatttaataaaatggtcccctgtgaatggatacattgtgcaactcatttaaaaaaaaatttagctttggtttaaattcatcgtgtggcattaccacaaaagcctaactctcttgtagtaccctccctgatatccaaagggaaatggaagtttgtctatgtgtgggattttaatgttggggtattagaaattataatccaagataccagctcagtaagacaagtcccttttagagttgtctaatttattatgcactaaatggcaactgagaatgacttaaagaaccaataggtgaccagaaaggaagaggttggaccccacagggctggtgtgctgcttggagctattcttgatttcattggtttatacctggactccgtatagtgaggaagtcattgtggctgccattatgccttttatcttccattatctgattttgatcattgtgttttcttgtaaggaaaacattcctcgctgtgtattatctgtggtttattttaagcatctttgattaaaaaaaatgtaaagacaggacacccagatactgtcaggctgaactgtaaatgtaattttatcatttgattgactaatcaagtaacaccatataattattagtggagttttttcttctccaggtatttgtttgatattcaatgctttttttcctcctaggtgacaatccttacccttccaaggaggacacccctaccagcagtctggactcactttcctccccgtctcccgtgactacagctgtccctgggcctcctggaccagacaaaaaccaccttctggcagatggagggagctttggagactgggcatccactatgtaagtaaccgtgcttctgttgggtgctgaagggtggaagccctgactttgttcattttaaagtttccatgagcagtgacctgtgggtgctgaagccattagatctaggagcccttgttttcttatcagaagggccaccaaagggagaagggtccttaaaacagagccttccttgaatactgtctgtgtttctagtatggaaggggtagctggatgctatgtcaaatctgatcgaagttcaattcctgggcagttttggattctgcaacggaaatttgttactgtcccacccaagatgtttccccactagttatgcaaactttagagatgtgagaatgcatgctgatggacagactcttgaaactgtctgtagaatgatattttacttacatgaatttctgagagcattatgctagcattctgctctgttttgctccatagcatcctgcagagttgagacttgatggttgacatttgattttatcttctcagtttggtttagtgccaggcatgtgcagatcagctcaagtatattaggacaaataatattaatacaaataaagtaccttgaacctgtgagggcttgtctggctgtgttgaccaaggctgtggagtaaaggcaggatggtggtgatgtggaacccaaaagggcatcacgtttcaaacaagtgctcagagaagagaaaactccaataataattacaaggcaatacttgattagtcaatcaaattttatctaaaaatacatttataattcatccagagaatctttttttttcttttttttaaagatggagttttgcttttgttgcccagggtggagtgcagtggtaccatcttggttcactgcaacctccgcctcctgggtttaagtgattctcctgcctcagcctcccaagtagctgggattacaggtgtctgccaccacagccagctaatttttatagttttagtagagacggggtttcaccatgttggccaggctggtctcagactcctgacctcaagtgatccacccgccttggcctcccatagtgctgggattacaggtgtgaaccaccatgcccagcccatccagagagtcttcaaaaaattttgttgaagccaaagttgcttaaaataaattatagataatggtgtcatctgaccctagctgggcattctggggactttaaatggactggaaagtgttcctcagattacgtggctttttatagttactgctggattcacatgaaatgattgtgaacttattaagtattaagagaggctgggagacatttggtatgccaaaatttgggggtgatctgaagactttgaaaatctgagactccaagtatggaaacacattctccagatgagatttttcctgccagtgttttcatctgtgcatattttttatgctgaggattgtggatttaaatcctacattactaggtatgcttgtcacctttactcttccttttccacaataaaaattctgtttcaccgtagtactacaagcaacaataacagtagttacctaggcacgcagaatctataatcctggttacactcgaggtggaatttagcatgtgtgtatgttttagtgaaaaccagatctctaattatgcctttcagtaagtgaatatcacaggcagtggagtgcagtttaagcagtcatctttcttctgtagcagttctgcagaaaactgacattatgagccacggtacagccaacactcaattcacaacacgtccatgcctgaaacaagaagggcttgatatttttggtcataaatcaaatgaggagtgaattccccagcttcctattcatacgcattttaaaatgtcatgaaaagcactccaaccttgagaggccaaaaagggggttggggggagtagttgaagcaagcctggaaaggagattttttttttttttttaatggagactttcttctatttcagaaacttgatttatttttttctgtgccatggatggaatacatctatgtttctctgaagtatatactaaaatgtttcttatgtatcttttaaaggatttactgatgagtgtgtatcagtccagatttgtcattatgttaggaagtttgtatatagatgagtgcctcttggacttgagtatgcaccagaacctcctgtaggtctcactgagacccacactgctggccccaccctggagctgaggattctgtaggtccgagaagggtcctgagagcttgccattctaaggagttcccaggtgacgatgaatgagccttgatatggaagaccatcccctgctccttgcctgcctccagggctgtgctgagtataagctgcttctctgaggagcgtaattaggataagtgattgctccacctcttttgtgtaaaacacactcttctagggtcgtgcgttgctgtcctcccagtagccggtgtgtgcttcccacatggtctggttctctttgcctcaaatatctgtcctgcttttttgctcaagccaatcctgacctatcttaacggtctaatttaatcttcacctccgggaagtcttccccatgctgtaatctacagggagcctctaaagagattccttgtccgtatttctgctgatacttattatttggcgctaagaaattcaagttgcctttgagtgttctttaatatttgccttttagtattatttgatatttatatggaataaatgtttctacctatctagctaatctttcccttaccccaagctagatcataaaattgttttttttgtttgtttgtttgtttgttttttttgggtgggggggcggggggcggggggcggggggtggtggtggcggtgggagggtggggaagactgagtctcactctgtcacccaggctggagtgtggtggcatgatctcggctcactgcaacctccgcttcctgggttcaagtgattctggtgcctcaacctccccagtagctgggattacaggcacgtgccaccgcactggctacttttcatatttttggtagagatggggtttcctcatgttggtgaggctggtttcaaactcctgacctcaagtgatccgcctgccttggcttcccaaaatgctgggattacaggcgtgagctaccgtgccctgccataaccttgttaatgataggaattagatcttatattctttgaacttttttgtgatattgatgtaattattagtgaacatttaatttcttattttaatgatgtatttatagaaatgctgccttttggaaatctcatttctttctctgtgttactgaatgtctcttaggctactacatttggtttcttactcatcatcatcttttttttttttttttttttttttttaagatgtagtctcgctctgttgcccaggctggagtgcagtggtgccatctcagctcactgcaagctccgcctcctgggttcacgctattctcctgcctcagcctcccgagtggctggttctacaggcgcccaccaccacgcctggctaattttttgtgtttttagtagagacggggtttcactgcgttagccaggatggtctcgatctcctgacctcgtgatccacccacctcggcctcccaaagtgctgggattacaggtgtgagccaccgtgcccggttgattcatcttctttcttataaagattacaaactcttcctctaggaattccacacaattaatcttaccatttgctccttactgtgttttgtttccttagcatttataagttctcattgtatgttctcttcttgtcttttccccctttatctctgcataccagctatacagtattaaatatcataggttctaagtaaatgctcattaagattccttttaaccaaagttgctatggagtcattgaaactctactctgggctcttaataggaggcaatgcctttactgtggtctcaggtcctaaggaatggagtccaaatgtatgtggatcacataggaccccagtagatctgttgaacaaaaatgctaaaatcttgtccactgggaagcagtttgcagaggaaaacttacagcagccgtggttctgacataggtggtgtagctgttgcctctgataggtagaaaacaatgcagcagaattggattccttggatttctgctgatgttcatgacttgtgggtgttattcattgcagtcaatcaatctgtagctcttacttacctgtaccctcagtaaggcgatgggtgacttcattgccagtgaagaattgctagctcagtctccttggaggacattgcatcataggtcaaggtatttcgaatgttccaaagtcattttttccccacaataaggtagttttcgctaaacaggttttcttctattgtaattgatggagccgggtccttgacaagtaatccttttagattctctgccacaaaagaaaatctcttttaagaaatatcgggcattgctatctgcttcctctacagatttcaaatgaaaaggaacacctccttttctgctggcacattctcaaattcaagatggcatggtctcagaatagctcactctagctgggggtgccggcaccctgagatgcatctcactgtgtgccctggcaggccaggagggcagtagattcccctctcccacccactgagaggcttggctttgtttatcctgaatgttgatatctctaaagcatctatcccagctagtgcctcaagctgtcgttgtgccactgagatttgtgcctactcagacttgatgtcagttatttaaaatcactagataacaccttcctattcccatatacagccttgtgcatgtcatcatatactttgtgtgcactcactggtaaccatttttattctcgtcaatgcaatcacttgtttcctttaaattgggcaaatgaatggggggtttctcagagacagctgcttggcatttcaaattacttgactgttggttccatgattgcttttcaggaagtcaataaattttgctgggagataccagagtaccccgctcccccaaatatgatttgtggcttagtacaccacagtaaactgtgaatgatttgcctaaagttcagaaaaataatcattttagatcatttttaatagatttctgtgaagtctggtgcctactgagaaattacagggtgggagtcactggcaaaccctgtcttcacttcctcctttcctctctctctgtctttccttcttccctctctctcctccttcagagagggcttcctcaaccccagcactccttgagggccaggacactcagttcaccctagaagttggtatcttaatctgattatgtaaaaaaaaaaaaaaaaagatttatcttttaaaagtgtttttttgcacatttgcttttttttttttttttttttgggctaattgaccaaaatgaacatatactgcttttgtaataagaagtgggaagctctgtaaatttcaggtcaggagagggtgataagtaacctaaaggaatgaacttcccattgcaaaaacttcctgcatctttcttggttagtagggggatgatttcctaataagatgagcagctttactctgtttacttgtatctgggccctggttacagaatgcagtgggttacactgagatctctaggagagcctagtgccttcttgtggaaggatgtggtctctgattctgggtactgtgaagaatgaattggcagccagtacctgttaccatacctaagtaaacagcagggtcacttagatagtggaggtctaagggagctcaaatctaaggaagaacaggggccaaatgaacaggaggaacatgctgccttgctgtgagcccacagcagcctgttaaattctgcacagaggttagctccttcccctacctcttgggggtctggggatttgagggagtagaacctttggctttagcagaggctggtggttgaggctgcagaaaaagtattagataccctcttggcacttccaggctgagagaccatggagcatttagtattatgggccaccagactttgtttcagctattttgtagatgacgtttcatcttaatgcttgcatcaacccagtgcggtagatatatcttcatttttaaaaagattggaaggcgcaaaggacataggaaaattggcccaagccacacaagcagtaaaggacaggtgagtttgacccctcatgtgtctgcccagtgacttgttttactgtagaaattgaaattgtgcagttgcatatggggacattgcttgaattgcaggtattctccaccctgccccgattctgaaacccagtgaaacagccatggctgtcaactggtcagtgcccttggtttgaagagggagcactgaccttacattaagtcatgtggctgtggtttataattatctatggggaataaacacttgaatctggttgctgcgcatttatcatctaacaccttggctgagatgcgggcgggagggccttctcccccacagcagagcttgagagacttggaaatttgatctatgcaaccaggcagcatccataatctttttatgagtaatatgatattcggttgtctcccttcagcttcagaaacgctctggaagtgattctcagggcctgtatacttggccatctaccatcacattgtctattcacattcagtctgggggtacaacttttgtcctgtgtgtttccttgaatttcttctctccagctttgtatagaaattatgctatgccgactgcctggccccttacatgcttcgatacacatccattgtggcttgctggggtatttttggtatctgcgttgtgtacttggcacttgcgtgtggcctaattcgtgccttcctttgctgtgctgtagctgcaggtgctgaaatttggaggttttatttttaagtcagaatgttgatagtccatgtaactttaaagccctaccatgaaaagatgacttcccaaaataaagacatgtctgaattttgtagtagcttttccactgcttaagacttaaaaacaattaagtcttgcatcagtcatttttggtttttagtttaactggtttttgttgttaaagattttcttacttgatgccattgttgtaatttattatttgctattcataaattggctgtgtctcaatatctaaataaagtaaggacctcatgggctctctccgtaagttcgagaccgtttacattggtaagtcactgatttcaaacaggcctggccttgcatccacgttctttttcttacaaccttgaagatcttttatataagtgatttaagcaaaccagggatttaagcaaaccaaggcttagcaagattatctgtaaaaggggaataataacatctgcccctctgggccggggtgaggtttccagataccacatgtaataaaacccaatcactgctcccctgagagctcgaggcagccacctgctgggattttcctttcctctgagaatgtagtttaatattcttagtttaacttgaccccaacttcctggttcatcagttacataatctcctcactgactagctcagagagagaacctttctagccttggagaagctctagatgttgacctgaagttgtgttgtttttagcagttactgtatttattcccggaggactcagctggggcttctctcctagcctcttgctttggggatctgctttgtcagagcctctgagaatagacccttggctatcacatgatcaaagcatggggaacctactgagacccaaccacatttataacttattctgagccgtatacccaggtagctcacccattacaacaagtaacccataaatctctttgtaagtgattggtggatttttctgagcggagtatctgtgtccctttagagctgtgcttggccctgttgaagatgttcagccttcacattgggtggcagctggtcgaaacattcctgtcagtgactgcaggacagtaaccttcagacctcgaatgccccctaattttctgaaatgaagttacagttccttttctgttcaactagcaagctaaagttcagccctcttacctgattccacactgatcatctggaaggaaggtaggattcaaggagaactctttgagtggaagagcagtcagagatgtaattctgcgcctgttctcttacagcaaaaccaagaacttttgctctaagagagtggactttgggagtgaactttgtcagatgattagatggtgatgtcctttcttgttaaaggaggaaatccatgtaggagcctcaggatcgcacaggctgaggactgagtgttaaacatggcaggccttccttcatggggcttgagggatttcctgcagtgcccttcctcctctccctgaccgcctacctcctgcaaaagatatttgttctcagctgggcgcggtggcatacgcctgtaatcccagcactttgggagactgaggcaggcagatcacttgaggtcaggagttcgagagcagcctggccaacatggtgaaaccctgtctctactgaaaatacaaaaattagcctggcatggtggtatgcacctgtaatcccagctactcgggaggcgaagcacgagaattgcttgaacctggaaggcggaggttgcaatgagccaagattgcgccactgcactccagcctgagtgacagagcaagactccgtctcagggaagcaacaaaataaagatatttgttctcaaaggtgaacaagttactgcttttacgtgctggcttcatgtattggctggctccctgctgcttgagagatgatcttatacagttgaagaaggcctctgctgcaggaaagcactgggtatgtgtgggtcagccccaggcacgaacaggggagccccgcaccacaaaaccagtgaagatggaggggattctccatccgaattgtcttcatctcccccaaaccccacgtcccttccaggcttcttatctggtctgtttaatccaggggtgagcaaaccgtggcccactgccacctgtctttataaagttttattggaacacagctacacttagttgtttacgttttgtctgtggctgctttttcactgacagtgatagcagaattgagtagttgcagaaggcctgccaagcttgaagtatttactctctggccctttacagaataagtttactgatcttgagctaatcagtaatcaaaacaggtctgtttggaagggcccacctttcttaaaacccagctttaggaagtgcagttaaccactgtggtggtagatggagagtgccaggtgattttcagtgtaagcttcacacatctcttcttgtcattaaaccaaccagacattttccctatgggttttggatgccctcaaatgtttatttataatttcagaaggcttttagtgtttcagtgactgaaaaacctatgtggggttgttctttttataatgtatcatttaaaataaatttttattttggaatagtttaaggtatgcagaaaagttacaaagatactacagagcttccgtagacccttcacttcccctcttcacttcccgcccccaccccacctccggctcttagcatcttacagaactgtggtacctttgttaaaaataatgaaattagtgttgatacagtactgttaactaaaccacagacttcatatggacttcaccagtctttccaataatgttctttctctgtttcaagctcaaatccaggatgccatgtttctataagcaactttagattttttaaatgatgacatctacttaatatagtcatacttttttccctttgcatagctgatttgctgtcttttggtaaattaaatggttagtgatgatataaccctagaaatcagaggtaagatctgacctagaaatatgtaatagtagtgagggcttcatttattgactgcttgctatgcttcagggctttacgcctatcatctcatttaaacccacagtgacccagccgatgagtcatgactctcttcacgttagctgagggagtttaggttgctcagccaagtttcagttgtggatgacactaagtgcaggctaatgatggcaactgtgggccaacctctggggggcactcgtaagtcattcgcttccttctcagcatagcctctagctattgacaaaaagaggaacaagcctaggggaggaagaaactgcaagctggcactcagccaacaatgatagtgccagctctggcacccaggtctctctgcagagtggcagagtcttaggcatttgtaatttgcatgcgtacaatccttcaatggcccctctttgcctttaggttatgattgtgcctcctgaatatcccggtacttgcatctctcaccattctttccatattccattctagtcactgaaaaggacttgagggtctgagatctgtgctgtcttgtcaaaacagggtttactagaaacatgaccttgagtaagttgctttcacctttctgagatggtcttctcatatgtcatgtggaataatagggtggttgggaataagtgtactagtgcctgcctgttgcatctagcacagggctagattgcacagttgtgcctcacatgagcctgggtgtggggaggtgatgacgatgttgactatggtagcatcagcttcagcattagctccgcacagatgctgcctcctccaggaagccctcctggctatccccatggttattaggtgcttcctccactcttcctctgagggaccttgggcagatcgctacatggctctcagtgcctgtattatggttattaattgggcattctccactcacttggctgcagagcaggtggtgtcacggtttcctgggtgtccccagggactagcacaaggcctgacaggaagtcctcagactgtaaatgatgagccagtgggtctactccgaaccttcctgatgggcagcaaagtccttctcccccaacgccgtgggttatggcgacttgcatgtcacaggcctttgtttctctgcactgctgttgtccctcggtgtgctcgtggggagccaaacaatgtgcttgcgtgtggagttctccctctcctggcacttaaggaataactggcatttatttgaacagagattttcccataatatacagatctacaatatttccttctgtctttattaacattttcaaacactcttgcccaggacagctgttctagacttatgctgtatgtttcccagactggcatgaaagatcatttcactaatgtgttagcttctgctcagagacctggcaaatgagagtttagaatctttcattgcagtgcaaacttctgatttgatctcgtattgtataaccgtagtgaaatatcttggtatttgggggatttagtcacttcaaataagcattcatttcttttcttaatgcgtattctcctcgctctacccttttgaatttagattgcattcagtgcttatacaggctggaatcaggggcttgtatctctagtgctgcccaaagcctgacctgtgtatattatgcaagaaatgtttgttagatgcaggagttctctggtgattggtgcaactggtgtcgagttttaacagttaaggcccctactcccttccccctttctgaaatgtttgtgatctgtcgctgccagaatgtttttaatatgcgtggagcgtagagtctggtactggaggcgactggatcacagtttgaatcagaagcagcatggactgctgatctgttccattttctaaaaatacactttgtaaagtaaccacatatacagcactgtcataatttcatgttttggggtttggccccactgctgcacgtgaaagctacaaggtctttccccgaaattcaggcccatgtttccaagcaagagtgttgactctttttaaagaagagagtttcctcatcctttacacaaatgcatattctttccctgcttactgtcttcccagctcttccacccaccccacctaaacacaggaaatgcctccgtggcgtcaggaacagtcaggtagactttcagtctgtgcattttcaggaacgtgtttccaagttagcaatttgaaatcttcatgtgcttttagtgaaacactcttgtttctatttgtcccctttctttgagaaagaaggacggtgatgttggccttccgtgctgaagatagagaagaatcctgttttaggagatgccttttgcagtgtagtgtgttaagttgggaagatagcgaacagatattagcagttctgtatatttcttctgtcttggtaaacgtggtttctgagctttttaggaacagttgacttcttcctccattttcgcaaactgcaacttggctttcaggaaacttgtggcacttaggtacttttttgtacttggtcagtagcttggcattaaacagaattggtggtttgtgctcatgccagtcttactaatcaaaaatccgtagttaaagggacaacaagaaaaaaaggcaataaatagattttttaaatgtttaaatttgggaaatggtaggaaaggactctcaaaaatttcattatgttctagcacataatgagcttttaattattatttcactaatcacctttgatctttttcccaaagatgttctttgggaaaaagctggggctctcccctgaaccacagagtacaaaaaaaatgatctggtgagtgttttagttctcccaaggatgatactgtcaagaactgtgaagggtctgaaaccgtaccctgcttgcgagctaccaaattagcctaccatcgtttccgggatgctggcagaaggcgtgggactcgcggtcagagccaacagcctctattaatcacagcaatgacagtatcagtgttttcttgtgccagttccctgagttccagttcctacaaggcaatgcagcttgggccaggtcacacctacatgcctcaagagagaaacctggagcttagaaaacccagatcttttatgatgggtaaagcccactctttgagagagagagagagagagaggggagagagaggagagagagaggggagagagacgagagagagacgagagacagatatgccttagggctcagttctctcttggaacccaggttgaggaaaagctgttagtcctttgcttatgggctgccattccaaaatgcctcgtgttccttcaaaatgttttaaataaaagaagggaaagagaatatcagaaattctcttctaaaactaatactttcctctaccgttttttgagaaaatgtaggtattacattttagatgatatttaaaaaatgtttcgattcttcttattaaaaagtaacccaaagtttggaaggtaagagatggttacataacgaagctcatgtttagtttttttttttttttttttttggccttccaaaaaatatggacaggttgcttttgggagacactgtgaaacatggcatcatctgacgtgtactggctttagatgtgaacccattacacgacttaagtatatttactcacttgcctcacctgatccttcccagccgacaagcctctgaaaaatttcctctatccaagcagctactgtgctggttcccaaaccttgtttggctgcacaggtctcttctttcacaggcttccagttgtccacacatctcattgcctcatctccatagacactgtctccagccttgcacgttgccccgtcttgtgaatattccagcttacagtgtgtctgcccttgtggggttctgaaatcaaaggagttacctagtagaggcttctgagacacacccaggaaatcacatgcagaaacttaagtctacatgggaagtgtgggaggtaatcttggtgaaccggttagtgctagatcacatagcgcatgtgttaaatagcaacagaaagatcacaaaaaaacaaaaaaggtgaatgtggagaacttgaccctggacaaggactgctgattctgtgttcctgttttgggatgagatggagaaagccagggtgcgggacaggcaggcttttctgttgcgtatctgtcattacagtggttctttcactttctaaaaactgaggggtattttccctaaacaaacacacccacccacccgcgggtgttttcatggaggtttccttttttttttttaaagaaagatgtgaggatcaagcagacaatacctataaaatttatgctctttatttttcaagggccacataagtgtagtcacatagttactttatcttcttcctgtaactgtcctccctctaggcagagggatggcagtcattgacgatttatgactctgaagagctgatggggggtgtggcaaaacatctcatcttcctccattcacaccctccaagcaccttgaataattgctgggagataacttggcaattgtttggctaactgtggccttaatttcctgccagggcttcactcacgcctacctgtcctttccgttcctgattagtaagacaacattcagcgttccttttctgctaaaaaaaaatggagtgacttttgtgactgttgatacagatcactttaagatttataacaaatcttgccttgggataaaatagattttatgactcccagatgaatggctggataagggaattgtaaataagctcttagaagaataatgttttttttttttaaatgaccccctttttttcctgaccaaagcataggaaagcttctgtgtattaaatacctaccaagtcaattatgcaccagatttgtaaaatccacttttggttttagagctttctaatttggttgctccgatgttggctgatggctccatgtccccgccaatctgcctggcttcgtgagatctggaaaaagagttaaagatcttcctgtggaggcaagagaaatacttgaaggcatcagagaacaaccagtatcaatgtgccctttcatttattggtgtcgcaggccttcagggaaggtgtatgggttagagaggccacagggggagtattgggggaggtggaactggagctgagccaaggaagggcaagattagagcagggcggggagcttgagaggaaaggcaaagcttgaggcggaggtgggaacgccaggaagcagagctgtggcagacagggtaggctgctggggcgggacggcccctggtaggtgagcaggtgcaggagcattgtgtatagggagacaagtgggtaaacttggccctaggttgctgagtgtcaccgtgttggaggattgcacctaggggctggccaggagaccatgctggtactgaagaacacggtgctagttctccggcaggggaaacaatctgagagcatgctgaggagtgcagaagcctcgggaaactgctcgtggaaactggtgtactggtttagcagaagacggggtatcttaggtgaagagcacctgggtgctgcagacagggaacacgtgtgtgttcaaaatgtcactgaatgaaacgagacacttctcaagggaatgtcataaaccatagtcgcctccagttctgaggtcactgaagagtaattcagattaacacgcatcaattatttgaactctccctctgtgcttagaggccattccaggtgtctgttcactgacctgtttacattaactttaaaaaaaaagggaaatattaagaaatgctctggtcaccagaagtttttgctgttcattggtttcgaagtctttggccctctctagaggaagcctgaatccagtggcattttcttctgaattgccacacgtgtaggagcaggtgaaagatctttaaatgtttagctgatcttttgcagctgccggtcatgtgcttgatgctagattcctgtggttttccttataattagaaaaagtgaataccttgaatgtcccactactcctttgatcaattagattctggttttctaattagtgaactcatagggtgctagcaggttggacagattggagaacctggagaaggacagtaagacagcttgagtttggggctgtggctggtttctgggttgttggtatccgtagtttgggctgcagccccggcaggatgcagagaggactctgtccctactggtcaggcatgataggggaattagtgacctagtcatctgggattgggatgttgtgcatttcgtgttctgtggcctttctgctattaatcctgtccttcaaactcctacccttagcccaggccagacccgatcgtctatggtccagtggcttaacccacagtctccaaccacaacaagctccaactcagctgtgacacctctttcacccgggtcgtcccctttccccttttctcctcctgctactgtagcggacaagccacctgaaaggtacgtggtttggagtggaatgtggaatatggtggcagcacacacagggggcttgatgaacctgagcaggttcttgtgttctctgctggcaaaagcttgcccagatacccccagcatcctggacttcatggacagcacttaccaccttgtatcagggccgtgcctcacccagttcagtagcaaggacgttctttggagaatttgccttacatgagacttgcttgagcctactctgtctttgtggtgctggttgtgcatttatgaagaagttcttattttggaagaacttcttgctcatgagtataaagcacattcttcgttttaaaagtaggcaagctggcactggaaacattcgcttccatggcatccagtggccaagtccatagaggacagagctgctgccctccagcagcctcttccacctgtagtggctcaggtgcttcttcctgtcagtggcttcccccacaccagtgaggtgaggcgtttcctttggatttgattagactggctaaaagcatggtttccgtcctttccatgaacggacacagaggttgctttaacaaatggtgagaagctgggcctggtgtgcctttcttggggcggaggcagggtgtaaatacagaagactcaggcaagagcaacaagccccttctagagcggtggccacccggagtggatctgggccagtggtttctcacctgtggagtgtggctgtgccgcctccttctgccggctggccgtgtgtctccaggtgcgtgtgcttttcctaatagaccaactgaagtgcttggagataaacatgtcctgtggttctaacagtgctgaatggtaggaaagggcatcccaccaggtagggaggagaattaggtgaagtggttcagtgacagctcctcagagaggctccctgaggaaaggcttgaattggaaacccatcatttacttgaaaatcaagtactgttcttagcctgatgttcacttccacgttaatttctcttttgggaggagttgccctactggtgacatcagtgagatttggggaaggggggttggggggtgaagtttctctctgttttccacattttcattggtgtcttttgtattctctttcttttcagcatccgcagtcggaaggctcgagccgtgtatccgtgtgaagcagaacacagctcggaattatcttttgaaataggagcaatttttgaggatggtaagtgttagtgggagcttcgtctgttaatcctgtccgcaggattaataagtctgcagcatggagtgagcagtcagcgatggtgctgttgtcgggagggcgagtctcccccttgatgctttggactggattaagcggctgcgttaggctcccagaccccaatgccaggggcctgttgttgatggctggaatgccactatgcttgcttcttgattactctctgacccatctcatcttgtgggtcttcattcaggtcatctctctcctgacgggaagaagctagtgtcacttggacttaagaaatgtttctgatttgcacactttattttctttgttctcccagagttgctaaccaagtcctttaaatgcttcgggtttaccaactctgagtcaacagaggatactactgtccttaaaaatttttgatttctatttctcttaccatttttgtgctttacatttttgctgatttgaacagtgtgtgagtctccagattcgggtattgactttgcatattgaaacaagggtgtagcttttgaggatttaatattcatacacaagcatttaggagctatgcctggttaaatatttcaaaaagttctcttatggctcagtgtcttttttctcctgctcttgctttcttccctccccagtcctgctcattatgaaatgcattagttgctgtggaaaccgtgatgtcgtgtgtgggtggagctcctcagaagagttccagggaagcagtaggaaccttagctgcttggaatggaatggttgattatccagaatgtttgggatatgtggaatgtatcaacacgaggcacagtggtgtactgtcagtaatgcagcatttgctgacgattgttttttagaaagcaagttgcctcatttagaatagatttctatatgcgtgtgatatgtactcttcagagacagagactcctggtagtgtcagaaaacaaacaacaacaacaaaaccccacatggaacagaattagactttgtggagaaattttgttcttggaatagaagcaagatcattcctccatcaccataacatacatgcagttttgccaagagaatgtggaacgtagctgccctgccccaggcctgtctcatgttggcacaccatatggctgaaggggagggtgcgatggtagtattgaaacgcactcatttgagaaatgtgatgaatttttattttgtgtgattggatttgtttagaagactctgaactccctcctgcagtatggtttgtgagatagttaccttggtagaaggtgtatctactaggataccttaggctgcaggtaacaaaaattgacacaactgtttgaatcaatcatgaagatggattaaagtcaggtgcagtggtgcacacctgttgtgccagctactgcagaggctgaggcaggaggatcacttgtgcccaggagttcgaggccagcctggataacacagtgagaccccatctcaaaaaaaaaaaaaaaaagggttgaggggattagtttacacaatagtaagtgtggaagtagggagctctaattttaattcatagtctcaaagatgttatcaaagaccaaagtatttccatctctctgtggaactgctctctgctggtggacctgggcctctgtcttgtttccctggcgggagcgagatgactaccacagttccatgtatcatggccacactctggcggaaggaggtgtctcatccttgtgttcctttaagaatgagaaaacttttccaggaatttcttcctagtttacccatcctcacatcccagtatgcagaactgagtcacatgcttaccctacatccatcatttgcaaggatttagaccaatgagaatcacacggggtataggatacctgctctgggcacacagccatgtgaatgagggtcagtgcctaaagccaatgcagatctgccagtttggataaaagaggacagcctggtaggcgtctgacccaggagacttacgttctccaggtctaaagtcccgagatgatttggagtcttcctaaaaagaaagtgtgcgtgtacacacgtacacatacatagtcacacatttgtacatatgtacacacatgtgcacacaaataccagtgtctccgtgtgttttggaggaggagagccactgactgcaggcaacgtggattctgaactctgcaggtattttgcctgggctcacaccatggctttcttatcttctgtgtgacctgggacaggctcctttaggactctgtgcagctgattcttcatcctaagcggcagggatggccacaacattgatgttgtattaagatagcattggggctactagaaaaagaggtttctgagttgctatagacgtatgggggagaggctgctgaccacgatgccacactgggtacattgtagtgtgccatagacgaggctacgctttgagccagtttgtgtctcccttggttctgtgctctgcggtgctggtatccagctctgtcaggactttgctggctggggcaccccgggtgtctcaggagctcctcgttctgtccctcccctaaggctggctacttggaaaataccttgtggatgtgttgacactctctccctacccagggatgtgagcgtctcatttaatgtgagctacttgtcttgtaggtgccgccctgattcttttgcagcagggcagataatagtggaaggtgttcagaatcaacagcattaggcttgctgcttaataggaacacttcttcaaagggtacagtaagtttaaagcccttaagcagggtttatctgtgtgtgtgtttgcaccttacatcttctgtgcatagttgatctcttagctagttaaaagcaggtgcttgcccagaacacatctagtgaagcccttccttaaatggctatggggtcttcctgtctgacaactgacactgagaagacagactggcaggtcatctgaccacggcttctgtggagccaggcagtgttccaagtggccactctagacagctcagcccacaggagtactgccgggaatgctccctttctgcagaccagcaatacttagtgtccctggaatgcccaagacatttttcctgtgttcacttatccatttggagtcttccagcctccatagatgctcttgcagtgcaattcctttttgtacctcatacaggcaacaaaggaaattggtttatgccacccagtggcctttggagaaaacaaactggaggtcagagtgacccctgggcggcctcgtcagtagttatgcgtttgggatgtgtgcagctgtgagatatcctgacccagagtgtggttggcacaggggtctttagcaattgtgtagctccatgactgtccttgttctttgctcttactgggtgggcctggacttaagttatgagttccagttctaggcggaagatgtgtttctctagtagactcactaatgcctagctgtttctctggggctatgcctcccaactcccccgccccccaccctcgggagagggctgtgtttgtaaggtctcagggcagtgacgttcctgtgatggccagagggacctttcccttttctctgggcctggggaatcctggaaataggttttgctggtgaccaccagccagtcctgctgtgtctttccagtcaggtgcgctccagttagatgggcagtggttgcctcctcaggggcagggttgggaggggtgctgaggcaggtggtttccaggagcgaccccacgtggcagcggcagcagcagcgggactgctttcctggctgtcccaggctctttgtcaacatccacatgtagatgtgggggagcaggtgtggcccaaattaatccttaaaagcctctggcgattaaactttaaaggtctcagatagacacagaataatccctggaaaacaatttggcattatcttggaaagctgatcacatatagaccccacagcccagcgatgtggttgccagatagattcctagcacaggggaatctgagaaaaaaatatcgagtgaaaaaataagttccagatgactatgcgcttctgacttatgtgcttctggttaagctcacacatatgcaaaataaataggatattattagggatatgtgcttgtgtgacaaaactgaattttacccatagccatggtaagataatgagaaacacaacattcaagctactggttgcctcggggtgggagataggacagagcccaggacgcagcctccctgtgggtcctgtggcagttctgaagttgagtgtgggttcctggcactcaccgtgtgatgatgacaattcagtgatttcagtacttgtcacatacactgtctacattatgctgaaaactgagttggtggaagggacctgcctctctttggtgctacttggggtccctgcctcacacccgtcttgttccctgttgtggtctaaaggctgtgaggacaccgtggctgaagcagggtgaggttcctggactgagacctgcaggcatagggagggtgcgtgggaaatgacagacactgagactgccatgttctccacccataagaatggaaaagcagagccctgttgtccgcgtagacactgcttgggggaggagtggtgtgataaactaggagaggagccccagatgggtattttggggttcgatgctactgagagaggtcagatcttcagagagggagggagagcctgccagccttatctgcaactgcggagccacttttcctgtgcttggggatgccttgctgttggtctccagacccttgtagcccacctcgcccactgctcagctgggtccacttccaaggctcttggatgttacaggatcccccttggtcgcctctgtaaagcagtgacatctctctccctactggcttctgccttccagggaggggagggctggggaggtggtgaatggggttgtggaggcgtctctctggtttgttggttggggagatgcaggattcccggcctggccttggtttccccaatcaagcctcctttcacctccagcgttgtagaaaatcacctttttcctcctctgttcatcctgtcttttattaataccgagtctgtgcttgcgcaagtgtgtggtgtgtatagggtaggaggagaaatagtgagcatgtgcaggtgagactatatttgagactctcttactgcctcctcatagcaggtcctgcaagctaagtgctagtaaccccgtattgcaggtaacagccgagcaaggcccaggggttaatttcccagatgcatctaggtagccaggagtctcctctagggctctgacttcagccctgggccccttgccactcaggcccccacattgttacaaccctgagggcctgttttgcatagaatccaaagcttttccctgatggtggctgcacactagtagcactgccagctggggtgtttggatgaagtgagaagtctctaaaaatcctggtatgaagaacaatgtcagagtcaaggtcagtgaaggcatgaaggaagtaacttgctgccagatcgctttgagagcacatctctgaatttgcttactcagtcattacacagataatcatgtgtctgacacggtgctaggtgctgggtctcatgttatatgtgttacatgctctcatagtctggactagaagagaatgtctcagtgtgtctctcctatatatacacgtatgcctgcacacacgcacacagaacatgtagggtgcataactgggagccccgacctggtctggagccaggagaggagtcctggaagtggggggatgctgaagctgctctttgaagcatgagtaggtgctgtccaggcataaaggcagggaatagcattcaggcccaagggaacagctccagggaggcgttgaagccagaagcttactgaatgtaaggaaagtgcaggcggttagtctgcagacagccggaatgtgttcctattcatccaggggagggaagaacaaacagttaccttgttgcaaaggacaattagaattggattgtccctgtcttccaaactgtgggcagctataccttagaggaccatgaactcaattcgctgagttgcaattagcattcaaagaataatacttttctacacaaatctatggggaaaaaaagagtagaatacagaaaggaaggcattgcatgcgcgcagtgagggtaagagtattgcttcatgaaacttgtgtgtgttacggatgtgtatgcctgtacttggtttttgatatgaaattattctcctgggttgtgatcagaagccacctttcgagttggtccgctggagtagctcatgcctcccctttcctttatgccacggctgccacgcctgcacctgaccatggttgggggtttgagctggggcctgctcacagctgggggttatgaaatgcttctgtattgcatttccgaacactggtgaggagtgcttggacctgtgccctttgctgtccaggctgcaattttctcgttgagtatcacgtgaatatttatgaacagtccattgtgccaggcaccatgcccagatgtataaggctcaggctgccttcaggagtttcccatacagtgtgggagtcagacgagactctgagaggaggaggcatccaatcaggtctctaaacaggaggaactacctggtgaagaggtgggggaaaggcattccagtcagaagccactgcacttgcaaaggcctggagttgcagttgggatttctctggatgattcactgcagttgacatgcatgatgtgccagtggagtgtgaagagctcctggaggggcggctggagccaggtgcccaggggcctgtgttacagaccagtaaggagcttgagtttgaggctgggagtggtggctcacgcctgtaatcccagcactctggggggccaaggcgagtggatcacctgaggtcaggagtttaagagcaggctggccaatgtggtgaaaccccatctctactaaaaatacaaaaattagccaggcatggtggtgcgtgcctgtaatcccagctactcaggaggctgaggcaggagaattgcttgaatccgggaggcagagattgcagtgagccgagatcgcgccaccgcactccagcctgggcgacagagcgagactccctctcaggaagaaaacaaacaaacaaacaaaaaaaaacacaaaaagcttgagtttgactttaagcaggggagtgatgtgatcagctctgtgttctagagagttcactgtgcatgttcgtgcacagtggattggaaggggccggactctggaaactaggacactagttaggaggctgctttgggattgtgtagatgaggattgtggtggccagtgcagggaggcagagcctgtcaatgaccctggtgcagactttgtgacccaacatcccagaagtggcccctgttctctactggccactccctgcttgagcttttaagtgaacacccaggaggcaagtacttgggggcattttgtaaaagtgatttttctcttccttttcagtacaaacctccagggaacctggctggctagaagggactctgaacggcaagagggggctgattccacagaactacgtcaagctgctgtagctcctggcctcagagcccctgctgaccctggcacccagggacctgcctgggggcagagagctgtcttcctcctccgaggctctgggctgcacccacaggtacctccacacttgggagttaccatcatcacagtcagccctgggggtggggggtggtgggcagggatgggacgcaccacacagaactgtgattgtggatcaggaggggaatgtcaggattcgcaaaatggacttttcatttgtcaagtattgggacttgtgatttttaattatccagcatatagaatgagagggagggcagccttctgccacctgtgtcgcctccactggcagtcacgccaccagagccaccctggctccctctcctccctgagcacctgctgctgcgattttaaagggaactgtactactcgcagtgataggtttgcagagtgtgtgcttggctgtggcagcctagcttggagaagctgctgttggtgcaagggagatggtctcaagtcagagggaagcagagacgcgcgtctcaagcctgcccttcctagacggccacctgcaggaccccacactcactgcactggcagcgtgcactggcgtatttgtaacaggcttctcggtgctcctcacccgtgtgctgttttccaaacaccacctttttgcctcaaggtctctgtaaatgaaataaactgtaatttacta

SEQ ID NO: 1574 - DNA, 42235 bp, Homo sapiens
tgattggctaggaaagacgtccgttaggacgtgttgccctttctgtgtaagctgtgagcgtaggcggccctgagggggtgtgttgcaggggtttccaagcccagcaccagcacccttgcccttttccatcaggggttcagcctagggtccccgctggtgggcggctcccgagtcttggagaagagcacgagaacctagaccgcccccgaagtgcggagaccccctgggcaggctgaaagatggcggcggcgtctgtctctgcggcttctggttctcacttgtcggtaagaagcagttggcgcgagtgggccccacgtcggccctaagcgcctctttgagtttcctcacgtttcagggcgctgtcagtccagcttctgacgcaattctggaggtcggcgggaatgcctagattgccccgcgctccccaagcttccattcactgtggctgtgtcgaagctgcaccctctggctcccagtgaaactgggctggccgcccctgttccccagcccttattcaccttttggcgtagcaaccaaccccggttgcctaacattcccaagggccggctgggataactgcccactccctggcctgcaaaaatgtagctcttttggtcacgtgggttcagcggcccctctaggaaactcgccagatcaggtgaggcgcgccagtgtgtttaagagacgttgcagaatagtagtccgccgtctctcgagcgcttactagtcgttgcttatgctgtttcctatccctgcagtgcctcccactcccatccacattaacttcgttgtgtgatgctcgtagccagaacgcgcgcttcctgtcacctagaattactggaacttcaatgtggaaatgcccttttggagaggcgacagggggaattgattttaaatattgttttcgcctcatcaaatgtcaccatccagtttagttactggtattcactggtatttctcaaattggagtgtcgaatgcttaggtttttgaaaaccgcggcattggaaagctttgataggaagtaaatgttggagctcttatttctccagttagcaaatgttcgatgcctggtatactgttagggtccaaatgaacagaatagaaaccctgctttgaaggagaaaaacactgaagagaaactacacgtaattagtgattactgcgcagtatagtttaggaagtgctaccgtagtagaataatctagaggggagtgattaacagtgcttgggtaggctagagaaggtttcctagaagggaagatggagctagttgcgtgtcgaaggaattgtgattgcttgtcccaagagtagagaaaggagaaaaaggcagtgcgggaattttggagtatgtgctagaacagtaggtgcttttaggaaacttgagatagttcggaatgagaagaagtaatacggaggtagagctggatgaggtgaattggaaacgtaggtaaaaacgtgaaaaaagaaggatggtgagggaaggaactagaagagtatcagggtaaagttattttctaggatctagggggaaagagttggaaacgctaagaaagcctggtcaccttggagaagtcagtttcagcttttggagacttgttagaatttgtaataatgggactagaagtattacagtgtttcagccgaatgggaattagaagtttgcagagaggtctggggaagttaaggagaagtaaggaaagcagcaatttaaggttattcaggattaggtcagtaaaagaaaaaagtaaaaaactattggaagtgtcagcagatggatgagattttataggagatgtgattaaacttgggagaagagggcttttcacggctctcaaaagttaagcacttggagaccgaacaaggaatactcttacaaatgttgaattgagtctgggtgcgtggctcatgcctgtaataccagctactagtgaggctgaggcgggaggatcactgaggctgaagtgaggtatgatagtgccactgctctccagcctgggcgacagagcgaccctgtctccataaaataaaatattaaataaacgtttaattgagctgcactatgccaaggacacctaggtgagcattggcactgggatatagtcagctgttaatacttatacggtacccttgacagaaataccaaagactgttcattaggaaagcatattttttttgtgctaagctcagctttaataggattctaaatatcaagggtacactaagaatatctaggaacctccacaaatcaaagtataacaaccataactcaatctgctacatcaaaatgtctattttggaagttactgtttctcaaaacaaaaatgactaaatttagttggtttcttggtgcgtaagaaaacgtcctgcttagatgtcccatcagaaataaggctgccatttccaacagcgttggaaaagcacttagcttatcaaacagctgatcttaacagtaggcaacatttaaaaaaaaaaaaacttgttaaaactataccatgaactgagaacacaactcgtattcagatttcacggttatgaagattaacaactgttatattcaactgttttcgacattgataaactcatacggagctagttataagtacattgagatgctttacaggcaaagatttttaacaagtagattcataaataaccgtctttgggaagcagtgaccatgtaaatctcaaatgtgaacagcatggaagtagggcgataggtttcagttaggttctaggtaacgtttattgagtgattgctctggaattgataaacttcgactggtggaaaaggcaggaaagcaactatgattgggcataatgaaattaattccatatggaggtatgggcagcattgtgttgaaatacacaagaatgtctttcatgtcagccttgtaatattttcacaataaccttggtgattaatgacctaatctcttgatttgtccctctgacttttggtccttcgaccaagctgcacagtagctccatattaatttcccttaaaaatgttttatggctatcatacattttataatattaaatataagatttactttttgagaataataaaatgaataccttcatgttcctctgtgtcttctttctccttcccacacccacccactaccacgtattttaagattataatgtatggtatttatataggactacctggcaaggcataatccttaaagacccttttcatgcattaactcatttaatcctcacaataaccttctgagattggcattaatatttcctttttcaaatgagcaaaatgaggcacagagaggttgagtcaaagttctctagctagtaaatgacagtatcttaatgggctttggatttaatgggttttgctgttcatttgtttgccagatattagaaacaatcttgtattcattgttatatgctgtacatggcaaatgtttctctagagtgcagttctcgaagtatggtctcacaacccttggagatctccaagaccctctcagagtctacaagatccttctgtaatgaccacgtttgtggtagactagatctttaataagtcaaacaaaataacatatccaacagagcgaatgcagaactagataagagaatccagcattctttttttaaagcaaacattaaagagatctgcagaaatgtaaaatagtgccattcttttcactagatcttttagagtgtaaaggggtcctgagagaaaaagtttgcaaggggcaactctagggcagtgatttttcttttttttttccagaccagaggctgggctctggattacagctcagtagtgggtcatggaatatgtactgtgactcaacccgtatcattttcaagaaagaagagagagaaaatcgttcagcaaatataactgaatgaattatctggttcacagagtatgtgcgtcttcagctttactcggtcatactaaattgttttaccaagtgattataccaacaaccctctttattttatgtcctcttaaatggatggtatcgtcccacttgtaaatttttgctgtgtgtgtgaaatggtatcctattttctgatttgtgcacctcttatcattggtgagtatgcaccctgtttttttcaaacctttactagtgtgtgtgtgtgtgttcttctgtgaaatacctgttcatgtcctttgcctgtttttgtctgttaagactgttccagagacatcttggctggtctttgatatctttcgattaatagttgttgttacttttaatgtaaaatttgttagtctttttataattagtgatttctgtttaagaaattcttcctttctccaaggccttggttgtattcttctatatttttttcctacttattttaaagttgaagccttttatgtccttaatttacttgaaattaatttgtatgctgtgagatagggatccagtgtaacggttttacttaaaatacacaattgtccccacactacttgttgaaaattcatcctatccccaatggtttgcaatatgttcatttccatatgtgtatgggtgtgttacctggctctttgtccctttgttgtatttgtctctcctacttagatacccacttggaggtgggggggtcatttacctccttgttactcaagagaaatattagctattgttggtcctttgcttttcttcagtagaaattctggaacctgctgttggaattttggtttagattttattgaatttctagcttaatttgggtgtaactgatacgtttaggatattgacccttctgtctgaatgttatgttactccatttatttagaactttaacatttttcagtacttgtataatttcatgtcttgtatattgttcagtttatttctagtttttaattgtgtgatatatattttcataagttgcattttctaatatataaaattactgactcttacatatctattttactcagcaatcttccagacttaattctcataattgaggattttttgttttgttctatttagtcatgatacgaaattgggattcttccttttcaatcttaatagctgttattctttttttttttcttagtgtgcagactagggaaatgaagtacaatgttgaccagaattgatgtaggtatctttgtcttactcctgattttaaaaggaatatttcaagttttccaccattaagtatgtttgccatcttttcttgtaaaacttcatattatcataaggaagtaagttttttaaaaaataatggctggatgttgaattttattgaatgcttttctacatttgttgacgatcgtattgatatttagtttggaactgttgcattgattgcactgctcagagctgtacatcatgttcctccaccattggaccttgacttctccaattttatttcctcaacatgtgtacacaaactctttttttcagctaaactgatgtattcattaacctggaaataattgccttttatatccatttctagcttgcctatcagaatacatgtcaatctacaagacccagtatcgatttcagcactaataaagaccttcctttaccatactgttttgaagcagtgttctgttgaatgcatctgaatttaatttgcacttagtctctattacatccaatttaccagttcccacctactgttttgtatttgagttttatctaggtaatatcttgcagctgtgttgcatgtgccacttataaagaaagcaagtaatatgcatttttaaattatgcttcatacttcacacagtgtcataaaaagatgttcaataaatatttgaattatgtgttcctaaatgagatatttgccctaagaactaaaggctgcaggaaaagctagtgatcaggttaaacattttgcctttaatcctgaaagtttctcctacaatcatattttggttggaataatttttactgaatgcttagggtcatggagagattagtggattgggagttagaattgggctcctttctacgcagccttcctatgatatttgtgctatttgttaaatataaagaagcccaaaagcttttggtgatctcttaaagggttgtagtgattttgttgaaaaggataatcttttataagtaatgtgcagtttcctgttttgcggaggaaatgtatagttaatattcaacagatttattgaacataataaaactcctttattagaacttaatttctccagcaaaaattctacaccaactgggtgtactacaattattttaattctgacactgcccagatgttgctcagacccccatacattaaggggctccgtttcacaagactgcctgcccccaagtcagtcagagttcgcagagcatctgcatttctgctcagctgactacaaattatgggattcctgcagctttccaagaacggctcacagtactcaggaaagactgttcttaagcaatttcagttttataaaggacacaactcagaaacagccaaatggaggagacatagggcaaggtgtgaaagggcttctgtatcctctggtgcagcaccttcccagcatatcagtatgttcaacaatctagaagctccccaaacctcattattcaagagttttcattgagctttcattacataaatacataattgagtaaattattgtccgctggtcactgggctcaatctgtcccttacctcccctaaggtcagggcctagggctgaaatttgtgactcttcccccccaccccacccccctcccaacacacacacacacagacggagtctcactctcttgcctaggctgtagtgcagtggcccaatcttggctcaccacaacctccacctcctgggttcaagtgattctcctgccttggcttcctgagtagttgggattacagggcacacccccacacttgactaatttctttgtattttagttagagacagagtttcaccatgttggccaggctggtctcgaactcctgacctcaagtgatccgcccagctcggcctcccaaagtgctgggattacaggcatgagccaccatgcctggctgaaatctgtagctctttataatctagtggttggtttttctggcaaccagcttccagaagatgccttcaaacctgaagctacctaggtgccctaccttgagtcccttcatcagcctaacaaggataccctatcacttaagaaattctaggagtttttgaatctgtatctgaaaccaaggacaaaagactaaatatattttttattataccacagggcatacagataataaaaatgtatatgtcatgaggagtgatataaaatagtaaagggcaagcccactaacatacaaaatgtagaacagaggtagttccatttggggaactagtttgttagttaatcacatagttaatgggattcccctgactgggcagagggtggtcggcaagtcacttaatatttttgaatattaaatgataggattctggtgggttgtaaataaccaatgaaaacttgaggttctctgtgacatttaaaattaagctatgcagtaattgaggatgctttgcaagacctttgacaatattataaagaattgaaaactcatcctattttccagttacctgtaaaaccagatgccaatttgccattaagtttggaaaatgacaaatactagtctttgttatatatgaacatactatagtagacttagcacttatttatttgagtaccacttttaagacttggccctaccctcctaagctctttgtccccacttttgattgtcatagccatagtgtgttttatatttatataaatagaaaatgttttatatttgctttcttaaatcacctggaaatttgcatgatttttaacatggaagtaaaatctttaattttaaataagatttaaatacagtgcaggtatttcgatagcctttgtttcaggagattgtttactgttttaaatattcattgtgctcttgtacttttatgaacacggattattctggtaaatgtaaatcttcaaaggtaagaattgaaaaacatagtttgctgtggccgtttgaggaaggaaagtggatgaacattttgaatagctggtagtcatatcttccaccttagccctcagcttcttagttacttcccccagtctaggaccatctgtcagtaggaagtcgcctacaacaaataaaactccacagttagcatctcctgggttgaaattattatgtggaatcctaaatttaacagaatctcattcatgacagaatggtgtactgtggaaataaagttttatgtttgagtgtttgatgggccttaatgttttctaattattttcttttttgttaattaaatgtaaagtatttgaggcaaggacagtgccttattttctttctggagttttgaatactataaatattcaagtagtagtttgtggatggggaatagagtaattcagtcatttgtagcagtttctggtcctgtaaaaataatgtttttatttttctgaacgtatatttcacagtatatatttttaactgcggtatttacattcattgtatcatttaagtatttctgcacagcatttgtattcaagttgtatgaacattattttcttcttgtgtctggcatatggctatattcagactaatatgaaacactttaaaagttgtatttctttaatgattgaattgtattgtttctagtcagtggattttttctgttgtctgtatggacagtcaatctcagtcataaatatttgtgatttaaatctgctatttgtggttcacacttttgaaaggtaatttgtgtctttattttttagaacagctttgctgagccatcaaggtctaatggaagcatggttcggcattcttcatctccatatgtagtatatccttcggataagcctttccttaatagtgatctacgacgctccccaagtaagcctacacttgcctatccagaaagcaacagcagaggtaatcgagcctaacgaaataaatgttatttgtgttttcttgctgctttaaaattcttaactttgtcctccattattttgccattagaggaaaatatatttcccctttgcttccagtttcagcccccagaaaatattatgcttttcttgtattccttatattgattgttgaacatcatcatccaccaaattactgatgctaaaacactttgagtcatcagtgactgctctgtaatccccactattagtccggaatgaagacctttttttgcttctgaaatataccaaaagcatactgttttttctgcctttttgtgttctcattgctttggttcaggctttcatcatctgtagcccagatgttcatagtacattcctcattaatctccctgcctgttttctcctcctcatccccagttaacaacatttctgtcatttgtcattatccatcatctctcccacaaaattaaagctttagcatctcttcatagcttacataataaattcttaatttttcataacctagaccctatatgcctcaccagcttcatccctaacttgtcttctgttttttcctttcccatcctttgctctggctactttgaaatacatttattcctggaacctgccatctgtattagttttcttgtcgccttaacaaattgccatgaacttagctttaaatatttgttatctcagttttctgtaggtcggaaatctgtgtaggcttatctgggtcctctgtttagagccttacaaggctgaaatcaaggctttgcttggggctctgttctttactagaggctctggggaagatctgcttccaagctcattaagattcttagccaaattcagttccttgtcattgcagtactgagattctgttgctttgcagacttttacttgaggacagtctttgctcctagaaactgtcctccttccttcatgtttcccttattgtctcctacggtaacagtaggtagtctctcatgtttcttttttttttttattttttattgtttttttggagacagagtctcactctgtcaccaggctggagtgcagtggcgggatcccggctcactgcaacctccgcctcctggattcaagctattgctattctcttgcctcagcctcctgagtagctgggactacagacgcgcccagctagtttttgtatttttagtagggacgaggtttcaccatgttggcccagatggtctcaatctctggacctcgtgatccacccgccttggcctcccaaagtgctgggattacaggcatgagctaccgcgcctggccaagtctcttatgtttcaaatctctctgagttctgttgttacatttctctaaccacagcgggagaaaattttctggttatgttatcagattgggcccactcagataatgaaaagatggttttgatattgaatttgttaatcgtcttttagatgtttcttcatctgtatcttttaaaatacacctacctcatactttgtgtgaagtttaaatgaaatatctttgctttatttgggatgctgtggcatttcctttttttgaaagttgtgtttaatcactaatattgcaacaattctatgtgttaatgattctctaggtaaaagaaatatttttgacatcgtaggctaaacaggcatttgtaaattagttgaggaacattttttgtttcagttgggatatatattgtaagtatcctaaaaatctcagaatgaacctgttttgtaaactggactgattgtacagtaaaataccaagtaggtaatgatatccaaataccagcttaaatcctaacctataatgggtgctgaaaagtgtttactgaaataaaagtaactaaatagtgtgatgtcttttaagaattttagtactctgtaatcactaacctagaagcctctttattataagatactgtgtctcgatgataacgaaaatttttaattaatggttaaagcaactgataaggttctacacatcagagtatagcaggttggcaatttaagaaaattaagttgcatgacattcaaacaacatagattttaaaaagcaaaaaaaaaaaaaaaaaaatgactgaagcccacagtagagcaaaaatcagttgcagtaagtttcttattcaaaaataagcacaaaacaaaatatccatttacaaagttctaacaggaacacaaaatctaagaattagatattaatccttcaactataatattgtatctagttctgatctttacacccatgaaaggaaacttttaaaaagttcaaaaaaatgacaaattactagcaaagaataagaaatattaagaaggcagatttattcaccgagaatcagaaaaattttagcacagcatgttactaatagagctaaattctgcttgagtgcaacatcagtggttttaaggaataaaagagaagtgagacaagcagggaggagacggagaggagaaataaacaagataaaaagtaacctttaagcttttatgcctttagagcatgatgcggtgaactatttaagcaatgtcccaggataattattataatccattatccttttatagtgttttaatccaacgatacttactttccaaatgggaaggaaagacacagaaatcactatccccttctcacccagaaaaaaaataaaggctgtgagatatgaacaaagaccaagagagttcagaaaagacatttgttggggatagggataagtgtgttggggaggttaaaggagaggaaaacctctcagaggaaaaacgaaataatagataatctgagttttaaagaatgagcacagttctataagaagaaaagttcaacaagagtacagcatgtgaaaggtttataaacgtgacatgatttttttttttttttttttgagacagtctcactctgtcacccaggctggagtgcggtggcatgatcttggctcactacaacctctgcctcccaggttcaagcaattctcctgcctcagcctcctgagtagctgggattacagacacatgccaccacacctggctaatttttgtatttttagtagagacagggtttaaccatgttggccaggatggtctcgatctcttgacctcgtgatccgcccacctcagcctcccaaagtgctgggattacaggtgtgagccaccgtgcctggcaaacctgacatgatttttattgcttcatcaaggacattgtggcttagtttttcttactgggaatttatgacagtgaagaatacaatgcctaaaatagtagtttagtgttactaccttgatttgagctaaaattaggaattttacccaacattgcttttgcatgatcattggcaaacttcaacacagtgaaaaaagtgaagtcttactattaatagtattatgaaaatagtgttgacctcacaggccctgggaaaggcctcatgagctctgccctcaatgtgcctatgccccatattttgagaaccactgtaatcaaggatatgagtatgtccagagtagtattttgttcatgtaaatacttttttaccaggtgtgagaagaatgtagatagtagcatttgttccagaatctagatgatagctccttgaggccaaagacagtcttcacgccttgcagagtgcttcacacattgtatgtggtctatatgtttgagggactgaggtttacatcagaagtaagtctaaactgaagcaacaagacagaacaggagactgattaaggaaagatttatgcatattttgttgtggggaatgaggaagatggagaaatctttgagtctaagatttctagtgaagatgattaggggtatgattaggacagatgacacaaaaaaagcatacttagaggaattgatataattttggctgtatcaaatttgagatgcctgtgaattagatggagatgaatactaagcaaatgaaaattaaaaagtcaagtataatagagaacactactaatgaactcagacatcatcaaggatacagtagtggatgaagcctatgagtatagaggggtttctccagaaaaagaaagtagagggagaaaagggctttggaaaataccaccattaaaacagtaaactaaaaagtaggaaaagtcagaaaggtggagaactaccaagacagcaatattagagaaatcaaagatgcatattacaggtttggcccctgcccccccgccccttaatctacaacaacataaacctgtgtttatgttaatgacagaaatgtcccaagcaataaatagacccaggtggacttgaagaacattagggactcaaacatggctagcactttccatcttttttttttttcggcttgtaactagcttcattttttctagctacaaaagagctttttttttgcctagcaggaaacattactaaaaattactgagttttaagttgaaccagttctggctttgatgtttcggacaaaagtcccaagaagacaagcaagcattatctgggtttcagcgtgtgtcccttgtggatcagttagccagatttgtcaaaggatagtaaagttgtaggtatagccatgttgaggtaaggggaaactcccagaaaaagaggtatataagtcagggaaacagttccaaagatgtgtgctatacttcatatagcaaaataaaagaaaaatttcaggaaacaaaattaggaaatacaaaatataatgaaaaatatgaaatttatcaggtatgacaaatgtgattacgtcaactcaaaagccaatatatgctttttaagtaaaacctgaaataaaatgaaacaaaaaataaatagctgacaaaggtgtttactgccatacaaataaaaacgatggatggcagtactactgtcaaacagttagtataggcaaatagcagcttcatgtaatactaaataaaaacaaataatacctagtttaaaagtgagaaggagaaatacccaagtacagaaataaaatgagtttcaagccaggacagtaaggatggaactaaagcctaaaaccttagggacagtattaggagtcttggcattaggtataagccttaaatgttggggtacagtagcagagatgatggaattttaaatgtgggtagcgactggagaacaaagctctaggcgcccctgaggcaacttctggaatactttgaaaaggtgggcgtgatgagagttgtcaaagcagaactggaacactgcggcccgtggtctcaggaagagactggataaaaaaagtcacctctgataagtcaactcaagccaattttatgtgcttactgaggtgcatacgtgaagacttgaatacataatgagagctatacattgttaatgaaaatgcttaatattataaattgcatttaaagtgtgctcatatataaataaatatgacatagtaaaggtcaatctcacatataaaagcatttttaaaatctatagaatttcaataaaatgtttataattactacatctagatggtaagattatgggtgtgatttttttccttttcaatcatgtgttttctaaattatcctctgcatttattcagtaattttttgaaaaagaaaacaataaaacgttacgcatttaaacagggatatgtaagccattcaagaatacataaaacaaaagtgcacaccccagcatatccttgtgatactacagttgctgacataaagaacaaaaatgaaatgttcagccagtttcaataataaatataagtgcagaaataaagtatcagcaacattgtgtactgttgggtataatttaatgaaggagtgcaaaaaatgtttgatattacaaagtctttagtgaatttgcctctgattcagaagaggttaagaaaactcaatggatattaaaggacgtttaaaattttatttttctattgtacttatctgattattgcaggtatataaaagaattgttccctttattattaatcttatatttaggcttctgtttagttctgagtgtcttttcagttgatttttcaggtttcttcctgtgtgtgtgtctgtttcatgtctgcattttttctagttatattgtagtctcattgcataccagcaagaataagctgacttcgataaaatgtattagtctcctatttgagacctgtaatatcctaggcactgaaaaatttggtgaaggaataaattatgttaataaatggacaagaatactttgggttgagtaagaggactcaattcgtaaaagacggcagctctccctacctagtgtatagtttaaattagtgtttagacaaaatgattctaaataattacttggaaatgttttaagatttatataatataggtgactgttagaatcaatgtttatgaaattttagtaattgaaatactggcactaattccctaacattaaggaatccagaatagaagaaagatctgaaactgtcttagggtgtgtatgtaacaaagagttacagtatctaatatatatatatatgtgtgtgtgaatttagtgtatgatcaatttgacatttaaagtttttctttcaatacaaaaacactttttctatgacttaacaaatgtaaacatatgaaactgtaaatataattttaaaaatacaaagtttatctgatctcgaggttgggaagaactgtccaagtatataaagaaagaaaacatgatgggaggaaacaccacacccaagactgtgttgttaaagcactgatgacttctgacccaattataaaagtgaccacaaagccagcttgcttttcagagttcaaaagaaccatcctgtaatctgtaagatatttgagaaaaaatcctagtcttaatgttcattttctttaagtgctttttggaagtaagctgggtataattaataaggaaataaagaacaacttggtccggttccaagatggccaaataggaacagctccagtctacagctcccagtgtgagtgacacagaagacgggtgatttctgcatttccaactgagataccgggttcatctcactggggcttgtcagacagtgagtgcagtccatggagtatgagccgaagcagggcagggtgttgtctcacccgggaagcgcaaggggttgggccattccctttcctagccaagggaagccttgacacacagtacctggaaaatcaggacactcccaccctaatactgtgcttttccaatggtcttagcaaacggcacaccaggagattatatcctgttcctggctctgagggtcccatgcccatggagcctcactcactgctagcacagcagtctgagatccaactgcaaggctgcagcgaggctgggggaggggcatccgcaattgctgaagcttgagtaggtaaacagcggtctggaagctcaaactgggtggagcccaccgcagctcaaagaggcctgcctgcctctgtagactaacctctccgggtaggccatagctgaacaaaaggcagcagaaacttctgcagacttaaacattcctgtctgacagctttgaagagagcagtggttttcccagcacggagtttgagatctgagaacggacagactgcctcttcaagtggatccctgacccccaagtagcctaactgggagatacctcccagtaggggccgactgacacctcatacagccgggtccccttctgagactaaggctccagaggaaggaccaggcagcaacgtttgccattctgcaatatttgcttttctgcagcttccgttggtgatacccaggcaaacggtctggaatggacctccagcaatctccaacagacctgcagctgagggtcctgactgttagaaggaaaactaacaaaaaggacatccacaccaaaaccccatctgcatgtcaccatcatcagaccaaaggtagataaaacgacaaagatgtggagaaaccaaagcagaaaagctgaaaattccaaaaatcagagcacctcttctcctccaaaggaacacagctccttgccagcaacagaacaaagcttgatggagaatgactttgacgagttgagagaagaaggcttcaaacgatcggtgataacaaacttctctgagctaaaggaagatatttgaacccattgcaaagaagctaaaaaccttgaaaaaagattagacgaatggctaactagaataaacagcgtagagaagaccttaaatgacctgatggagctgaaaaccatgccatgagaactacatgacgcatgcacaagactcagtagccgattcaatcaagtggaagaaagggtatctgtgattgaagatcaaatgaatgaaatgaagcgagaagagaagtttagagaaaaaagagtaaaaagaaatgaacaaagcctccaagaaatatgggactatgagaaaagaccaagtctgcctctgattggtgtacctgaaagtgacggggagaatggaaccaagttggaaaacactcttcaggatattatccaggacaacttccccaatctaggaaggcaggccaacattcaaattcaggaaatacagataatgccacaaagatactcctcaaggagagcaactccaagacacataattgtcagattcaccaaagttaaaatgaaggaaaaaatattaagggcagccagagagaaaggtcaggttacctgcaaagggaagcccatcagactaacagcagatctctcggcagaaactacaagccagaagagagtgggggccaatattcaacattcttaaagaaaagaattttcaacccagaatttcatatccagccaaactaagctttgtaagtgaaggagaaataaaatcctttacagacaagcaaatgctgagagattttgttaccaccaggcctgccttacaagatctcctgaaggaacaactaaacatggaaaggaacaaccggtaccagccactgcaaaaacatgccaaattgtaaagaccatcgagactaggaagaaactgcatcaactaacgagcaaaataaccagctaacatcataatgataggatcaaattcacacataacaatattaaccttaaatgtaaacaggctaaatgctccaattaaaagacacagactggcaaattggataccaagagtcaagacccatcagtgtgctgtattcagtagacccacctcacatgctggggcacacataggctcaaaataaaaggatggaggaagatctaccaagcaaatggaaaacaaaaaaaggcaggggttgcaatcctagtctctgataaaacggactagatcaaaagagacaaagaaggccattacataatggtaaagggatcaattcaacaagaagagctaacctaaatatatatgcgcccaatacaggagcacccagattcataaagcaagtccatagagacctgcaaagagactcagactcccacacaataataatgggagactttaacaccccactgtcaacattagacagatcagcgagacagaaagttaacaaggatatccaggaattgaacttggttctgcaccgagcgaacctaatagacatctacagaactctccaccccaaatcaatagaatatacattcttctcagcaccacatcacacttattccaaaactgaccacatagttggaagtaaagcactcctcagcaaatgtaaaagaacaaattataacagactgtctctcagaccacagtgcaatcaaactagaactcaggattaagaaactcactcaaaaccactcaactacatggaaagtgaacaacctgctcctgaatgactactgggtgaataatgaaatgaaggcagaaataaagatgttctttgaaaccaacgagaacaaagacacaacataccagattctttgggacacattcaaagcagtgtgtagagggaaatttatagcactaaatgcccacaagagaaagcaggaaagatctaaaattgacaccctaacatcacaattaaaagaactagaaaagcaagagcaaacacattcaaaagctagcagaaggcaagaaataactaagatcagagcagaactgaaggagatagagacacaaaaaacccttcaaaaaatcagtgaatccaggagctggttttttgaaaagatcaaaattgatagaccactagcaagactaataaagaagtaaagcgagaagaatcaaatagatgcaataaaaaatgataaaggagatatcactaccaatcccacagaaatacagactaccatcagcgaatactataaacatctctacgcaaataaactagaaaatctagaagaaatgggtaaattactggacacatacaccctcccaagacaaaaccaggaagaagttgaatccctgaatagaccaatagcaggctctgaaattgaggcaataattaatagcctgccaaccaaaaaaagtccaggaccagacggattcacagccaaattctaccagaggcacaaagaggagctggtaccattccttctgaaacaattccaatcaatggaaaaagaggtaatcctcccaaactcattttatgaagccagcatcatcctgataccaaagcctggcagagacacaacagaaaaagagaattttacaccgatatccctgatgatcattgatgcaaaaatcctcaataaaatactggcaaaccgaatccagcagcacatcaaaaagcttatccaccaagatcaagttggcttcatctctgggatgcaaggctggttcaacgtacacaaatcagtaaacgtaattcatcatataaacagaaccaaagacagaaaccacatgattatctcagtagatgcagaaaaggccttcaacaaaattcagcagcccttcatgctaaaaactctcaataaactaggtattgatgggacgtatctcaaaacaatatgagtgatttgtgacaaacccacagccaatatcatactgaatgagcaagaactggaagcattccctttgaaaactggcacaagacagggatgccgtctctcaccattcctattgaacatagtgttggaacttctggccagggcaatcaggcaggagaaagaaataaagggtattcagttaggaaaagaggaagtcaaattgtccctgtttgcagattacatggttgtatatttagaaaaccctatcgtctcagcccaaaatctcctcaagttgataagcaacttcagcaaagtctcaggatacaaaatcaatgtgcaaaaatcacaagcattcttatacaccaataacagacacacagccaaatcatgagtgaactctcattcacaattgcttcaaagacaataaaatccctaggaatccaacttacaagggatgtgaaggaccccttcaaggagaactacaaaccactgctcaatgaaataaaagaggatacaaacaaatggaagaacattccatactcatggataggaagaatcaatatcgtggaaatagccatactgcccaaggtaatttatagattcaatgccatccccatcaagctaccactgactttcgtcacagaattggaaaaaactactttaaagttcatacagcaccaaaaaaaacagcccacattaccaagacaatcctgagccattaaagtgatcattaaaaagtcaggaaacaacagatgcttgagaggatgtggagaaataggaatacttttacactgttggtgggatcgtaaactagttcaaccattgtggaagactgtggcgattcctcaagtatctagaactagaaataccatttgacccagccatcccattactgggcatatacccaaaggattataaatcatgctgctataaagacacatacacatgtatgtttattgcggcacggttcacaatagcaaagacttggaaccagcctaaatgtccatcaagactggattaagaaaatgtggcacatatacaccatggaatactatgcagctgtaaaaaagattgagttcatgtcctttgtagggacatggatgaagctggaaaccatcattctgaacaaactattgcaaggacagaaaaccagacaccacatgttctcactcataggtgggaattgaacaatgagaacacttggacacagggtggggaacatcacacaccggggcctgtcgtgggttggggggaggggggagggatagcattagaagatatacctaatgtaaatgatgagttaatgggtgcagcacagcaacatggcacatgtatacatatgtaacaaacctgcacgttgagcacatgtaccctagagcttaaagtataattaaaaaaaaaaaaaacgtgatgggaaagaattaggtatacctctgtgaaaaatcaaaacatctgtacatcaaaactagaattaaaggcagataataaaatgaagaaaactttttcccatagaaaaatgggcaaaggaaattcatgaaagggagaaaattagccaataacatatatgaaaagatttatactttgatggaaatggaaaataactaggagtagcatatttttctcattagaatggctatgattcttctttgacccagtaactttttagtttttaattattgatcattagaaaatcttttaagactgattgcctgagggaattctcactatttaataatgctaaagtgaaaaaacctacatatttgttttgtctcaatttattttacacatataggaaaaaatttaaataaccaaatgacagtcattatctttgggtaataggattattggttatttttcagtgtgttttttctcagtcttctacatttactgcagtcaacataattttataatcaaacttgaagcggactttagaaagtacttaaaatgcggattttaaaagtattatttttgtgtgcttgactgtaactctatagttggtttctacatgtgctcctattaataaaatgtattaataagtaatagttactaatacatttactaattttaattaataagtaatatattaataagacagtaatgtactttaggactgttatgtgaactttgtatgattggctaaattttttaccactttataaaagtctttgaaatttttttaccatagtaatggggtttttacttgagcacatttcaaacactcaatgtcttttttttaatttattattattttttgtgagacagaatctcactgtcgcccaggctggagtgcaatggtgcgatctcagctcactgcaacctccacccctccacactccccaccccacccgggttcaagcgattctcctgcctcagcctcccgagtagctgggattacaggcgcccgccactatgcctgcctaattttttttatttttagtagtgacagggtttcactgtgttaggctggtctcgaactcctaacctcaggtgatccacccacctcagcctcccaaagtgctgggattacaggtgtgagccaccgcacccggcccactcaatgtctttaaattgattttttaaaaaacaaatatgagataattaacattttattgttcccaaagagtgatcctccactggactcatccatcaattttattttttatttagatgagtttattctttcttaatatactttctccgcatatgctgttacagcatccacgtttgtgtttgtatttggcagccatattttctgctcttaagaatcttcaagataagattcgacgcttggaacttgagaggattcaggcagaagaaagtgtgaaaaccttgtctagagaaacaattgaatataagaaagtactggatgaacagatacaagaaagggagaattcaaagaatgaggaatcaaagcacaatcaaggtttgttgatgaagaaaattaaaattctatcaaaataagtgttgtgcagtattaagtattctaaaagaaatagtacattagtgttttgtagcggtatcttcaagtactacaaaactgcattgtattctggtgcattttgaggagcaaatgctgttgtcatacatggcatttatttactgaatgcaaggccagtttgactagcacgtagaaagaatgatttaggtaatctgaaaaggcgtccaggtctgtggaaggtgtttttattgtatacacaatagatccaattcctgttaacagcttgttaaaactattttatgggtgagttgatttctgcttttcttatgtattctttttagaactgacatctcagttgttagctgcagaaaataaatgcaatctattagaaaaacaattggaatacatgcgaaatatgataaagcatgccgaaatggagaggacatctgtcttagagaaacaagtaagtaaagcacctcacagattgatactcaagaacagttatggggaaaactaattgaataaagactttttttctttcggtgaggattaatggtgctgttacagcccaggactgaaatttcttggcatcagttatgaaatctaaatatgtgattggctttttcttgttgttattgttgtgtttcgtagagttttacttaaatggtaaaaatacagttgtgagatgtttgaaagttatgttagcttctttgagtctacattataaaaagtgtaaataaccatatacctctgtatctctgaaatttgtttaatgactccagtgagatagtagatgactttgtaaaactcttcagaattgttacttagcatagcatttttgtgctttcttacaccagagatcttcgtatttaggtgacctgtacatttgtgagaagatatctcaacatcagtctcaaatatattgattgatcaattgattggatctcactctgtctcactctgtcacccaggctggagtgtagtggcatgatctcggttcactgcaacctctacctcctaggctcaggtgattctcatgcctcatcctcccgagtagctgggattacaggcgcatgccacgatgcccagctaacttttgtgtgtgtgtgtatttttagtatagatgtggccaggctggtctcaaactcctggcctcaagtgatcaggccgcctcggcctcccaaagttctgggattacgggcatgagccactgtccctggccttgtgtgtattttttttttttttttttttgagacggagtttcccttttattgcccaggctggagagcaacggcgtgatctcagctcaccgcaacctccacctcccgggttcaagtgattctcctgcctcagcctcccaagtagctgggattacaggcatgtgccaccacacccggctaattttgtatttttagtagagacagggtttcaccatgttggtcaggctggtcttgaactgccaacctcatgtgatccgcctgccttggcctcccagagtgctggaattacaggcatgagccaccacgcccggccagccttgtgtatatttttttaaaacttactcctttttctgttatgaatctagagtttgcattcattagttttgtagacatcttaactctattataaaatcggattgtttatatgcttaacattatgctagatgccctgcaatggaaaaaaaaaatactaggcagttgtccttcagtatccatgagtgaattggttctcagacccctgtggatagtaaaatccatggatgctcaagtctcctataaaatggtgtggtatttgcgtataacctacacccaatctcatatactataaattatctctagattacttataacacctaatgcaatgtaaatgttatgtaaatagttgctgtactatattgtttggagaataatgtcaagagtaagaatctgtgtatgtttagtacagattcaaccatccttttttgttttttctcgtatattttcaatccacagttgatcaaatccatggatgcaaaacacacagatacagagggcttaccgtgtatgctttctaccctcagtcagctttcagttctcattggagagaattagacttaaatatttgagcaatcatacaacagtatttgagaagatgtctcagtaattaattcttgtgtgtgataggtctcttatttcagtggttataatttttcattttcatttgggtctttttccatccacttagttttgttctttgaatgtactgttactctgtggtttttataccttccttctatctctttgaacgctataaacaattctcaattttttttaattatttgatgttttcaaagtgttaatcctcgtttgtttggctttatttattgattctcccttatggtatctttttttttatgggaacttaataaagaaaagttatatggtggtctcattttttcatttattgtgttaattccacaataaattcctcagttgtgtgggcagccttgtgagccagttgtgaatttgcctttggttaggcttgatggttttcactggttctggctgggcagggtggcttacacctgtaatgccagcacttaggaggccaagccagacagatcacttgagtgcaggagttcgagaccagccggggcaatagagcgagacccagtttctacaaacaataaataaataaaatcactggttctgttccagatttatgttactatattggcttgatattgttgatcattgtggattatacattgcctaaagttttatattcctgcacattttatgtaccctggctccaatattgccttgtgtgatatttgacttcagtatcctttcatttgcttttgagttcctttctcttttttttgtatctgaagattttcctttcttgctttcaaaattgctgtgtaattgtattagtccattctcacgctgctataaagagcacccaagactaggtaatttatgaaagaaagaggtttaattgactcacagttctgtatgtctgttggggggacttctggaaacttaacacttatggtggaaggggaagcatacatattcttcttcacatggtggcaagagagggaagtgcagagcaaggtggggaaaagcccctattaaaaccatcagatctcatgagaattcactatgatgagaacagcatggggaaccaccacgatgatctaatcaccttccatgagatccctcccccaaaatgtggggattacaatttggattacaattcaagatgagatttggttggagacacagaggtagaccacatcaataatcatatattattattatgtctgctgtgtttatctaacatttctgtgatttttgggctggagaaaggggtcagtttaataagacaactttaagatgttttgactaatatatgtcttggagacaactattaggcatatgtaatagatgtcaagagctgttaatatccactaggatgtggctagaagggaattagttcacacaaattcctaaattattgctttatattaatttgtcatattcaaatttctattaatatggtacctattgctgtagccttattttgaagacacagtttacaagttcaggcactttttaccaataatagtccttgagttagtatatttgaaattatcctagtataatggtttacgggtggattacttgaggtcgggtttgagagcagcctggccaacatggtgaaaccccatctctactaaaaatacaaaaattagctgggcgtggtggcaggcgcctataatcccagctactcaggaggctcaggcaggagaattacttgaacccaggaggcagaggttgcagtgagctgagatgatgccaccgcactccagcctgggtgacagagcaagaccccatctcaaaaaaaaaacaaagtctatataggaggcaatctttataaatctttgactctaaacttcaaaaaaaaaagtttagggccaggtacggtggctcacgcctgtaatctcagcactttgggaggctgaggcgggtggcttacggggtcaggagagcgagaccatcctggctaacacgatgaaaccacgtcactactaaaaatacaaaaaattagccgggcgtggtggcgggcgcctatagtcccagctactggggaggctgaggcaggagaatggcatgaacctgggaggcggagcttgcggtgagccgagatcagccactgcactctggcctgggcgacagagcgagactctatctcaaaaataaaaaaagtataaaaggatattatacatagaattcaagggaaatatgaaaagatagataccaaaaccataatttttaccctaattaagagattaactacttgacaggaccaaactaaaagtatttgtgtgtgaagcctatatgtccaataaatccctgctatcccagagcataaagataatgtcactatataaaactacatattaggtaaatagctataagccaaggcaactgagctaagaacagtatccacttatatcagtcatttattgatgccccctatggtttcatcttaatgttattttcctagaagtagttatgtgaagggccaaataacagcatagaaaaacactgctcagtgtttttctcttttttgattgtcaaattatcaagccgtattgaatattgtttttcaggtttccctagaaagagaacgacaacatgatcaaacacatgttcagagccaacttgaaaaattggatcttcttgaacaggagtataacaaacttaccacaatgcaggcccttgcagaagtcagtgcatgtgtctttttattgttaacatatatcagggtggtttttttttaatgttaattattttacatcactggatatttatagcattaaaagtgatcttataatgaagaaatatattggagttttaaaaagaaaatataaatttggagagaatgttcacattttacaatcttggtgggcatttttttttatgaaaatgtttgttaaaaaattaaatgtttttggccgggcgtggtggctcacgcctgtaatcccagcactttgggaggccaaggcgggtggatcacctgaggtcaggagttcaagaccagcctgaccaacatggtgaaaccccgtatctactaaaaatacaaaaattagccgggcatcgtggcgcatgcctgtaatcgcagctgcttggaggctgagacaggagaatcgcttgaaaccaggaggcggaggttgttgtgagccgagatcacgccatttcactccagtcagggcaacaagagcgaaactccatctcaaaaaaaaaaaaaaattaaatgtttttgagtatccttaaggcttgcatcacttggtttaagttgctctctgagctaattttagttttaattatttcatttgggagatatttaataccactgataataaagttccagatttagcctccctatccctctttacattcatgcagtgctgtgttctttggccatagattttacccataattttgtccagctacctcacagatgataaataattgaacacaaaaggagagcatcatggatgccatccagctcacagcctccattactacagtgatctaaccaccttatattgagtaggataaaatttacatgttccagtgctgctatattaaaattttacagacacttaagatttttcacctttatcccttttgacatttttatcactagaaaaaaatgcaagagttggaagcaaaactccatgaagaagaacaggaaaggaaacgcatgcaagctaaggcagctgaggtaagttaaaatgtgagaaagtgggctcttcatatttcttaccgctttttgtgtacaagtaaacaattacatttaggtatcttacattatttgtattttagaatagtccaacatacaaattttcagatataggttaatgtagaaaattatgaacaagtatttttatagacagagtaaaatttgaacagttttttagcatgtttgtaattgtagagtttcaatcagcattttaaaaaataacagactaaaaaacatcagagactacacacataagaaggtatgtaatcatgtaaaacttcttacggccattatcagtaatatttaaaagctatctttcagtattgtacttataggtacttctctttggtggcctcaagatgccaggatagaagttgaggtagtgggatgccccaatagctattgacccagaccagttaacagaagccaccacatgaggaaaatgagctctactctctcctacttttggattttatcccatgcagtggccaccagatagaataggtgaggcagtgtggattcacaaaagcattgagtttatatgtaccaaccagaactgcatttctaggagatatatagcaagactactgaagtaagtctgacttacagactcagtaaaataaaattttcatgtttttaactgaagacactctcgttatgagcgtatttgctcaaattcctcccagatactcccctgccccttccagggtcttttatttttatgatatttgcatgtatcttttttcgtaagaacacaagaatcaggtctcgattccaaggagtagagcctctgcagttcaatctgtgaccaaaggcctacaatgtcttgggctcacttcatatatgtgattacaggaatataaaagttatctttgttatgttgtctatttcttctagtgcatctctaaatttattgacttattttgtattaaatctgatacagttccttctcaaatatttaccttctgatcaatttgtagatttgttgttgttttccctcagtgtgctttctgagttatatagccacatggcttaatttttgaccaacaaaatttctttgcccattttctctttagggttggccacttcactgtgtttccatttccatacttgtaacaaacaaacttgtgggttgtgctttattatatgcattgtggtgttgagtacattatatatgaaatacaaaatttagtaagttccttatttaatgaatttttaaaattatttatggtacttctattttctccttcatttagcaggcaacacatagggaccaaattagatgttgctggtaatatgttaccagtaaatattttgagttgatggtgaatattattgtactgaaagaacaatgagggatagatgtgtggttccaagtctagtgttgggcaagttatataactattcagagtctggatttttatcattgttaaagagtggtctgctgaggtcaggagtttgaggtcaggagtttgagcctgaccaacatggtgaaacgctgtctactaaaaatacaaaattggccgggtatggtggtgcatgcctgtaatcctagctacttgggagggtgaggcaggagaatcgcttgaacctgggaggtggaagttgcactgagttgagatcacaccacctgcattccatcctgggcaacaagagcaaaaaaaaaaaaaaaaaacagtgttctgcattttgcatcttggtgttggtgtgatcaaatgagaataaaaaataatgaaagtgctttaaaatgttttaaaactgtagcacagaaatatacagctgctgggaagaataaataaactggaagttaaaatactcaaaaaaaagttcttgtatactgtttacactcattggcatcataagtcttctagagtagtaatttcctgttcattgaattgtgtctagtcaatttactatatataaagcaatgttaggtgtgtttggagtgtatagatgcttcctgagggtagagattcctgtattcctttgtcatggaatagattttttaccccaaagctgcactcatgtgggaagtattagtaataatcttagtatctgtttttatggaatccagtggttctgaatatttgttctagctccattataatttcctggggaactcttaaaatactttaaaatatgaatttccccaatctggaaaggccaaaatcatgagatctggacaggcacctggcagtccaaattgtcctcataaactgcagacagttttggtacatataggcagatttgaaacaaacactattccagacaggttttttgttttgttttgttttgtttttttaaaaaggaaagttgaaagttggcttagtgaaaagagcagtccttttttgaaattcttagtgcttgtggaatttctaccatgaagataggttatttttaaattagtatagttactcagcttctagagaaaagggcttggtaacatttgcctgatagcttccagtgttttttgttttttgttatttttttggatataagttttcaattcctttttcttatatagtaagtgcatggctttttagaaagggaagaaatgtattctgctcttcggctgttttgtgtctggtaatgtagtagatgccatttttgaaaagaatatatttaagcaatggtttggggttagatacattgcatttaactcgttagatagaatttatggagtaactacaaatactggagataatgtgttccacgctgaagaagggacaaattataacagaaggtcaagataaaatgagagactggtatttatttaaaatatttgacaaacgttgatagattggttcaagacatagttatacagctgtaatatgtttttcagttagatactaccattggtttttacaggctttttacatgacacatctgaaatctgagtcatagcttttatttctacagcattaacttgaggctctcatttttcctagttgcagactggtctagaaacaaatagacttatctttgaagataaggcaactccgtgtgttcccaatgcaagaagaattaaaaaaaagaagtcaaaaccaccagaaaaggtgtgaagacagaaccaaatcaggcaaaatgctgattacttggtatagtttatgtcaaaacacccataaactgtgtggtgtactacaaccttgagagagtaaatctttcattctcaatttcttcattcagaaggtggagataagtaatacctactcctaaatttttatcctgatagtgagaaaatatataagcattttggaactacagaacaccatacaaaattagcattattagtactgcattatcttgtgctcttacaatgttttgtgtatatgtatactgattttctacttagaatgtaactgttgttttgtcaagtgcttttttccccccagcctttcctaggctaggatatatgctaacaagtactattaggagctggcttgtgatcataatgccaactatagataaggcaagtagtagcctagtagttaactgaagtttcaagttagtcatgtatagtcagtttttattatcatgtgaataaaataaaattgttttccttttcttttcattcagaaaagttctaggaactattttggtgcacaaccacattatagattatgcttgggtgatatgccatttgtagctgggaaggtgagttggtcaaactccggattctttttatacaacattgatccctgaattaagtccctgcatctgcaagtatgtctacaaatggaaggaacatttttctgtgcctttaccagtgtgtggatcacagtgatgtgaaaatgagatgtagggaggtttttggggattagggaagcaaggaagagatggggaggataccttaaagtagataaagtatatgtggaaaggaagtgataaaacagagaccctaagttgaagaaggtgttgtttcagataggggtcaaggaaataagaaatagtatgtttgtagcattggatttttagtatcaatcctgttgagttacatttagatataggtagatattcgaataagcacgtagcacattctgcttgtcctcacatccagatcatttctaggactaattctccaagaagcagtcatacgtacacttgaatcttcagtttcttcagcacttgaatgtaaagctgtattgtcatatatcaagtactgagtgaagtgcctaaaactgtgctagttgacactactttataagctgtttgtgttgctggtggttttatatttagattccaactagattgttattctggcatcttgggaagtaaatgttcttctgaattttgtatttgtttatatttatttattttaaacccctagtaaattcgcagtgaaatcatggggaatataataaattagtggtgacaagcatttgaaaaaggtacagttgacccttgaacaacatgagtccgaactctgtgtgggtctacttacaggcagattttttttttcaataagtatcttggaaaattttttggagatttttggcaatttgaaaaaacttgcaaactatagcttagaaatatcagaagttaagaaaaagttggtatgtcatagatgcataaaattgactatgtcaatactagtgcattttatcatttactaccataaaatatacacaagttttttttaattataatttatcaaaacaatttgcacacagactacgtgacgccattcacagtccagagaaatgtaaacagagataaagatgcagtatgaaatcataactgtataaaattaactgtagtacatactgtacgactgataattttgtagccaccttctgttgccattgtgatgagctcaagggttgggagtattcacttaaaatgccacgtgacgctaatcatcttcaaatgagcagttcatctctccagtcaattgtgtatcacagtaaaaagtgttctctagcagttccatattttccatcatgtttagcacaatacagtaaataatttgaataatatcatgggacccatatcaagtgctactaatgatggtggaagtgctcccaagaagcagacaaaagtcatgacatgacaagaaaaagttgcattgcttgatatgtaccatagattgaggtctgcagctgcggttgtccaccatttcaaaataaatgaatccagctgaaggcctattgtaaaaaaaaaaaaaaaaaaaaaaatgatcccggcatgttggcgtgcacctgtggtcccagctactcaggaggctgacagaagaggatcactgtagcccaggagttcgagactgtagtaagcgatgatggcaccactgtactccagcataggcaacagagtaagatcctctttaaaaaattttttttaaaaaaaaaaggaaattgtgaatctgtcactgcagctactctagcaggtgccaaaaccttgtgctttttgcaaaatagctttttatctcattgaaaatgcagcttttatgtggatgcaggattgctataagaaaggcatacttgtagactctaatatgatttgagaaaaaggaaagtcattatatgacaacttaaaaggaaggtgaggtatctaaagctggagaatttaattccagcaaaggatggcttgataattttagaggtttggctttaaaaatgtcaagataggagaagcagcttctgctgaccaagaggcagcagatgaatcccaagataccattaagaaaatcattgaggagaaagggtatcttcctgaacaggcttttaatgcagacagaagtaccctattctggaaaaacatgatgccacgaaggatatttataagtaaggaggacaagtcagcaccaggatttaaggaaagaggagacgggctaaatctactattttgtgaaaacacaatccgatttacaatcaggactgcccttatctataaagctgctaatccctgagccttcaaggggaaatatacccaactgccagtctttgggtttacaacaagaatgaccctttgagaaccctttttctaaactggatttagaaaaaacattgatccatcaatcctttgtccctgaagtcaggaagtaatttgccagtaagagactgccttttaaagtctttttaatactaggcattgcccctagctacccaggagcatggaagttcaacaccaaaggcatggaagtagtctacttgtccctaaacacagtgtgtctaattcaccctctggatcagggagcataaggacttctaaggcacattacatacactataaaaagggttcttaatgctgtggaagagaacttcagagagaacattatgagggtctggaaggattacagttgaagatgatgccatcatttttatagaaaaagtcatgaaagccatcaagtctgaaataataaattcctgttggagaaaactctccaggtgatatgcatgatttcacaggatttatgacaaagccaatcatgaaaaagatggtagatatggcaaaaaaggttggaggtgaaggatttcaagatacgaattttggagaaattaaagagtcagtagacaccatgatagaggaattaacagaagatgactgggatggataagagtgctttcaaaccagtgccacaagatgaagaagacaacacagaagtaatgtcagaaaacaagttgacattagataatctgacagaagggttctaattattcaagactgcttttgactttttttttttttttttttttgagacggagtctcgctctgtcactcaggctggagtgcagtggcacgatctcagctcactgcaacctctgcctcctgggttcaagcaattctcccacctcagcctcccaagtacctggacaacaggcacgcgccaccatgcctggctaatttttgtatttttttagtaaagacagggtttctccatgttggccaggctggtctcgaaatcctgaccttaggtgatccacctgcctcagcctcccaaagtgctgggattctgtaatcccactgtaatcccagtggctgagccactgcgcccagcctgcttttgacttttacgacatcgacccttctatgatacatcactgaaactaaaacaaatggtggaagaattggtatctcatagaaacatttttagagaaatgaaaaagcagaaaagtcaagacaaattatagtgtatttctgtaaagttacacagaatgtgctagcctctcctgcctccccctccacttcttctgcctctgccactcctgagacagcaagaccaaccctacccttctgcctactcaacagtgaagataatggggatgaaggcctgtatggtgatccagttaatgaatagtaaatatactttctcttccttaggattttcttaatatttttttctaactttacttttagaatattgcttacaatacataaaacaaaaatgcttccagtcaacagcaggctattacattttagggcaaaatttattatagttctcagttacataagtgggagctgaatgatcagaacccatggacacatagtggggaacaacatacactggagcctgtttggtgggggagttggtcaacggggagggagagcatcaggaagagtacctaatggatgctggggttaatacctaggtgatgggttgatctgtgcagcaaaccaccatgacacacatttacctatataacaaacctgcgcatgtacgccagaacttaaaagttgaaggaaaaaaaaatttcattatggcagagttttgactacatgggtggtcggtgcccctaacccctccattgttcaagggtcaagtgcatattaatataatcagaaaaataacagaacgagaattttttaaattattgcatattgaaagtgtactcataggcaattagtatgctaaatatatattacaagttacgagcaaaatagtggttacatcgattgatttttgaatagtggaccagccttgcattgatgtaataaactcccacttggatgtgatatataatactgctgcattcactttgctagctaacaatagaaactaagattagaaggaaagcatatgtttagcttagcatggtggttccaaatctggctaatcaaaatcaactggaggacttgaaaacacaaatttccaaaccctaactctgcagtgagtttggtgtgctgcctaggaacctgcattttaaatatgctttctaataatatttatggagccaagtaagcccagccatctatttataaagtggaatagtacattgagattgttggtttagtgtttaaaacaaaagcaaaatatctttgagaagtctatcaggtttttcttacacacgtgatagacatgtaatttagtgcttcctattattccaggatacagaaatgaacaatagtgtctaccacctggatgtacactgtttaataggtgaaatagatatgtaaaagcaattaaaatatgataaatgctatgagagagatgtaaaaagtgttataggtgatctgataatggactgattgattacctggcagttttaaggaagcctttaaaaataatatatttgaactgggttttaaagaatgatataaatgttgctaatacaccaaaaaaatgtcatctgcaaatatggtttgttcacaaaatggagagaaggggaggatgataggacatgaggctaggaaatgtaggttgcagctcaatgatgtgtatgtagggccttattttccattctgaaacatagttagtggatttatatcaaaggatttcaaatagaagaacatcatgatgagaataattttaggatttatatactctactttagggggtggagagttctttttacctaggcttagggaatagaaagtggtgtagagaatataacttcaattacttctttcatcatttttcttcctttagtccacaagccctagccatgccgtggtagccaatgttcagcttgtcttgcatctaatgaagcaacacagtaaagctttgtgcaatgatcgagtcatcaacagtattcctttggcaaagcaagtatcttcacgaggtggtaaaagtaagaagttgtcagtaacacctccctcctccaacggtattaatgaggagttgtcagaagtcttacagactttacaggatgaatttgggcaaatgagcttgtgagtttttgtttttttttttaaattcagtttagctctaaaacctcattttttaaaaacttgttgactttattaaatcttactttcctttgttgagcaagtatggttgagcacaatccttataccaaccaagttactgggactttaacaaatacaactaataagggtaaaatctctctctttttaaatactgttaaatgttttgaagaccaaggtttatatttaagttttatttctttgagaacttatgatatacagtcatgcatcactgaatgacaaagatgtgctctgagaaatacatcattaggcgattttcttttccttgtgctaacataagagtgtgctaagcttatagcttattgctcctaggctacaaacctatacagcatgttactctactactaaatactatatgcagttgtaacacaatggtaagtatttgtgtatataaacatctaggtagagtaaaaatatgatactaaagtcttacgggaccactgttgtatatgtggtctgttgtttactacatcatcatctggcacctgacatcacattcattttagctaaacttaactgataagacatgagtgtttgaagagcaagattcatctgtagactttacatatacaatactcttttggggaaaataagaatataaagaattaaccttgaaattaagaactcttgcatttccctctagtgcctttcttgaacttttaaattcatatttttaattaaaaatttcttgatctaggctaggcatggtggctcacacctgtaatcccagcactttgggaggctgaagtgggcatatcacatcctggctaacagggtgaaaacctgtctgtactaaaaatacaaaaaattggccaggcatggtggcaggcgcctgtagtcccagctactcgggaggctgaggcaggagaatggcgtgaacccgggaggcagagcttgctgtgagccgagatcatgtcactgcactccagcctgggcgacagagcaagactccgtctcaaaaaaaaaaaaaaaatttattgctctgttcaaaaaatggagtcattttttaaacacatggagcagtaacccataatgaggtataatagacctaaccatgaaacacagaaaacttaaccatgttctacttctgctttgtatatagtgatcaccagcagcttgcaaaacttatccaggagtcgccaaccgttgaactgaaagacaagttggagtgtgaattggaggcattagtgggaaggatggaagcaaaagccaaccaaataactaaagttcgaaaataccaagcccaggtaactcagttttccttcactcaagtttctaatgattaagaaaaaaaaaacactttaattcaaatattaaatgatgacactaagtgtatcatagataaatatctacaggagatacttctttactgaagacatttgttcattgagaattggtaagtggattaagaaagaagacacttttagtcacttagcatattcatctaagaaacatctttcaaatactgaatatatttaatattctttatgaataagctttaacttctttgatgaatttaaattggagtttatccaagtaagtttttttaaaagcacctgcgaaattctgtttccaaaggaataagtcatacattaaatatgtgaaatatatttatgttgctaatcattttatatcagccaacaatgtagtactaccagatgcagtggtgacatcacactcaagggttttcaaccagagagaaacatgattcatatatttaagagattactgtagtgactaggggtagggtaatgggatcaaggcagagaggctgagagatcagctatagatgtatcagaggtggtcagcaagacagtagttgggtttgggcagaggtaaacagatttgaggtatgttttggaagtaaaaaaaatattggggttacttgctgctgggtatcatgtagaaggagagggagttaggatggtgattccactgactaaaatggagaaagctgagaagttcagagagcagaacagttttgttgactgttgattggtagccatatgatagacacacagtgccaagtgctctgagtatatcttctcatttaattttcacaaaaggcttctgaggtgggtatattctcatattatagatgaggtagatgctaagccacattttctgggaagtatgcatatatcctcagtgaaattaaataacttgcccaagtaccagcttactgggaaatggcagagctgggatgaaactagccttttcaactctaaaactttggctgttttttcaaagttcatgtatgaaaaagaaatacaagcaaattattcctgtaggagtaaggagtaatggtctaatttgttgcttatactaattagacttattctattggaacaccaacatgccagcatcagtttggctaaagtaaaaataaagctcccgtatttaaaattattctaaaaataatggaacaaaaataaaattcttttcatagtattaatacattaccaattacatctgttcatccatctggaaattgcttctttgcctcctcagactagtttctagaatatctttctcctcttctcccatttgtgaaaatccttcccattcttcttttctctgtgtctgattttttgcctccttcatgagtctttccttcaactccccttgtttctcactcgccctgttctgtactttggcaatattgccttaatttaggacaaccagaatttgtttactcatgtctacttgtttgtgtattgttttatatatatataagcatatatttatttatattaatatttaagtgttaaatgactagtgcagtagattttgaagtctttaaaagaaagcctagaatgtattatttttcagttagcatgagagttaaccaaaaaaaggtactcttgtactttttgttgtcagaaaaaaaatattttcattaaattctccttttccttcctgccttggttatttggtatagctggagaaacagaagttagagaagcagaagaaggaattaaaagctaccaaaaagactcttgatgaagaaagaaacagcagcagccgttctggaatcacagggaccacaaataagaaagattttatgaaactgagacctggagaaaaaaggagaaaaaatcttcagttattgaaggacatgcaaagcatacagaattcattacaaagcagtagtttgtgttgggattactgactcataaccaggtcagaaattttattcagataatctgtacctcatcaatcagatgatgacaatttacttcccaggtctcatactcacttatgttggaattaattaatagcaggtgttaaaggacccaggcttcattacacaggcttttcatgtatgcaggatgactcaatgttaaagcatttaaatggaaaccaggggagttttaaagcccgagaaaccacacataatcttttgttgagatgagtttgctgtactgacgctgcactttgtaaacagattaccagttttttacttgtgggtgtgattttttaaaatagttctttatatataattaaaattaggtttaaattttcaaaatatgagactatgctataggcagtgcttgcttgaaaagtctcatttttaaatctccctggcatgaggtgcccacttcccctttccaaagcaaccattaaacatactttgtttctactattggtggagtttttctatatttaaaaatacatatatatttcagaggatttttattttgctttttggcatttcagactttgatcagtgttaagtgcacttgtattgctttttaatctgttaattttttaaagacccaagcagtcattttgagttatatctataaaaattataaaaggatttttgaaagtataaacaaattgtcagtgaaataaatgagattttggaataaagtgagaatgggagaagggatatgttgtgagcatataccttcacagttcttaatacctgttttgtaatcatgatattcagtcaaggcattatggtttttaatcttgaaacttagagaaccctttgaatatttgcttttactggtgtacagtatgagtggaatataaactgtacacataattatcatgttgatataaatcataatttcaactagatcaagacatgttaaccttttataaatttaaagtcaataaagcacctttttaaaggaaacactgcaactttccttaacagcctgttaataaaggctttgtgacaagctctcaaaaaatgcatttctaaataggaggacatcaatgtattgatgaagagaaaaaactagtacttagttgccacactcatgcttacatagaaagagagcccaagaatattagatttcctcatgatacaagatactacagtaacaggctttaatttaggatccttaagattttggggtattatttgtgactctcctgaaattgtaaacttgtgcttctgtgtccagttttctaatgagtaggttcgtagcttgattgaattaataattgtgagcccatagacacaagggaagtgagaaacagtgctctggtgacatgataaatatatgtgtcaaccaccatttcagctattaaaaactcctgttatctccttgtttgaatttcaggtcattaaattgtataaccatcatttgaat

SEQ ID NO: 1575 - DNA, 42235 bp, Homo sapiens; identical to SEQ ID NO: 1574

SEQ ID NO: 1576 - DNA, 42235 bp, Homo sapiens; identical to SEQ ID NO: 1574

SEQ ID NO: 1577 - DNA, 53032 bp, Homo sapiens
gcgtcatgttagggtgaagcagaggacctcagtgctgaacatgctaaggaggttggacaaaatcaggttcagaggtcacaagagagatgacttcctcgatctagcggagtctccaaatgcctcggacaccgaatgcagcgacgaaatccccctgaaggtaccgcggacctcgccccgggacagcgaggagctgagggaccctgtgagtacctgtcctcgtcccccggtgtgggctggggtgtcgtccccgtcctctgtggccgggccaagcgtggactcaggcagattcgtgtcctgcccatgctggtcagagatggactgggcctgactctctgtctcacctgctcccgacccctgcagaccttgtggggccggggtgctgccacgccgagccttctgtgttcgcaggtctgattagcggctggattggttttcctcactggcttttctgggtgggtggcagacttctcacgcacatgtgacgcggaagcctcggcctggccctgggagcgttgacatgcggatggagcagggcgggcgttgtctggaagccgctggtgcctggcttgtcttctattcaagccaaggtgcacgtttccagcccccaaagctggctaagcccaggctgggccctcatcagccacgcggaatcagggctgggcttgtggccagctggggggacagcaaatacccacggagcacctcagctaggccctgggccctgggtgggagccaggtggggagccaggcgggagccaggcaggagcaggccctgccttgcagaaacttgcatttggtggggggtggggcagggcccgaagcatggtgggttgggctccctgcggcccctcctctggcccagcatggcctctagctcctccccgcatgcacacaccaaatttggtgtctggctggtttcctcctccagcccctgagccaggtcttctttccaggtgtggcctgggagcgccggccttccctggctccttgcgttgctaatgctttataacaggacagtgactgtgcgttgctttcagcaggaattaataatttactgctgctgctgctctctcgacactgcccgatcaggcaggtggggccgcttggcttcctggggcatcactacagaccacagagtgcccggcctgccgggatcggccatccccaggcaaaggttgtggttggtcctgggggtggaccgggaccccggtagggtgtctgcccttgtgcaggttatgtggcagaacggcaggggcctgccttcgccggagagctgtgtctcatccgcctctggctggggctggcacagagggcatgggtcacgattctccgatggtggtctgtgtgctgagcatgtggtgggtgtctcgggaacaaaaatctccctcccgacacatacatggttcaacagggaggggtgacggggattccacgcaaaggccagagcggggctgtttccccagctccctctccgccatccgtctgtcctgctccaggtgttgtctcggtagggaccctcccgcctgagggaccctgtgagtacctgtccttgtcccctggtgtgggctggggtttcgtccctgtcctctgtggccgggccaagcatggactcaggcaggttcgtgtcctgcccatgctggtcagagacggactgagtgtgtgcgtggtgtctgaggggcgggtggactgagtgtgtgcgttggtgtctgaggggcgggtggactgagtgcgttggtgtctgaggggcgggtggactgagtgtgtgcgtggtgtctgaggggcaggtggactgagtgtgtgcgtggtgtctgaggggcaggtggactgagtgtgtgcgtggtgtctgaggggcgggtggactgagtgtgtgcgttggtgtctgaggggcaggtggagggctgcagtgagggggccagggccagggttgcaggtattggtctggttggagcagcaggaggtagggctgtgggatcatgggagtcttcacctggggcagaacatctggatttggggggcatcagggatccccttcgggggagggtcagtgtcagagctggccgctccagggtgatgtctggggagtagcttggagaatgtggctcctgggggtggcagagggtatggcgctagcggtgttgctggcgtcacaggagaggcaggccgtggtctggaccagctctggtgggcaggtggtggtccacgaggtacaagggggcttgagggggcatgttgagttgagagggagcccaccgagtaggggcaaatgctgcagaggccagggcaaggtcagcctgtggactggggccccccttcctcgaggctgtgaggggctgcggggggaaaccacctcagggactcggacgtctggaaacccaggagattcctagtgtgggtgagcagggccccgcttggggcatcgtgctgaatgcaggtcaggcactgactgcagagaccaggctgagttccttagctgtgtaacctggacctgagcctcagtatcctcagcttttaagggggacggcagtctcgtccacccccaggcctgctttaaggatcaaatgagataataagtgaaacgtacgtggctggcgtcttgcttatggttagcttggagggagttgtaattattaatgaccgtgaaatactgattcgctaaaccctcctcctggttccagggctcctttgcgaagcctcgttcctgtagcacgttgacactgctccggcccaggctcacgaggcccccggggtggggggctgtgcagcgttgccctgctccttccgaggtcccctctcatcacccttctttacacgggcagcctcccagaaacatcctgagacctgggctcaggcacagaggccttgggggttggttttataacagcttaatcgagatattcccaccgggtatacagtatacagttcacccactaaaagtgtgcgactcaggggtttctattaatagcatatttacaatgctgtgctaccattactacagttttaaaaggtttttatcacctgaaagagaccccgttcctttcacagtcactcccatttcccttggccaccggccccaccagctgccagcctgctttctgtcgatggatttgcccatatggggcatctcatataacatgaggcctcgtgtgtctgtcctttgctcgcataagggacgcgaggttcatccatgctgcggtgtgcattggtgccgcctgcctttttatggctgaacctgtttcatcatatggccaggccacattttctttttcttattctttttttttttgagacagagtctcactctgtcacccaggctggagtgcagtggtgtgatctcggctcactgcaacctccacctcccaggttcaagcgattctcgtgcctcagcctcctaagtagctgggattacaggcacacaccaccacgcccggctaatattttgtatttttattagagacggggtttcgccgtgttgcccaggctgttctcgaactcctgagctcaggcaatccacccgcctcagcctcccagagtgctgggattacagacgtgagccaccgcgcccgacctgttgtctttattcattgatctgttgtgggcgcttgggcagttccattcttggactgtgatgaatgaggctgaatgcctgcgattgagtgtttgtgtgcatgtgcttccacatggtctcgctgggccatgcagaggcccgagattgcccttttccaggatctaccgcattctcatgtgcagccgcgccatgctccgtgcccaccggtagggtctgagggtttccctggaggggcaggttcagaccggagcccaccttgcagcctggggtgttctgaccgcccctctcagtgctccaggagctcttccgtggcggaccccaagcagcctcactcctggcagcggctcaggatctcaccctgggatgttcgtcacttcagctaatctgtccccactgagggatcgcaggtgcttgtggctcttagcgtccatcactcctggcagcctggtgcccatgtgggctgcggcacttttggtggaagtgctggaccgagtgtgcctgtgtggtggtcctggcagctgtgcggtgtgccctccatagccccccgagggccgtgtgccctcaccccggcctccgcagtgtgccctccatagctccctcgagggccgtgtgccctcaccccggcctctgcagtgtgccctccatagctccctcgagggccatgtgcccccaccccggcctccacgctgttctcaggcttctctctccaccgccccgaggggcaagacggcagtgccgagtggctgtaggttgcacggcttttattgtgcaggaagttggtcatctttgcacacatgtaggcttcattctttttatttgttgtggtaaaatacacagagcattgaatgtaccattttcattttcactgtcagtgtgcagttcaggggcacggagcacatgccctctgttgtgccaccatcgccacctccacctccacctccacctccagaacctttcgtcatcccagactgaggcccagcacgtgtcacacgccagctccctggtgggaattcctccctgccacaccccggcagcctgcattccgcctcctgtctctgaatgtgactcctggggaccggggatgggtagaacctcacagcctgtgtcctttcgtctcctggggaccggggatgggtagaacctcacggcctgtgtcctttcgtctcctggggaccggggatgggtagaacctcacggcctgtgtcctttcgtctcctggggaccggggatgggtagaacctcacggcctgtgtcctttcgtctcctggggaccggggatgggtagaacctcacggcctgtgtcctttcgtctcctggggaccggggatgggtagaacctcacggcctgtgtcctttcgtctcctggggaccggggatgggtagaacctcacggcctgtgtcctttcgtctcctggggaccggggatgggtagaacctcacggcctgtgtcctttcgtctcctggggaccggggatgggtagaacctcacggcctgtgtcctttcgtctcctggggaccggggatgggtagaacctcacggcctgtgtcctttcgtctcctggggaccggggatgggtagaacctcacggcctgtgtcctttcgtctcctggggaccggggatgggtagaacctcacggcctgtgtcctttcgtctcctggggaccggggatgggtagacccttacggcgtgtgtcttttcatctctggccgctgtcaccaagcaccatgtcctccaggtgtgctccgcttcattcctgcttcctttcgttgtgggctgtttgtgtcctgggacaaagtggctgagagtagaacccagacctgcttgggaggggaaggttggaggggccctgggtgggcttgaggggcccacgaggctgggctgggaaggggaggtaaaggtggaagagacaggtaactgtgtggctggtgctggctggaaggagaggtggcaagaaggaggtgggcatgcttagggctggggcagcgtctggggtgacccccgaccaggaggcaggagatgggagacgtccccagaagacccacgccccatcttgagagggctgcagatttcagttgaggcaaaagttggagaaaatagttctagaaaagctgaagaactgagaaatggccaggcctaccactctagttttatagtgacagcgccacagccttggtgtcctgcacccttggagttctgagtccaggcctctgactccagctcagggtggctcctctgtaggtctgagaaggggtcagctggagggacccacagggcttgcagaaggattcagaccccagcatttcagggcagcaccccagggccttgtgtcccaataggagaccccttgttcattggtgagtcctgcagagccagccctcaccaccctggtatccaggtggctctcatctgggctgtggaatcccaggactgggtggagaccgtggggcccagccctcgtgggcctggagcagccattggagacagggttggcacatgtggatggagccgggtcacccgcacgacgctgcctgtgcttgctggggagggtgctgggcgtggcggagttgaattttccgcctctgcactgggcagagcctttccacgcaggcctctggccccttgccacatgtctgttatggggacccacacagccccccgcccggtggggatggggatgtggagggaagagcatacttatttgtagggctgagtgggcagaggcagatgggagcctccaagctcttctccaactcagcctccaggaagcagccctgcccaggctgacgtgctggaacagggtggcacggtccaactgttttccccaggcctccccgaaagtatgccacagcccaggctcctcggaagccagggggcccccagctgccctggttccatccctctgcccgcccgtgggccttcctcccctgaccccagtgccagcattgtctgtccttgtcacaggtgggtactgttctgagttggggcactgggacgtttcctgtgggaatagagctgtttaaagtgtggctccctctcctgccctccctggggagccccccacctaatgaaggtggggacttggatgaggtggcatggatgcccgtcctctctttgtccctgacttccaggtagcctttgctcatgtctgtcccagggaagggctggctgtgtggggctgtttcaggggctcctgatgaaggctgctcctggcccgggagcccagcaactgggggctctggccggccctgctttctccgtgggttggcgtccttgctgctgctgccaacgggagtccccagctggaggaggccaaggccactggcttcctggggaccccagcctgccttgtcaccaagaagaatggggtcctctctctccagcatcacttgagacaatcccaggaagaatccattgtgggaaaggcaacccctagttccgagcagggtgtccatggggtgtaggcaggaggtgggctgggtgggctccgggggtcccggccgtacagggggtgttttctgtcctcagtgtggggctgggacttgggatccttgattgttgtttaggccgccttcccggttagaaaattcatgataagcactgaggtctcccaggccaggcctccatcatcctacgtggaccacgttactcctgggccaccctcaggcctgtctcacccccgggtgcctgtgctctcagcagacagttgggggtgaacaggcccactggccccaggcacacacctgccctctgtaccttcaaggagccattgtaaacagagtaagtgaagtatttggaaaatgcctcttgaaggtgggccctgccgagggctgggggagtgtggcaggttccctcggtggggagcgaggctgcagaggtgcctggctgctgggtctcatttcagcttaatgattatgacttcctcctccagacaggcacattcctgtctctgaccttgccttgcaaccgctgtgggcagggtggctaggtttgactcaaatgcaaggaaaatggagagaaacttctggaagctacatagataagaaacctaaggaaggggagacagaggagaagaagagataggtgtgcatctccaaacaccagcccaaggcagactcagcgaaggggcagagggcgtgcccagctgtgcaggagcaagggtgggcgaatggcgggagaaggagcaaaggcaggagccaggtgccagcctggtccttggtccacagtcaggggtcctggaactgcccaaggcacttgggggcaagtgggtcggagcaagcaggtagtgcgtggccacagtttctgtgtttgagatctttaaaaatattcataataggctgggcacggtgactcatgcctgaaatcccagcactttgggaggccaaggcgggtggatcacctgaggctaggagttcaagaccagcctgggcaacatggtgaaaccccgtctgtactaaaaatacaaaaaaattagccaggtatggtggcaggcacctgtaattccagctactttggaggctgaggcaggagaatcgcttgaacctgggaggtagaggttgcagtgatccgagatcatgtcattgcactccagcctgggcgacagagtgagacttcaccatctcaaaaaaaaaaaaaagaaatcataatagaaaacattcaaaatgtccagcacgcttttgaactagagagcagcgggctgggagcccaagtgtccttcgtccctttgtggttggtaccacccctggccactcctgtcttggggagccgtgtcctccctgcccccgcccccagccactcctgtcctggggaaccgtgtcctccctgcctccacccctggccactcctgtcctggggaaccgtgtcctccctgcccccgcccccggccactcctgtcctgggggaccgtgtcctccctgcccccacccctggccactcctgtcctgggggaccgtgtcctccctgcccccgcccccggccactcctgtcctgggggaccgtgtcctccctgcccccacccctggccactcctgtcctgggagaccgtgtcatccctgcccccgcccccggccactcctgtcctgggggaccgtgtcttccctgcccccgcccccggccactcctgtcctgggaggccgtgtcctccctgcccccacccctggccactcctgtcctgggaggccctatcctccctgcccccgcccccggccactcctgtcctgggaggccgtgtcctccctgcccccgcccccggccactcctgtcctgggaggccgtgtcttccctgccccgcccccggccactcctgtcctgggggaccgtgtcctccctgcccccactcccagccacccctgtccaggggagctgtgtcctccctgctccccacccctgaccactcctgtcctgggggcccgtgtcctccctgccccccgcccctggccactcctgtcctaggtggccgtgtcctccctgccccccacccccccggccactggatgactctggagcaggtcccaggcacgttctcattctgtctgaaacacgccagggtccatatctgaaagaagaggactggagagaaacagcccagggcagtgcaggggtccagctgcaggctttgcagtgtgcctcctcctggctgcgtgtgggagcgcccaggcccttgcccactcaggtgaaccttttccaggctgtctatgtcagagccaccttcatggggacgtttagcccccggggtctgtcctggggccccagctggggtcctagtctggcggcacctgcgtcttgagcttccagggtcagcttggagccccagacccatgtctccagcgtaagctggagcacaggtggggttgtgtgacctccttgagactcttttggagcttctgtcctcctggatgggtgcttgtgggatcccagcttccagcacctgggctccgctggcctcccagaacaggcgtcccatgcctgttcctcatctgtcagtgctgggacagaccccaagcagctcccacagggtccgtccagcgggcgggacagatggaatcaccctgcctccactcatgccctgggaactcttgccccagcagcgagagcagctgaaagtgtgggaggtcgggcacccagaacggggcagccacagccagagtgccctgcctagaagctgctggttcccgaagccagcgccttattcctgggctgtggccacagcgtgggtgatacatgtgcaaggagccgttgcggtgctgctccgggtggccttgttgaagccgcacacctgttacctggctctggaggaggaagtctgaggacccagctggagaaatcgggtcgctgctgtcctgtggtgggacactcactcgtgtgctgtccctcaccaggtccctggcaggatgcaacgtggagggcgactgtgtggcatccagtgtggggcccaggcaggcctggctgtgccgggcatggcccctgctttctgtcccatcagcagggtgtggaacggccgcctgtgcccagtccctgggctccaggcatcgggcagctgtagcctgtaactcgagcccgtcctggcttgctggggctgtgagctggggtttttgtggagcagacaggatgacgaggcccctgtttggagtttgctgtggctcactggggctgtgagccgcggttttcatggagcagagaggacgacaaggccgctgttcggagtttgctcacctcggttgcggcagacccttctgcccgggggccagtctctccgatctactcagtgtggctcgtggaggcgcccgcagcctccactgaggtgtgagggcctggctctggcacggccagccggacacacggggccagcacagttccagggttttcttccctctgcagcctgaggagatcaggatcacaaccatcaagagacttagcgccacttatccagttcccttttttttttttttgagatggagtctcgctctgtcgcccaggctggagcacagtggcgcgatcttggctcactgcaagctccgcctcctgggttcatgccattctcctgcctcagcctcctgggtagctgggactacaggtgcccgccactgcgcctggctaatttttcgtattttttagtagagatagggtttcaccgtggtctcgatctcctgacctcgatccacctgcctcggcctcccaaagtgctgggattacaggtgtgaaccaccgtgcccagcctccatttttaagatatttcttaaagccagccttacaggggctctgaggatatccacattctctgagatgtccctgctccccacagaggaggctgggtagacagacacgggtcttatgctgggggctccgtcgccccatctgactgctgcgtcgtccccatgtccagaaactgcagctgctggtccctttcacatgccactgctgccatcctggggcccctgggcacctctgggggaactgagtggtgcagacccagggtgccacaggtggcccctttgagcttttggtgtttttcttctaggctggtccagggaccctcatcatggccacaggagtccaggactttaaccggacagagtttgatcgactgaatgagatcaaaggtcacctggaaattgccttattggaaaaacatttcttacgtgagtaccagaaagcgcttggaggggatgggacaaggtgggtcaggggtggctgagatgggggatgtcgtcttgcccaggagctgggtctggtgaagacccacgcaggctccatcgctggacacgagccctgggcagctgtggctccgacgtggccctttgggctgggtggtcccggcacagcctctgtctctgtgtttgagcctcccttgcggccctgctaagccggcactcaaggttgctccacaggggctgggggcgtgggggcctttcccctgcggggtaaaggagagtctctggggaaaaggagtgaaatgttcccagaaaattgtaattattttagtgaattggtcccttgcattcccagtgggtggctcggactttttcagagcttttggaaggactctgaaatcttatgtttgttctggttggtttgtgtctccaggagggaggtggggcagtaggctctggcgtccactggccttggccaggcgtgcctggtttgctgggcttcggactctgcagcagtgagaatggcagagattcttacaggaggggctcgcaggcttggccccacttggtgtatcgctcttgagcctctctccccacctgtgtcctccctgttgtccagatgtggaaactgaggcacagagggttcacaaagtgatgcctgactagtaagaggccacttaccagtaagacagtgccaggcagatgagtcccaaatttcctgccagcaaccctgctgtgtgtggttctcacagctgactctatggtggaattcttgttattacgctcctgtgtgtccagagccagtcacttgtgaaccacatggagcccccatttgtgacaggcaggggcttacgaccggggtgcacaggtcacttccttctgggtgtcgtgcccagccagggtcttttccatgctgtgtaccagacagccagtgcctttgccagaaggattgtcatctgggtgccctgtccttggttaccagtgctctcatgtctgtgcgctcacctggtgctcaagggtccaaggcctgtccacacagccttgtggattcacctggcaacaggccagagcgtgatagtgagcctgtgtatgtacagcactggactgtgtgtgtgcttagatggcgtaatgaactctgtgtgctcatgtttgtgtggctatggttaacggtgtgtgcgtgagtgtgtgtgtgtgtgtgtgtgtgtgtgtatgtacagtggtggttaactctgtgtatgcatgtgtgtgagtagttaaccacggtagtagttaaccgtgtgtatgtagacagtggtagttaaccctgtgcgtgcctgtgtgcctgtgtgcagcggtggttaaccctgtgtgtgtgtgcacgtgtgtggtggttaaccctgtgtgtgcacgtacgtgcacgtgtgtggtggttaaccttgtgtgtgcgcatgtgtgcagtgttagttaatccagtgtgtgtgtgtgtctgcgtgtgcagcagtagttaaccctgtgagtgcacatgtgcggcagtggttaaccctgtgtttgtgtgtgagcgtgtgcagtggtagttaaccctgtgtgtgtgtgtgcagcagtagttaactctgtgtgtgtgcgtgtggcggtggttaaccctgtgtgtgcgtgtgcatgcccgtgtgcagtggtggttaactgtgtgtgcgtgtgcatgcccgtgtgcagcagtattaccgtgtgtgtgtgtgcatgcccatgtgcatcagtattaaccgtgtgtgtacacatgtgtatatccatctgtactctgacagctttcttgggcccctgaggactggacactggtcgttctgaggacagctctggtgacacactatggctgtggtgtggagtgactcggtctctccatgagccttaggttgcatagagccagcttgggcagagaggggctggcccgcatgggctgccgacagggttcagtcctcccgatgaccgtcctggtgacctgccgcctgcgacctcaccagcctgcagtggtggctctgctggaattgatggatctctgagaatggagaggctgggctctccctgggcggtggcagcagggggctggcccttggttgactgtccagctgggcctgtgcatggaaggtatgctatttggcctggagagcatagctcagcagacgctagttaagtcatcaaccaccagaggctgccttatccgctgaacctcacgaattgcctttctgtgagttgaagtggttgaatattgacggtttttcagtcatggggcagggggtcagtgtttcactttcagggagcaggtgctcttggtgcagggcaaggatctgtgagcatcaacagagaccctctgctggggcccgggaagcttcaggagaagaggcgagctggcatgtggggtggagggatggagggacgcctgtccaggcagattcgctttgagacgttgttgataacaaagttgcaaaatggagacagctgaacccacagggctgcctctctggggccgagcagatcccggaggaaatgaggccacctggtcacaaacagagctgctggcgtccctggaccagcacttgtgactctgtcctcagcatttgccaaaggagcatctccttttaccccttggtagctcgtgaagtaaaagtgttgggttcacctctgacagcctgtggggtggtgagcacggggattattttttaattatggaaaatttcaaatgtatccagaaatggagcaaagagtgtcatgggcctccctggttgaaacccaccactggccgcaacaagattcccagcaagattccggaccaggcaggcttccccgacacgccctctccctgcccccaaccccctgccccggccccccgccccccgccgaggttttggagcaaatcccagccagcatcctctcatttcagctgtaaatatttcagtggatagctcagtgtgttttaaaaacaaaagccacgagtctaatatcacaactgaaaaaagcaaacagcttttcgttaataccatcagctgtccaacttaagctcaaatttccctgatagggatcgagccgctgcactccagcccggatgacagagcgagaccccatctcttaattttgtttatttatttatttagagatggagtctcactgtgtcgcccaggccggagtgcagtggtgcgatctcggctcactgtaacctttgcctgccgggttcaagcgattctctggcctcagcctcctgagtagctgggattacaggcacgcacctccatgcctgggtaatttttgtatttttaatagagatggggtttcaccatgttggccaggctggtctcgaactgttgacctcaggtgatccgcctgtgtcaaccttccaaagtgttaggattacaggtgtgagccactgtgtgcggccccatctctaaataaataaataaggaaggaaggaaggaaggaaggaaggaaacaaataaatgtccctgatgaggtctcagattgctttgcagctctctgtgaatgaagagtcagatgaggttggtgtgctgtgctcggtggtgtctctctccggtcttgaccctgcgggttctctgcgcgtcacactttttgtccttggtagaccaggtcacctgctggacagtctctgctctggactgtgctgaaggcggcctaacatggtccataccctgtgcttcctggtcgtggcggggttgggtgaccctcgggggactatccctctgttggtggtgccgtgtgcttccatgaggcagtctctgtttaatgtcacagctttgatgattattgctcagagccatcatttcattagaggttgcagaatggtcattttctacttccgctattctctctccatttgttagccgacacatttccgaaaacaaacttccctttgtctgccgtttggctccgccaaggagtagttcatagacaaggggcagggtgcatggttggattcccccctcattttccagttttcaaaataatgagttgcattctcttctgagagcatccaccagagagggtgttgggctctcctggggtttttggtattctcatgagacagtgaatgtaaacatatttggtgtgttttgatcattctggctcgtatctgattaatgctcaaatagttctgcctctgggcctctttcagttggcttctgagagtccttctgacacaacccagttgtctctgagagattccttgcctttcggtgtgaccagatatcccaggctcatcgccagcatttcctgccccagtcctggaattgaccatttctgaaataaagccctggtttcttttggtggaagctgacgttgatacactccatggggatcctggggcattgatggccgctggtgacctgtcgtgtgtggaccttctcagtggacagggcttgggcctgaggagttcatacagataattctattggaattcacaccaggactcctaagtgcctgtgtaacctcatcagacttttattgtatctttgttttgctgaaatcttggttctcagtgaacatcatcggcattacacatttgtttgatcccttgataatacacacaatctcaaaataaaatatcacaagattactcaatgcagtctctatttgtttcttgttcttttgtccttagggcttgtcccactagaaaggtacagattatggtgtttgacagtcactggcaagacttttttcttcctttgaggctgtgttatcaagtcagtacagagttgggtgcatttgtttcttttcaccttagatttctagagatggctttttttcttttaaattttgacatgatttcagacttacaggaaagtcacaaaaataatacaaagaattcttgtgtatttttcatccagttattccccaaaggttaatattttaccgcatttgtctgtctgcctctcttatctatctatccatccatccatctatttatccatccagggatccattcatccatccatccatccatccacgcatgcatctatccatccatccatccatccatccatccattcatccattcatttatccatccctggatccatccatccctggatccatccgtccatccacccacctacccatccatccatctatccatttatccatccatccatccatccatccatccatccatccatgcatccatccatgcatccttccatccatccatccatccatccatccatccatccatccatccatccatccatccatccatctatccatccatttatccatccctggatccatccatctatccatccatccaaccatccgtccatccgtccatccatctatccatccatccattcatccatccatccatccatccatccatccatgcatctatccatccatccatccatccatctatttatccatccatgtattctttttttctgagctgcttgatggtcagttgcagacacaatgcccctgcatgctaaatacttttgtagtatttcctaaaggcaaggatattctcttatctaacttcaggacagttatcaaaatcaggaaattaacattgatacaatgctattattatctggtctgagatcttattccaacttcactattgtctagtaatgtcctttgtagcaaaagacagttctgagttgggatagtttcatgcctctttcgtctcctttcacctggagcagtagttctttgtttcctgatattgacgtttttgaagagcacaggtcagttattttgcagactgtcctcaatttgggtttgtcccgtttcctcatgaagagactcaggtcatgcgattatgtccgggtgccacagacatgatggcgtgtccttagtgtcacatcggcaggtacatgatgccattttgtcccataatgcatgatgtagagaattctttttttaagttaaatttattcatacagctatctaaaatcgtttccatggttccaaagtcaaggtatattcagagaagtcgagtttgtctccttgcaccccgcccccatttcctctcttcccctgtagataaccagttttcttctaattttacactgtattcttccaactgaaattttttataaacatgagcatctatattggttcttaccttcctgcttaggtaaatgttaaggtgctcacactttctgcatactcacattatatcctgtaggtcactccaagatggtacacagagataatccctgttccaggttacacttgcccctgttctatgttacacctgtccctgttccatgttacacctgtccctgttccgtgttacaactgtccctgttccgtattacatctgtccctgttccatgttacacctgtccctgttccgtgttacacctgcccctgttccgtgttacacctgtttctgttccgtgttatacctatccctgttctgggttacacctgtccctgttccaggttacacctgcccctgttccatgttacacctgcccctgttccgtgttacatctgtcccttttccatgttacacctgtccccgttgcaggttacacctgtccctgttctgtgttacacctgcccctgttccgtgttacacctgtccctgttctgtgttacacctgcccctgttccgtgttacacctctccctgtcccgggttacatctgtccctgttccaggttacacctgtccctgttctgggttacatttgtgtccatggtgttactgtagcatggcttcatccacttgtccacttgttccctgtttttttttttttttttttttttttttttttttttttactttgttttgtttttgagatagggtctcgctctgtcactgaggccggagtgcagtagcacaatcctggctcactgcagcctcaacttcccaggctcaagcaatcctcccacctcagcttcctgagtagcagggactataggcacattgcactgcacatggcctttttttttttttttttttttttttttttttttgtggagacggggcttcaccatgttgcccaggctgatcttgaactcctggactcaagccatccatccgcctcggcctctcaaagtttattacaggcgtgagccactgtgcctagccttgcttgttccgttgatggacagttgtactgtctccaggagtagaggatgttagtagttactgatagttcttcgcaggctgtctgcacctggaggatatgggatgagcttgtttttataccccaagcatgatgtcttgggtatagtgggagcttggtgaatggagggattaattgcagattagttggagttcgcccagcagaacctgtgccttgtcccattctcactcccatctcagtccccagaaggatatagaatgtgagagaggacattatgtaatctggggacccacagacatattctggttgtcactaagccaacgtctgtgtgccactgtggccatctctgcctcgcctgacctgcaggagggcgtgctgacatggagagctgtgttcaggagtcaggacccagttctaattcttgactcaggcgctggttaccaggtggctgtgagcatttacccgtttggggcctcagctcccccacctgtaaagcagctaagtggtcagtgttaaaatcccactcaattatctatagtgctttctctcagaaagcagagtgttactcttcatggaggagaggaaatggcccaagcgtgccgcagccttctctgatgattaaatcctgaagagtacaaatgttcctgcaagcaaatgacacaggatgaagaatgtgaagttgaaatgggttttggctcatggctgaaggcaggagcctaaatttgttaaagaagcacataaataaattaaaagcatcatgcgtttttatttagcccaaatgcatttcggttgctagtgctttttgagcgcggttgccgtgcatgcgtgtgcatctgttggtcactagtcacctgctgcgcgcaggctctgggaggtgagattccccagggttgtaaggtgcacacacagcctctacccaagagcactgtgatgtagaatttggattttgggggaaagtgcttctgaggaccctcggggccagggagcttctcttcctgggggcttcccggttgctaggctgtgtaggggagccctcgtgactgcctttcttcttcctgtgttgctggagagggctgcagatgcctccctggctgagctggagggtgctcccctaggctaccacgccctgtctctgggcatgggtaccctcgtagcgccagacacgggtggattcccggcagatgcactcacacgggcagtggcagtggttcctcaagagtgtgacttggagagagactgccttttcctcctgagcccctgatgctcccagaagctccctttcctgctgtgacatacagggatcagagtggctggcccttacgccatgggagatcttctcgaagaagctggcaggaggggctggccatctgcttcctgaggcctgcagaccttcctctgaatgctcagttttaatggaggggtcctggagcggaagggaagtttctaggtggctgtcctgggtgattcagagtgaggaagaccttccttaccattgaagtcttctggaagcagaagggtctggggagctgccagctccctgctggcgggggtgtccttttgaggcctgatggagacaggcttaggtgtggggttgactcagtgtccctggacttgcccctttggacctgggcctgtgggtgtggttcttggctcaggccttttaaactctgctcttacagtttctctggtggtgaaaagctaaactctgtgttagtgtgttttcacgctgctgataaagacatacctgagactggcgctttacaaacaaaagcggtttaatggactcacagttccacatggctggggaggcctcacaatcatggcggaaggcaaggaggagcaagtcacatcttaccagatagcagcaggcaaagagagagcttgtgcagggaaactcccccttataaaaccatcagatctcgtgagactccttcacgatcacaacaagaacagcacaggagagacctgcccccgtgttttaattacctcccacggggcccctcccacaacacttgggaattcaagatgagatttgggtgggaacacagccaaaccatatcagacttccagggccagacactgggttggtctggttctgccctagagtgacatgtttaataagtgacgactgtgagtgggtgacccagacctacagaagggagcagacaggcagaagatgaagacaggtggcactgatacagcagcgtgtctatattatatggaatttccctaggaaaaaatgaagttggcccccaatccctgtttctccatcacctccattgccccatgaactcctgtctgctctttaattacacattgtggatgtttggccctgggatacttcattgcccaggacagatctttgagtacaggggtgagctgaccctaccacaccgagttcctggcctgtcctgtccctggagctcacacctcaaaggagaaacccctgatcctgccagtggggggcctcctccctgctgcccccaggggctgggatgaagtcagagagggagcctgaacacacctgcctgtgtgttttgcaacggctgcaggtcctgggtccagcattgtcgtctgacaggtgttttggatgatgcctgtgttgaattccatgggaagtgttaagtcgggaaccactgcccacctctgtgacctctctagtcactgcgtcccgccctgctgaacacatcccagctccctggcctcacagccaaggtcctgcatgcagtgggtgagacattccccaggccagcaagccttcccgtcctctgcacctcatctgtagatgaggctacatggcagagatgggctctctcgtggcacatggagagtactgatgcagcagttggcatgtcctgatgtcccagctctgtaaggagacccttatttgtcatattcatctaccaactggagtcatatgggagggagtaaaggtagctgctgccttatctgtgatttccaagggcctgggcccagagcctggcagctactggatgctcagcgcacaactttatgtgtgtctatatggatggatggatggctgtgggtaagtggataggtagatgggtggacgggtgggtggatgggtagatggatgcattgctggaaagatggatgggtggatggataaatggatggatgagtggacatgtagatggatggatgggtgggtggatggatggatggatcagtgagtaggcaaacgaataggtagattaggtaaatggatgggtaaatgttgggtggatggatgggttgatgaacagacaagtgagtggatggatggatggatggatggatggatggatggatggatgaatgggtgagtggatggatagatgggtgggtgaatggcagagggatgggtagatggatgggtgaatgggtggatggatggatggatggatggatgagtggatggatggatggatgggtgagtggatggatggatgaatggatggatgggtgagtagatagacagatgggtgggtgaatgggagaagggatggttagatgggtgggtgagtggatgtgtggatggatggacatgtgggtggatagatggatggatgattggatagatggatgcatcaatgagaaggcaaacgaatgggtagatttggtaatgggtgggtaaatgattgatggatggatgcatggatggatggatggatggatggatgcatggatggatggatggatgcatggatggatggatggatgcatggatggatggatggatggatggatggatggatgcatggatggatggatggatggatggatggatggatggatggatgcatggatggatggatgcatggatggatggatggatggatggatggatggatgcatggatggatggatggatggatggatggatggatgcatggatggatggatggatggatggatggatggatggatggatggatggataggtagacaaatgaaccaataggctgtttcctccaccaggcatactcttttgcatatactttaaggccttactggccaccttccagagctccagatgcaccaccttgctcccattctgtctggtgtttggtcccagatgcagttttatctgtgccacctttgcttcctagtgctttggggcctagagtcaccagctggaactggagttggggagtgtccctgattgcccctagcccacactcagcagggagcaggtgcttggcagagagcctgttgctgtgggaagggactgggggcctggagggcttggctgctgggtgccaagcgcttggttggaaagggaggttgtgggggcgagggatggcacgtgctgtcgagcacacgactctcctggctccgtgctgggccggagccccagagtccagcccacaggctgtcagatgccgcgtgcctctcacagggagaggcaggcgtcggtttctgaaaaccagctgctctgggtgaaaaccctggctgggatcctagttcttcttatttgacgtggtaaaaatgtcagtacattatctgtccaccttagatcctgcattggtgtcctgaaatgtacctaaaacggtggttggccagctatgtgctcagcagccttcaacattaggatgtgacgcacttggaagcttgctccttcctggttatcagccaagacagtgttgacagttgatcgttcagtaaacattatctctgcacatagcggtaaatgacaccgcaataaataaatgttagggagaaaatgcaggcaaaacttcacaataaaagcgaggcatttcttggaattctctgttttccctgagcagggagggccacgggaggaaggggttaaaagggctgcctctgtgctggtggctgtagatgaagccgtactctgggctctgcagtgtaacttgcagcctggtgattcgatggagggagtgcctgtcttctagaaagttcctgtggtgatggcaggagggctgaattgggctgggagagttcaggtgagagtccgggggaggtggccaggtggggcctctgggtgtgcgggcctccggggatgcgggactccgccaggccaggagcagctttttgggtggattctgagttcgcgcccctggcctggtgggaaggagttttatttaaagattatcacttgatttttatttttgggtgaggctgggcctgttgaatcagtcgtgtgccaagaggactcctgcctgagagatctacttttacaggtttaaaaatagccgcagaactgctttccttcctcccagtaacttccctgtgcgctgagtgtcgaggctgggtggagggctgcgtgtcgaggctgggtggagggctgcgtgtcgaggctgggtggagggctgggcgtcgaggctgggaggagggctgagcattgaggctgggtggagggctgagcattgaggctgggtggacggctgggcctcagccccacagtctgggcctgtgtaggcctgagccgatgcatctcctttgcctcccctcaaatcagcgtggccgttcactcatcagagaacgttctgggggttgccccggagtgaccagtgaggtggttgtccctgcccttctcctcgcagatgctggggaggcgtgaaggctggagcaggtgggtgcacaaccagcctggctgtcccagggcttcctttagcctctgtgggggcgatttctatgtgccatgtgtcgccacgccaggctcttgtcctgtcccgggggctcctagtctgtggctgattctgcttcattccttggagagtggtggctggtgctgactggaagtgggtggggctgcctgcaggaccagagtcactcttccttgtgagcgtccctaaaccttgcgctagagcttgacccctgactgcaagacgcctgtgggtctgagggtccctctgggcacgcagagtgtcccctgggcttccttccatcttcccctctcctcgacatatttttctgcccagtggctcttgtgataggttggagtgggggcaggccctggcccatcgggtggccatcctggtttccctgtgtgccacgtacccgggccatctcgctttccttcctgacaatgagacggctgatgtgccttcctaggcatcgggggagcagacccctggatgagaactcacgaggcaggcacagatttctctttccaggagctcccttgggacttaggttctaggttccgactcactccttgggcaggcattttgggcccctggcctcccactgggttccttgccatttggtggctgctgtgaccaggtctgctgtgcactcagcctatttcggccggccctcgaccctggaagaggcgcagctcactgggctggaaacagtgccatgggatctgcacaagctgtggcctctgatgtggtggcttctctgctgctgcagggctgtgactttctggtctgatgttgcgggccacggctcctatccctgggtctccgcctgtgacttggcccccggcaggtgtgatatcacacgcatcctggtgcacccgggcagcctcccatccctgtgcggcgtgtatggctgccacctggactctgctcacacacgtcttgcacatgtctgtgcccaagacaggtgcagggggtcttgggagagcaggtgccccgtgctgccattaggatgcgctgtggcaggtcatgcatttgtgggccacgtgggtgactctggaacacctcctccatccgtgctgttcactgcgggggtttagagaggctcggtgtgcacttttctggtggggccgccttggtggcggcactggggaatcctgcttcaggtgcctttgagggcggagctggaggtgggggggagagagacggagctaggggctgccagggacgctgtactcctttagggctcctggacccactaaaggagggcttccagtggttttatgacccaaggactgccaggggcaggaaagtccacgccgggccaggtggaaggaagaggactgtcccagcctgcctaggcacttggttcctttgcttgacacgattgtctcgagggagagtgtggttggcacactcatggccccacagagtgtccatgtccccccagcctgtgaatgtggcctcccatggcagaagggactttgtagatgtggatgagtcgccgacctttggtggagatggttctggattatctgggggcgcacagtcaccacaaaggttctgagaaggagatggcaggaaggtcagaggaggccatgtgagggtggggttagaggtcacagtgacgtcattgctccctgggggccgcaagccaaggagcacaggagcctcaggaagctggaaaggcaggaaatgggtctcccccttcccggagcctgcagaaggaacagccctgcccacgccatgagctcagcccagggagacccaggctggacttctgaccccagaactgtaagagaatacgtttgtgttgttttaagccactgtgttggtggtgagccatgggaaacaaatgcagaggtcaccaaggggctccgtggcctgccctgtgtgtggcctcgctcccacccccaccctgcaggacaccttggccctgacctgcagggcagggaggcctgtgggtggggcagcccggcgtcctcagtgtctgtgagcagctcggggcacaaggaggcccactccggaggccgagggaacccagagcctcagcagcagctgcagattttcggtgcctggacaggggccggggctggacgagaggaatctgccgtgtgaatagcagctcagtagtttgctccgggctggaaatcggccctcctgtttcttttcttactcgggaaagagaaagaaaaattgatgatgggggatttgcatctcctttgtcctgtggaaagatacagctgtgctcggcacactgcagttgacctgaatgtgtcgctggtgggcaggaggcaggccggtgcgatggagtcgtggggcgtgtgatcatcatttcagtttcgggagagacagcagcttggccttgcagggagccgtgtgctcagagataggaaggactcatgggagagcagcggtcagacgctccagctggtttcgtttacttagctgtctttgtaccatcaggaacgacactgggcaaaggtgggaagcctcatggctcttccggaagctgggacaggctgatttgccacgctgtccgaggagccctgtctgcaaggctgagggggccgtgccgcccgctgccccgggagccaggcatcctttgggctctgagcagcgagcatggcggggctctggcgttcacatggcgtcctctgggctctgagcagtgaagatggccgggctctggcgttcacatttgtcagggctctgcagagagcctgaccccaggaggtccagggtggaaagaggggcggctgcctgagacccctttgacctctgaacccaggcttgtgagtgtgctttttcacacaggcaggcatgacatggcatcccaggctccaggagggacccgtgtccgcatccatccacatctgtccctgggctgggactggccaccttggctcaagctttggccagtgctctgccgcgtggtggaacctggctggctgctgccctttcacagcttagtgactccaggaaggggcgtagggggcagccccatttaggaaaatgtggtttcctgttacccgtgcagggaggggccaaagtgcctctctgacctatggatggagaggcatgtgggctgccttgaccttgacagggccaagatcagaggaggtgatgtgtgggtactaggagttaacctgggaaagtacctgagccttcccgccttggcctactccgcccaagaggcctgccgggagcaagcctgcccagtgtgacttgtctcacctctgtgttcccacgtgatagagtcactgccacaacatgaagacagaggcatgagatggaaacaccccgtggctctctctgaaccctccccagctggctccgaatttgggactgagccaggcggacgctccctttggggagaaacaccggctgacggggcatttggttccttccttcgcttatccagtgagccttgattaagccccttctgtatgccagccacaccgaaagaggggccaggaggctgagaatcgggtctgttggaggtggctggggggtagggtgggagggcagcatccatctcaggtgggccaagatgcccaggctctcctggctgtcagtgggcgtgtgacccctcggaggaagggtccccaggctcctcctgccttggggcatggacccgcccaccaagggcttcagggccagcccgggctcacgcagtgggttcacatgctccatgctgctcttggggacccacccaggcaccctctcagggcagggtgttgtcccctctgttcatggtggtgtcccggcgccttggcagagcccggcgtgtgatgattacctgagtatttctgacgaaggtgtgccagagccggccctcaagtggctccacgagggcggggggctgggggctcgtgccacatgcaaggttggcaaggggctgggtggaggtccctgcagggggtggggtttgtggactgatccccgtgttagggctgtgacaccgaattcccaagtccccgcctgcctccactccgtgcacggcccgctggtcagcacatctgccctccctgctagacgcactacgtgagaactggccaagctcccctcccaaccactctcccttccccacatcttgctggtttctccttgggccaggctgggtcttggggccagaacagatggtgacaccggggtggtccctcctccggaacctgtggggtgtgttgggcacaagtcagggaggcctgcaggtaatggaggcttggaaacgtcacactgtaccaggaggttgtgtgccatttctgggaatccccacccagcacacggagtgggaatcatgtccccaagaggaaagagcaggacccgtgagagaagatgacagaaggctacgccagatgggggggctgttggggaagtcactcggggaagtggtattggggtcaggactgaggctgagggacagcttaccctggagggtggaagagaagcttcctcgggagcagggccagcacatgcaaaagtcctggggcaggcccgaccctcggcaaatctgaatattttctggacatttgaggacctaaaagcaggtctctgtggcttaagcccaaaaagcaaagatgaggggtggtgtggagggtgctgaggctgggagtgggtgggtgggggcctcgggagggagcttcaagctgggaagttggattcattgccagcccggtgaggagttctaagcgggaaagcaacaagttctggcttgtgctttacaagcagccttggacctcagcttggagccggacgggagggtgtgccaggagctgggaggccggttaagaacatggggatggggctggggcagctgagagaccagcagagtggatggatctgggatcttggaagaaagaaccccagatgtgtagggggtgaagggcccccgcccaaatgtggctggcactgctcccctctgctgtaaaggagccagccggccgcccagagagggctggggggtagctccctcagccctggagacgtgtcccccacagccctgggtcaggggccctgcagctcctgccacctccttcctgctgctctgaactggagccccaggccgggctggaccctgcccctaattctgacccagaagcctccccaaggccctaggcagaggccacctgcctcccttctgaccccgcctttgctcagctccgggactgagcacttggtaccttgcagcctgtcctgagccctggggaggcaccggcttcagctaacgctctgcctggccatgtcagcgggtcggggacctccgtccgcggagaaaagtagccgtgccagggccagacgcttctccccagaacggaggcggggcggggagggggagctctggagggaaccagcctgatgagactgggcagcccgcagggacaggcccagtgccccccaccccagcctccacggggagggtcttctccaggccagctcagctgccctggggggctctcgggagtccaggatgctgaaggacactgaaaccatgcttggagaagggccgatcccagcgggccggggagcagggcagagctccagcacccacactgggcaagtggatcctggcccttggtaaattcgaatattttctctctggttagtaacagcgagtaacagcatccagcacccccagtgggagtggggctggtgagatgcaggtgcctgtctcttcccttttgggtaccgtgagcctgtggctgccgggcaggaaggtgtgctgacctttggcttctgggtttactgaccctagtccacccgcggctgctccctgcctgggcacggccccctgctgtttctgtacggctactcctggacattggctgggactggggcctgaggctgtcatactgcccttggccccagttttggagtcttaggtatggccctgtggccccaagtcatgtggtgaggtgtccaggacaggaaaggaagctactggggtcactcccaccctacccagaaagaaacttccaggcttagaagcctgccttcagccttgggctgctggccagacccccaagggttcctgcctcacgctggtggggtctggctgctggccctgcccaagaacctgggtgaattcatcagccacgttcctttgtctcaggaatatctcctgggactccagcaaacgctcttctcctgctgccattgccattttataaggtctcagcgtgtccgccccatggtcagtgtggtctgtgcagttgaagtcgaggctgactgatctggaccctcagccaccataggccacagccagccctcagccaccatgggccacagccagccctcagccaccataggccacagccaggcagccttctggggagagacagcacttaggtgaccctcagctgggttctgcaagccactgctgccccgtaaaccagcattgttccacctgaacttaaccgtgaccttggccctggggccacctgcctgagcctgtcaaggagacagggttgggctgggcaggggacaccacacagaggagggtggatgggctggggtggggagcgcctgggcagggtcttgtcagtggcccaggcctctgagaaggaccgaggacctgtgggcgttcacaggtgccagctctctgctctcatcggtctgttgctcttgttcttcatgcgtggagcctgtgccaggccctgggagggcagtgggggagaagcaagggcctcaggcttgcccttaggtgacccagcggtgttggttttaggaggaagaggcagggatggggcagaggaagcgggagagaggccgggtccccgtctctcctgtctttaagtggtagaagtgtcctgactgccagaggctgcctgcactccctggctcctggccccttccatcctcagtcttccagtctctccgacctctgacctctgaccctgcctcctccctctgcctggatgctctttcccagggtctgtggcctcgctgtgttccctccaggccttgactcagaactcaccttctcccgaggctttcccagagcagccctgtgtccagcctgccccgtgctcttctcaggccccctggccagcttgagctgtgggctgtccccgctggcccagggcctttgctctgctgccgacgcgtcccagaacctcacccagcacatggaggcgctgggtgggtgtggtgggctggccaggtgtggtcagcgtcctttccgcaggtgtcctcagcgtggcggtgcttggtgaaatggcttttgtgttctgtgttgcactgttatgaagcatagtgaggaaattcacacccttgcttcacccacctcttgccccagtcatgtaagaggagccccgttactagctcctgcccaggaggaagggctggatggggaccagttcatgtcctgctgtgagcgccccgcaccctggaggaaggtcaggtgctcaggtccgcttacggagcagagacccctctgctgtttctgagtcaggcacccctgccccagcatcccagagtcggggtcgcgtggacatgagcgatggtcacctggccgttctctcccccatagaggaggagctccggaagctgcgagaagaaaccaacgcggagatgctgcggcaggagctggaccgcgagcggcagcggcggatggagctggagcagaaggtgcaggaggtgctgaaggccaggtaccgcgccttcctcggggccctggcctgtgtgcggctgccccaaccccccaccccacccgccccgccgtcctctgctgcacccatagcgtcttggcagcatcattcttggccctggagaggcctgagtgtgagggtgggcccggctctgactgcccaggtataggtcctgcctgtgcctgcatgagctgtggtcttgggaatgtgtcatcttcctgtgcctctggcggtctggaaaagggtgcacaggtgctcctgccagcccccaggcctggggccaggccaactgaagagaggcttggcatggggcctgcagagccccagagccacctcatggctctgatcccggcctgctggtgaccccattctgtacatccacccagtgccccaccccgggggccagcccggcctcttaggatcttcccaggacctgccttcccagtgctgcctgtgcgtgttcccatgccccctgtctgccccagccacgctgtggcccccgcccccctgcccccatcctagcagtatcatgtcctgggcgccagtgccgccctggctcctagagaggcatgtctgcacctgacatctttgctcttgtttgtgggtcccatgtgggaccctgagtgctcacagtctcctccctcaccctgccctgcgcctcacagtgccgccagcaggaagcaggtcattcaggaccccagcgcaagttacaaagccagtgccctcctgtctcgctaacaccacgaggctccgtgtccctctgcacaagttcaaactggtgcctggtacatgaggccagggagctcaggccactcacctctggctcccaggcctcccgctcagcctccactccagcaacctcctgcttcggcctccctctcagcctccactccagcagcctcctgcttcggcctccctctcagcctccactccctcagcctcccccctcagtctccaccctcagtttctgcccagcctccccccagcatcatcttcagcctccgtcctcagactccactccctcagcctccccactcaggttccactcagcctccctccagcctccacttagcctccctccaggtctcccacctcagcctcccaccaccattggccacacctttgtctgtggcccccatgacctgcatggatggctgtcaccagttagggaggcacacggcatctctgggacaccccagctgagcactgcctgctatgagcgctccgggggccgtgtgtcattgtcaggactccaagtgtcgctgcttagctggccctgaggaagcggctcccttcagcaccctcaggtttagtgtgtgggaagacgggggatccgctgggctgactcccacttcttccttgcccgcctcctgcaggtcagcatgaccttgtggagtgccctggggggctcatgtgggggctcatgtgggggcatccagctggtgtgggggagggagaggcctcactttcctattccgccctggcagaacctcccagaccagaaatgggtgcatgggcctcggcaggcgctttacctgatgctgaaccttctgggaaaatccacagaagctcaaagcttaaattacatttaattatgtagagttgcaacagagacctgacctgccacgctgggagatcccagggacaggtgcggtccccaggcatttggccacagtgccatccccgccacgggacgctgcttctcccccggtggctaaggtggcctgaggctgtccccgtggccctgctccctgtgttctgtttcccatcctctcactcccgccagccccactccaggatctggtcctcatcttttaccaaagccccttggtggcaggtgtgcccagcccgggtcagctgtaagaacgcagggagccccatctcgcacagtctctgccttgggaatgggtggggaatgggcagtgaaggaacatccaggctgtgacccaggaagtggaagctgaaggtcctgggagcattaagggctctcccctgctttacatgggggcggcgcttaggaaccttctggaagcctgaaggaggaggggtgaaggaagagcagtcccaggcagagtgacctcctctttccttgtcgtcctggtgcagatctggggtgggtctgggtggctgtggtctgtccagggtgggtaggtgtgtgagggcacacacaaacatgcagacacatgtgcgcacacactgcacacacacataccacacactctgaagctgcaggattaaagcacagcagttctgtttatgcaaacctctattttggtttttaagaaaattctcagaaagtcaccttggtttaaggctacttgtcagtaggcagagattctctccattgtggatccaaagtcccctgaaaacctcactgtctgcttcctgcccgctgcttacctggccgtgccctgtgtgccctgtgctccgccctctgttctcttctcagggtttactcctcccccagcttcctccctccccactcccgcttcccaagagttaggaaggttaggggcgaccacacagcacttggcccggttctgtgctgcacctgctcacaggccttggctggaggggctgggtgtgggacggaagcagaccctagtggccgtctagtgcccctgcccagtccaggcaggtcgctggagtaggctgagctgggagctgggtacaggctgctgacaggtggcacccagcctgtggcctggcttggtgcctgataaacacatgtgtgttgatcagtatcttttcattagcagacgggttggtgatatgagagtattctgagtttaatgatgttgaaagaagcaagtgtgctaaaatgaataggaaaggaaagagtggtgaaagatgctggttgtttaaaaacaaaacgtgtgcctgttaggaaggcagctctgtgcttgcctggatacgctcggaaccagcatttcagcagtggagactctggagagagccctgctgtccctgacctctcctgtgcagtacacggtcgcgagagccctcgggggtgcctgactgggcatggagtttggaactaacagacctcttgtctcttctctccctgctttttaagaaccgaggagcagatggctcagcagcccccaaaagggcaggcccaggccagcaatggagcaggtacaccctggtgggcgggtggacaggcaggcgggcgggtgggtggctgcgcgtcacctgctggttctgtaggcccaggttaacaatggagcagataccccctcccccagcaggtgggcaggcggcaggtgctggttctgtgcccaggcacctgctggcatccgggaatctcctcccgtcagaactgggttagtgtctctgatgcgaagtggtgagtcatcatagtcgtcatcacaaatttccagtcactcaactaaagcgtgattgtgtgttctttggggaatacacacgtactctgtttcagccttgccccacggaacagtgatgtgagagccacgctggtcactgccgctgccctggtgcctccccgaaggggaccaagtgggcagtggggctatggttggctgtgagtggggagttgggggttcatgtgcccttttatctctctcctcgtcctccatccctgagtgcctgttctttatcttgccccacgccctgcaggcagccggcatagttccctgtacctgggggtcagcaaactccagcccccgcctggcttcacagatttaaatggtttcatttcatgacatgagaacgtaatataaacctgaaatttcagtccataaataaagtccatgggaacacagccgggccggttcacttacggctgggacgagtgtgccgatctcacctggaccctccccttaaaaactctgccaggctgccttgggggcgggaagaagccgcaggagcctgccctggccccatcctccctgcccgggtggccttggggtacacagacctcagcccccttggcctgtggctcttgagcctctgccctgagcctgcagccccctgggtatggtgaccacaggccctctggtcccagggcccaaaactttggcgaggcagcacccgctgcaggcggctcctcactggccttctgaagggagggactggcttgcacccctgagccccccttccgagggattcttccggtttcccgccgtggaggctgctttccagaggtgttcgcttttggtaaacattgctggtcatcagcacgacaacaccgtgcgctcaccctgggctggctgcgctcgccaggcacccccagcccaggacacagcctcccgctgcgccatccattggctgatgctcaggatatgcagggctggggcagtgacctctccatctgctttctgacaacccggaggtagaaagggggtttgatgcagacgtctgaggtgggccgagcagcctggatggacaggctgcccgctgacgagagcccagggcgggcagagagctggggacagggatgaaaagcagagagacccggcactgaggtcgtcatggctggggcagctctgctgtgtgccggttggtttgcacttggtgtcttcagaggactgagcccttcaaagtcccttgtacagggacccttcatttccctgacctacccccgagcattccttgtgcctctgctggccgcgcccttgcagtgaggcccctccctgccctgagatcccggagccgaccccagaacaggcagtgcagccctgccgtgccctcaccgggtccctgccccctgcagagcgccggagccaggggctgtcctcgcgcctgcagaagtggttctacgagcggtttggggagtacgtggaggacttccggttccagcccgaggagaacactgtggagacagaggaacccctgagcgcccgcaggtaggggttcgccgagctggggctgcctgtgcgttaggggccccggtccctgggctgaggctgcagcgggtgggccatcctttatcaccgtgggccaaagctgtctgtgaggctgccgagagctcctggaggctccgctgtgtctggtcttctgggggccgtgcctggcaggggcttgcgaggcccgcttaggtgcagcagagctgcatgcgcgcactgctctcagctgtggcttgtgacagttgtgtggggactcatggggctcagcccactgcctggggccttccttggctcttgagtcccatcagtaaaccttggttcccctgccaggtgctgccataggccctgggggtcccgagggagctaggtcagcaaaggccctgcccttgaggacttctgttctggggacacaggcaggagatgaggggacgatttcattggcgagtcgcccctgccttcctaacttggggagtggcactgagggccatcccggcgcaccctgctgtgctgagccgccgtgcatggccattctgtgcactcaaggggtcccaggctgttgagacgtcctccctggcccctgcagagccaacggaaccgggcagtggggactgcagagccggcgggtgcattaaccctgggctcccatctctccccttctctcttaggttaactgaaaatatgagacggctcagtgagtaccagcggctctgcgtggcgcccacgatgctcagtgtgggtggggcccatggcggtggggactctgggattctgagctgaaccgactctccagggagacgtggttaagcggcctcctacccacagtgctgaccactgtggtctgctctgtccccagagcgcggtgccaagccggtcactaactttgtgaagaacctctctgccttatccgactggtactccgtctacacgtctgccattgccttcaccgtgagtgggtcctccaggggccgagcagggtgggtgggatgtgcctgccagcattcaccacatgatcaggcaccttcccagggtgggaggtggcccccaggtggcacttcctcaggccccagggacatgctcatttctccttctgtaaagtgggctcactgatgccagtgcccagccatggggtggcttcaaggatcaaagatgttgggcgtggcccggggctagcctgcagggctccctggacagggatgtggtgcagccttgtcccccagggtgcccttgggaaaggcctcttggcactcaccgtgcagtgcggtggccacgctgctgaggtccacagagtacctggtgctggggccaggagtacctccaagggcatggcagcacgaggggcccagcccagcccctgtgagccatgagtcctgagggattggagggtgccagggcccacattgccagggccttggggaaaaggtgcccagccgtcctgcctggaactgccctgcagcggctgccccagcgggacaggagacttgccacctgtgtctcagtacttggtcctcggggggagccccctcacccaggatggagactgtgcctccagcacgaggaagatgcaggcagcccacctgcttgctagggcctccaggccagagaggaggcgtccacagcctggcactgtccagggctcccaaaggcagcactgccctgctgagcgggccccttgggagaggtccccagatgacctcagcctgggtcaggctctccaggaaagtccctgaagcctgtggccctgtgcctgctgcgggcacttaccactcacctgggacatgggcactttgttcactcacagatgaaggctgggtgctgggaccaccggcttcaccctggccctggaaggcctcttctcctgccaccctcacaaatgctttgcgacaggaggcctttgctgcctgggctcccacacgctcctgtgccatgtctgttgtcactaagagatgagcccaagctttgaacctgccttccaggcctcacctccatcccctgccctgtgcacatctgctctgcgtcccgggctctgtgctgggcacagatggtgcctggcatgaaggtggccccgggcatgcacctggctcgccctcagcagtgcttgcctgcctcgcccagccaggctgagtcctggtgatgccccaagtctggtgcgtgggagccacaccggggcaggcaggacccgcatgtggaaccagccgccctcttctgtccccaggacacgcttctccctaggtgtctcctggcttccaccggcggctcttaaaccggggaagcagcccttcctccggcttccccatcagacgcaccctcatccctgagtgtctggagagccagcgggtggcctggtctccccactggggccgcctggtggggggaggcgggagggatgtgccttgtcctgatccaagctgtcaggaggtctgacgccctgtctctcacccgcaggtgtacatgaatgccgtgtggcatggctgggccatcccattgttcttatttctagcaattctgaggttatccctcaattacctcatcgccaggtaggtgagccggtttgttgcagctgctttatcccaccgcatgtatggctgtgctgtctccctgcgtctcacaaccgtgaccccagctgggtatgtcatgcactgacgttttgggggtggtcccctgacaggctccagagaccccccaggcagggcggctgccccctccctggtttgctagagatggcagtgggaagttcccaaatcccccagcagctccttccccgggcggccagcagagccagggccgttccagcacctgcccgaacatcgcagggggcttctccccaacatcagtgggtaggtgggtgaagcaaacagggctccacgccccggaaggttcctgctggctgcctgttggagatgagcctgctggggaggagctggaccgggaatgagtaccagtcgcctgcagacagcacgcccgtgtgactgacgcgttaaccccaaccctggcctgagtcagggctctcgtgtcaccccttatgccccctctgagcaccccctccctgtggaggctgaggggggctctgggaagcccatgccctggggtggacccctagtccctgcactcctgggtccttcttagcctgcggttacccctggagtgaacctcagccttgcaccgaggctcagggaagagctgtgattctgtactttgacttggccgttcaaaagtttgcacttttatgcaccagtgtttccagatggttctctgtgcctgccccagttggctcatttgaaaatgttttttgtagaaatcacttaaatactctggaaggtgtcgttggtacccagagctaggtcaggatcagcttggacacttgctgatgccactttggatgttgaagggccgccctctcccacaccgctggccacttttaaatatgtcccctctgcccagaagggccccagaggaggggctggtgagggtgacaggagttgactgctctcacagcagggggttccggagggaccttttctccccattgggcagcatagaaggacctagaagggccccctccaagcccagctgggcgtgcagggccagcgattcgatgccttcccctgactcaggtggcgctgtcctaaaggtgtgtgtgttttctgttcgccagggggtggcggatacagtggagcatcgtgcccgaagtgtctgagcccgtggtaagtccctggagggtgcacggtctcctccgactgtctccatcacgtcaggcctcacagcctgtaggcaccgctcggggaagcctctggatgaggccatgtggtcatccccctggagtcctggcctggcctgaagaggaggggaggaggaggccagcccctccctagccccaaggcctgcgaggctgcaagcccggccccacattctagtccaggcttggctgtgcaagaagcagattgcctggccctggccaggcttcccagctaggatgtggtatggcaggggtgggggacattgaggggctgctgtagcccccacaacctccccaggtagggtggtgaacagtaggctggacaagtggacctgttcccatctgagattcaagagcccacctctcggaggttgcagtgagccgagatccctccactgcactccagcctgggcaacagagcaagactctgtctcaaaaaaacagaacaacgacaacaaaaaacccacctctggcccactgcctaactttgtaaataaagttttattggcacatagacacacccattcatttacatactgctgcggctgcttttgcattacccttgagtagacgacagaccacgtggccatggaagccaaaaatatttactgtctggccctttacagaagtctgctctagagggagaccccggcccatggggcaggaccactgggcgtgggcagaagggaggcctcggtgcctccacgggcctagttgggtatctcagtgcctgtttcttgcatggagcaccaggggtcagggcaagtacctggaggaggcaggctgttgcccgcccagcactgggacccaggagaccttgagaggctcttaacgaatgggagacaagcaggaccagggctcccattggctgggcctcagtttccctgcctgtaagtgagggagggcagctgtgaaggtgaactgtgaggcagagcctctgctcagccattgcaggggcggctctgccccactcctgttgtgcacccagagtgaggggcacggggtgagatgtcaccatcagcccataggggtgtcctcctggtgccaggtccccaagggatgtcccatcccccctggctgtgtggggacagcagagtccctggggctgggagggctccacactgttttgtcagtggtttttctgaactgttaaatttcagtggaaaattctctttccccttttactgaaggaacctccaaaggaagacctgactgtgtctgagaagttccagctggtgctggacgtcgcccagaaagcccaggtactgccacgggcgccggccaggggtgtgtctgcgccagccatgggcaccagccaggggtgtgtctacgccggccaggggtaggtctccgccggcctccgctgctgcctggggagggccgtgcctgacactgcaggcccggtttgtccgcggtcagctgacttgtagtcaccctgcccttggatggtcgttacagcaactctggtggttggggaaggggcctcctgattcagcctctgcggacggtgcgcgagggtggagctcccctccctccccaccgcccctggccagggttgaacgcccctgggaaggactcaggcccgggtctgctgttgctgtgagcgtggccacctctgccctagaccagagctgggccttccccggcctaggagcagccgggcaggaccacagggctccgagtgacctcagggctgcccgacctggaggccctcctggcgtcgcggtgtgactgacagcccaggagcgggggctgttgtaattgctgtttctccttcacacagaaccttttcgggaagatggctgacatcctggagaagatcaagaagtaagtcccgccccccaccccggccctgcggcgcccgcccggcctgagcctcccgtctccttccagcttgttcatgtgggtccagccggagatcacacagaagctgtatgtggcgctctgggctgccttcctggcctcctgcttcttcccctaccgcctggtggggcttgccgtgggtaagtagatgcacctgcggcctgtagcttcaggaggagggacacaggtgtccgcatgccaccagtgtctgccaggtgtctgcaagagctgttaaactcacctggcgatccttcctctgctttttgtcacaaatgtttcaatttgggagaagtgaagcccatccgagatcgagggacacggtgattgtttcttaaatcaagaagccctccacttccaaggcccccatgtctcctgcaaagtgggaggagctggaagacccaagacccaggatagcaggacttggggtgtcagggaattgccctgggcaggacatgcctcttggggcgcctgtgggcttaggggtgacagtcatggagagcctgagagcctggtttgatgtgcagggaggttggttgtagctgatgagtttggtgacatcacgtgaagccaagggtctcatccactaaaacactcatctgcagagctggcggcggggaaggagggtggctggcggtgaggaccgggctgtgccgggaggtgggtggggtgtggtggccccccctcaccccaggaggcgctcatccactgctgcccagcatgctctcttccctcctttctcttttcttttttcttgcttccctcctttatctttgtctttctccttttctttgtttttgtctctctctctctctttttttttttttggagacggagtgtcgctctgtcgcccaggctggagtgcagtggcgtgatctcggctcactgcaacctccgcctcccgggttcaagtgattctcctgcctcagcctcccaagtagctgggactacaggcacccgccaccacgcccagctaattttttttgtatttttagtagagacggggtttcaccttattggctaggctggtctggaactcctgacctcaggcgatctgcccacctcggcctcccaaagtgctgggattacaggcgggagccactgcgactggtctcttctgttttgttttgtcttgtcttgtttcttttcttttctttctcttttcctcaataacaacgatccagtgtctgacatgggccacacactggcatgtgggagcgaggccgccagggtcctgtccttgaggggcaggtgggactcgcctgagcccacgcaggacagcgtgtgcggctgtaggagccacaaagccaggggtggggagagctccgtgccggagtcgggaggtcagaccccggcccctcagcagtctaggcttggcgtgctgcgcagaggagcagtgggggctgtgtctgtgtggaagagcagatgccccctgccacgtttcctgaatgcctttaccataacgcaagcccgaccctagccctgacccagcgtaactgctggtgggaggacaggcctctctggacgcagcacggctgagctgtccaacagcagctcactgtggccatcaggtggcatcaccaggagtgggcagagccagatctgatcagacccttaccccgacaatgccctggagcccctctggctagcacccaggactctaggctcatgaatgggtaggtgaccactgtgacctcctgttggacccctaggcctgggtccaggtgccgaggctccagagctgcagtgcacttgcggccctggacagctccggggcaggccgccctccacggggagcctgggggtgtgcacctgggtcttggtgtcctgcatctgccctgctgtccttttttttcaagacagcgtctcagtctgtctcacccaggctggagtgcagtggcacgatctcggctcactgcaacctccatcccctgagtttaagtgattgtcctgcctcagcctcgggagtagctgggattacaggggtgcaccaccacactcagctaatttttgtatttttaatagagacgaggtttcaccatgttggccaggctggtattgaacccctgacatcatgatccgcccgctcggcctcccaaagtgctaggattccaggcgtgagccactgcgcccggcccctgctgtccttttttgtgacacccagtgtggtttgggttctcacaaccaccctgagatcaccactgccactgggcagcggtgaccctgccaggtgtgggccaagatggcattcctggcttatcggtgcccatgtattcttttgcagtgctgacaagggacctcagcttagaggggcagaggctgcctgctccaagcaaggatggccccagctgggacttgggctctcttgagctgagctgtccctcctgggtcggccaccacgtggaggaggcctgggagctcagtccagtcagccaagggggtggtcctggccctgcccctcctcacacctagcatctttcaagaatcaacaagttgtccggacacggtggctcacgcctgtaatcccagcactttggaaggccgaggcgggtgaatcacttgaggtcaggagttcgagaccagcccagccaacatggtgaaaccccgtctctaccaaaaatacaaaatgtagccgcgtgtggagcttgcagtgagctgagatcgcgccactgcactccagcctgggcgacagagcaagactctgtctcaaataaaaaaattaaaattaaaattaaaaaaaattagccaggcatggtggcaggcgcctgtagtcccagctactcagggggctgaagcaggagaatggcgtgaacccgggaggcggagctggcagtgagccaagatcatgttgctgcactcctgcctgggcgacagagcaagactccgtctcaaaaataaaataaaataaaataaaataaaataaaataaaaaatttagccgggtgtggtggtaggctcccagctactcgagaggctgaggcaggagaatcgcttgaacccgggaggttgcagtgagctgagatcaagccattgcactccagcctgggcaacagagcaagactctgtctcaaaaaaaagaatcaacaagttgagaattggggtcaaaaagtctgacttgattgatgaatttctgtgaaaatgtcctacaaaggcaaaaaatgaaacaaaggcacagctttatcagtccctttatagcacagatagtacatggaactctgaccctggggcccctgcagggagggcctgccacgtctggtctggtctggcgggctgtgcactgggggcagcgagacagcccccagcactgggaggggcacccggagagaccggaactcctgacagcttttgctgcccaggggggtgcgttagcaggtgtgtgggggccggccccgcctcccatccctgcatctgttgccaggtggggtcctggggcgcagtcaggcctggctcttctgaggtcgtgtttagtagggggactgaccatgattgtgtcaggtgacagtatcggggagaaaacggagctggtggaggggaacttgcgagggcgtggctgggagccgtctgagcagctggtcatgggcggcctctcagcagggatgggctgggcgtgggggggcacccagttgaagaagggcaggtgggagggggtttggggagggattgccatggagggacctcagatttggtgtcaggtgtggggaattggggcagaggaggcacagtcctgaagtgtttcaggtgggtcaagaacagccctgagccaggcggagttggagagagaagtgaggggcattggatgggggggtcctagcagagctgaggggtcttagtgggagtgggtggggcgctggcagtggggccctcgcctggggttgagactgtgcagcacgaatgggccccaggggagcgaggctgggggtatccagggtgaggactgagcgagcagctggactctcacatccaggctcagggtggagggtgccaatctgggaggtgggaggtgccggaaccatcaccctgagtagactggcatagctgcagagctctagatggagcaggctgtgtcccctgccctcaggactctatgctggtatcaagttcttcctcattgatttcatctttaaacgctgcccgaggctgcgcgccaagtacgacacgccctatatcatctggaggagtctccccaccgacccgcagctcaaggagcgctccagcgccgcagtctcacgcagggtgagcccggcccccagctgcggggatggggggatggggggccacgaagccgggcatccccaggcccacagtgctctgttcacctccggctcatttagaggctgtttcttcaattttatagactccttaaacttgagggttttttttttccctgttaccactgcggtttctgaggctcatccagcccctcccaagcccagggcaacacctggggactggccatgatgactgagagccagcaggcctgggagtgaccactccatgggggtgcccggcccctgccatccctgacagtgaggctctggcgctgagaccaggcagtttgagaagggcccccttggagccacagcctggcactgggccatatttcattcacagtcacaggccctccagatgtgcagcacagcatcccagccaggaccacggggaatgagcaggcctcggtgctcccttcggggtggctcagatgagtcaggagggttgctgggctctccccactgaggtgaggtggccctgcctggaagaaggagccgctctgggccggaagggacctcgggaacgtcttcccaaatttggatcccagcttttggggaggtgtgtgtgcggccagcacatctgggtgctgcaggcgtgggcagcgggcctgacctcgacgctgtttgccgttggcagctgcagacgacctcgtcacggagctacgtacccagcgcaccggccggcctgggtaaagaggaggacgccggtcgcttccacagcaccaagaagggcaatttccacgagatcttcaatctgacagaaaacgagcgtccgctggcgggtatgtgtgccgtgagtctgaggccaggccgagcgccgacacagactgaaggcccgtgaggggggcgctgtggatgcaggacggggtcgccctgtgacaggccagaggagccctcaggatggcattcacatcccactgccccaggaggagtgcaggagccaggggtcatgaggactctgcgggctacaggggaggagggcgtgcccgtggggagagccgcccacgctgcagcactcccctgacagcaggcgtgcaggcaacacactggggagagagtccagggcgaggcctcagggcctgcagggcgctggcagggggtctgcccctggttccatcgtgtctggagaaacaagagccaccaggggacaggtgactcaggatcctggggacaggtcagctttcccaaagggagggcctgttaaactaaaccgggcagctcgaggtgtgtgatgagcggctgcagaggcagctgcggagaacggagcttcgtcctctgctgagccctggccctgccggtcttggtggaggtggtgtcccagcgccctgaccctgccggtcttggaggtggtgtcccggccacactgtgacttctgttgctccctgctctgcctgggtgcttttactttaaaaaccctgccagtgcctgttgaagaggaaacatctgttttccaccctctggggccacctcactcttgccggcgcgccttcctctcactgtgggtgtgacgtgagcgcggtgggcggatgtcaggatctgagagtcaggctcctgggtcccagcgtcaggtcagaggctgggtacttccagtggaaagtgtgacaggcgggccttctcccattagtgtgcgagaatggctggcgctgctgcctcatcaacagggaccggaagatgcccacggactacatcaggaacggggtgctctacgtcacggagaagtgagtgcagccgtggggccctgtgtggctgcaggggagggggcgcaggaggctgcctaggccctgggatggcgtggctggcccagtgcaggttttcctgagtggtggccatggcctctcccatgctctgctcttgccggctgtctgggctcccagggaaaaggtgttgtctccaagccggacgtggcctgggctgtactgctgccatccctcaggctggcggggatgctgtcttctctggggcccaagcagttcatggagacgaggggcagagtctcccaaggaggggaccgtgtggggacctgctattgctgaggccctgagtccttgttgccctgagtgcctcatgcagagcagtggccgtgagtgtctcactcagagcagtggctgtgaatgtcttatgcagagcagtggccgtgagtgtctcactcagagcagtggccgtgagtgtctcagagcagtggccgtgtctcactcagagcagtggccgtgagtgtctcagagcagtggctgtgagtgtttcacacagagcagtggccgtgagtgtctcatatagagcagtggccgtgagtgtttcaccggttctgtgtctgctgggaagggagcaccactgtccatcccactgggggctgagaggcagccccgggagacccccacctggtgggagcgtgctctggttcaagagccaggcgacgcctctgtccgttccccttccagttacttgtgcttcgaaagctccaaatctgggtcctcaaagaggaacaaagtcatcaagctagtggacatcacggacatccagaaggttggtgcacctacccacccccactaacccccgtgttttcttcgtcacctgacagaggctggcgaggctttccctatagacttctgccagcctctgtcagcatctgggcgccgcggccacgctggccggccatggtccgtttccttgacttgagtccccatgtccctgtgggtctgcccctgccctggggtccacttgcctggaccgtgtgtctcaaagtggaggggctgggttggagcccaggaggtcaggacccaagccccactctggctgctgtgttcccctcgtatctgggaccctccccataaagaaaagcacaggggccctgagcccctgcctcggatgcaggttttcaggtgggagctcagatggtcgcgcccgctctgggcattttctcagcattttaccgtagcatggaatgagcaggtgggcgtggccacaagtgcctgtggtcccttgttttctggggcagggaaggctcagtgaggcactggcaggcacacttggcccgagtggtcagggcccccagctccctcccagctccgagcgtcctgggcatgtccgcattggcacggcgggcactcccggccccacggcagttgtgggtcatctctcccacccggctctggaaaaaagcgtgcagtcaggtgaccagaaggggtgagttcagggctggggtcctttccgcctgcctcttgggattggcggtgctgacagatggccctcctggtgccaggccctgagagcgagttctggggctgagtgcctaccgtcagcctcctcaggccggcttgtctctgaccttcctcaggccagctggccgacggtctgggctggggtgggacagaccctttacaggtctggtgtctcggccacaaagtgaggaggtgtccacaggcccttaccttctgttgtttggaagtcccaggtgcccgtgggccctgctgcctgtgtgcccagtggaggaggatgccctgggcctgtggagggctgtgcctccctgtccccaggagagacctgtggtgacggccacgctttgcctttcagtacaaggtcctgtctgtcctcccaggctcaggcatggggattgccgtgtcgacgccatccacccagaaagtaggtgccgggcggggggccgccaaggggttggtgtgggcccaggggcctgactctgagcaaccctgggaccagcgtggggcagacagccagagttttagtttgggcagcagggtcacaaagccgccccctccctcgcagcagctagagcctggggctgcgtccaggttgggttggaaatcttgctggggccatcgagtcaccggacagacagggatgttgggcacaggggtcccctgactcagtgacttgggaggagggaggcacggggctaaagcctggctcccctctgcctcttggctctgttcccctgaaggctggagcctggctccgggtggtggggagacacctgtcttttgcacccagacccacgtgactagcgtgctggcctggggctggtgttggacttcgtctcggtcctggtcctggcgccagcctggctgtgccatgctcactggtggcatttcttccctgccagccgctcgtgtttggtgccatggtgcacagggatgaggccttcgagaccattctcagccagtacatcaagatcacctcagcggcagcgtctggcggggacagctagtattgacttgcccaggacgttgctggaattttctttttctttttctttttctttttttttttttacgatttggtagtggaaacaattggacatcctcatgagcttttgcaataattctcctggacctgtggttctattgtgttgacctctgcgttttatcgaccaagaaggggccagggctcacagggacgggggtgcccctctcccacagggcacgtcaggtgcctctgagggccacccgcagactgggggagggggcagaggccctcgggggcccgtggagaagacacacaggacccctggccctgcccttctccgttccagcctggacagagaaacctctccagccaccccaagaggttctcgcaaccttgtgtcccgctctccagaggccagaagctcgtccaccaccaaagccatagctgaagagtgcggggcccttcctcctggggacagaaagatgtcgtcaaggagggacatgggggcctttcaccaaccaccgagaaacgggcctggcggccctccttcctcttacatgagaccctcctgtggcatttgcccttggtgccgggctggggccgggcgcagtgaccctgcctgcgctccacactcgctccacgggaacagagagggtgagaagggcccacccctcgcctgccctcagtgtctttggtggcaccttccttgctggcctccagggcgctcagcaccgcgtctgtaagggcctgcctgctgctctcggcctgacacgccggccaggaggtctgtagctggggaccagtaagggcacaggatggtgcaggtaaaagcacatctttctcacactttgctctttggaaggcccaggagaacatccgcgaaggctgttggaggtgctccgagcactgtggcatgtctggcacatggcccccaggctgcggttgcctgggttggttgggggaggaagtggggaggagtgttccgggaccatggtggcccaggctgcagccgcctttgggccatccgagaggctctggcagcccctgtgctttagggagcaaccgtgagccgagcccagaggcctgggcctgcactgcctgcagccgacatgcgacagcgttccctcccccgcgtgcctagccggtgccggtccgggcacagacccccccagcccccgccctgccccagggaagcctgggcttcccgggaacaaggtggcatttgtggagggagcgcccgcaggcctggtctgctggggccgcctgcgctgggctgaagggagggaaaggcggcttgggcctcctggaaggaggtggccaccccgcgggcctgcgtgtctgctggggcggatcccgcagctccctcagcttgtcctgagtcccttgggtgtcgttgagattgttgttttttgaagaaacagaagattctattttttacagcgagcaagctggttttcttatttttgtatcctttttcagatgtaatttttatctttgctccgatcctcatttgctggtgtgggtgagggatccggcggcatgggctggtttcacccccttcacgaggggccgcagagtcacacgctggtgccgggggtgctttggggggagctgcgccgatcaccagattaagcacatgtcctatcccaggcggtggagcggagcccccgtggctctggactgcgcggacgttggcgtcaggatgaccacacggcggcctttcccgaatggggacagaacccgctctgagccgtgggtctggctcctgtaggggactggctctcttggtgcaccaggggagggggacatatcccagtgaaccccaccttggcgcctgaggcaacacagggtgggcactgacccacccccaggggcggctgcagaggcagtgcccgcagacaatggccacacctctctccccagggcccggcagtgcccaaggatgggtccggggcctcggggccaatgagcgcctcttcctaggtgctgggattcagtccccaaacacagcgggaggggtccctggggcagatggggctttaccagcgtcgggtggtttagttcgagtcccttttgtggagaaagggagatgaaaactgaccacgtgccaggtgtggccgaagcccccagggagggccacattcggggagcggggggtcgggggagggccaccgactggctctgctgccagcacaggcccctccctggaagtcctcgggagcggagcgcggatcggcacgggctctgggctccccgtggagagaagctgtagtttttaccaaattgtgtacatctgggcagatgtttaatttctgtgactaatcactgaactagacgaatgttaaattttttatgtctgaagcctgagtctattttggatctgtaaataatcattgccagtgtgacttttgttcaacaaaaggattgtactgtattaagaaccgatgaaaaaaattctcctgtaacatttttttaagaaaactttgtttgtttaaagaaaaagtattgtataaattataatttttatttaaataaacctaaaatgctttgtgctaaggctca

SEQ ID NO: 1578 - DNA, 34650 bp, Homo sapiens
gaaggctatatttagcaggtttccggaagttgccggactggctgtgaggcggtcctgcctcgctgccttcagtccctagtgtctgggtccccgccctccagccgcctttgagtcgtgcctgggtcctcgcccttgcctcagaaccgcgaagaaaggaagctcgcgtgtttgctagaaaacctagttgggagtgcgaggcagagaacgttcagcacctttgttcctcccgaaccctcgggacagaggcagggttctgagggcagggattccccctcgtcttggccccaccgcccgggctgggcactaaactcgggccgcggcggggcgagcgaggcgggctccggagggagctgacgcctgatgatggcgcaggtagacacacctgccccttctcgggcggaaataaagtcttgttttgtgttcgttaaactttcgccgctaggcctcttatggcttccccggaggccactggtctgttttcagacgttcacgttccctctgccccgcaggtaacctataaccattttgtcttttagtccaacatgtttaccgtggctgatgtgttgagtcaagatgaactgcgcaaaaagctataccagacgtttaaggatcggggtatactggatacactcaaggtatcggatttaggcgtatctgtgtcagcttttacaagtgtaacctgtaacaggtagttcaaattcaatcaaggtttaggttttaataatcgtatgatacatagattgtattggtgaattacatttttatattcccgaataactctgtatcctgaaacattacagtctcttgaaaatgtttgagaaaatgttgagtttgagtcgtcttaaaggagcatattcaaataattaattgaactgacaataagataggagaaggaaatatttgtataatgaacacagtaagattaggcttgttttataaatatggcttataggttcctaaattaataagtgggtttgtaatacatttggatgaaggacattgacaccatatagaaaatactagtgtactgcttaataatagtttgggaaatgaaaaattttatctttaaactatattgaaatgtatgaatgtttagtttgggcagaaaatacctattagtatgctttatatttggattaacagccaggagtaggattagctcaacgtgttttcattgaaatatgcatttcaaaagcatattttacgtttaaaatatgtagctatatcctgtgtatgtatccttttttaatttaaattatatggtgagcatttccctgtttccttaaaagttttttgaaatcttcattttcagtggcaacaggcttatctttggatatttttgtaatgtatatagcagtcccctgttgttgaatattttggttatattctccaacagtccacagaggtgtgatgaagtggcagaattttttcctatacttaatatcccaatcgtaagctgctgaaatgggcttctagggaagtgaagttatgagtctgcaagtggatctggctaaccacccgtttcatttggaagctggggaaagaaagctttttctagaacccactggactgcttgtctcacggggtaagacaaagtgtgcaggggaaggtttctaacttctggccatggatctagaaccattatggaaatagaaggaaggtttccaatgaatgtagctcatctgtgtatatctctaatgaaacagtcctgctgaaatttctttcccttgtgtttcttttttatttttgtttttattttatgctagacacaacttcgaaaccagctaattcatgagttgatgcaccctgtattgagtggagaactgcagcctcggtccatttcagtagaagggagctccctcttaataggcgcctctaactctttagtggcagatcacttacaaagatgtggctatgaatattcactttctgttttctttccagaaagtggtttggcaaaagaaaaggtaaagtctttccttttctgtttctgaagtttttattaacaggttcttcctctgctgacagtaaagtgctgtatgatagctaagtgctcctcgactaggtccatttctgtttcctctttgaattcacattgtacctgcacataatatatttgttatataacaagtgggtactaaatttgaaattaatttcttggcgtctcatttagtctcacataaaacagtgatgtatagaatctctaaatgtttcagacctataattgatctatctatcctctatcttgtctaataagactctgccaatctgctgaatgtctgctgtaagcttggcactgtgataggcacactgcagatgttttgtgtgttacggatgaggaaccagactctggagaggtgaatcaatttgcccaacatcaagtaacttttaagtgacaatgcagggtggtaaatctagatctctaacatgagctctttttttcctgcactagtttcttcagatgtttctctttgtaattagataagtgagaaatacgtaatttaaaaaatctgtaaagttctcaaatattaaaaacacttgttttttttttttactacttttctaattattttaactatatttcttcaccattactgttgaacattagtactactttattattttaaaggcagatacagcagactttccctgtggatatgtgcgtgtttttttttttttaatagactttattttttcagagcagttttgggttcacagcaaagttaagtgggaagtacagagaattcccatatacctgctgcccctacacactcatagcctcccccactgtcaacatcttgcatcaaggtggtacatttgctacaatctataagcctaccctgacatgtcattatcacccagaggccatagtttacagtgaaggttgcagtgagccgagatcatgccactgcactccagcctgggtgacagagcgagactgtctcaaaaataaaataaatttcactcttggtggtgttcatatgtttttactttctttgtgttttctgtaattatccaaaagtttcatattccaaagttttagtgacacaagcttagtacagtatttgaatgaaaacttaaataatttgcatttcttcataagcaaccaaattttatttgtcagcattaggaatttatttattaatttatgtttttgagacagagtcttgctctgttacccagtctggagtgcaatggcgcagtcttggctcactgcaacctctgcctcctgtgttcaagcaattctcctgcctcagcctcccaagtagctgggattacaggtgcccaccactacacctggctaacttttttatttttagtagagaggaggtttcaccatgttggccaggctggtctcgaatcctgaccccaggtgatctgcccacctcaatctcccaaagagctgggataacaagcatgagccctcgtgtctggcctggaattcatttttgatacatcattctctaactttctaatcactttatacttttacttattgtgtaatagtcaataatacaattatatagcaggaattaatcctattcatacaacttaacggtttctactaatgtaaaatgcccatgcagaatatttactttaaaggaaaaccaattgaaaacaaatatcagtgttctcagagcagacatagtgaatggtatatactgtagtagaaatatattttaatagctacccaaaatgtctgttaaacaatattttaagtacactttaattacggttttaaggacagtaaaaatctatttacatttttaaacaatgaatactttttaaaaaattgtaattgaatgacccaggaactcagtcatgtagtcattggttcatcagatatttcagtgtcatctgtaaggcattaaacatttaggcatatcatctttgatgtgaagtacttagaagttaattagatgataaagatattttatccttttgaccttgatatgtttatagtaatttatttaacagtgtaagaaagagcttgaaatttgctttattagcatagttataatcttatttaatctgaaggatgtttcttaatttcatattcagaaacatatcctaatttatcatttaaacactgatataaaaatatgtctacttagtaacctattttttcttaaggtatttactatgcaggatctattacaactcattaaaatcaaccctacttccagtctctacaaatcactggtaagatggcttagtttctgtaatctactttggtttgttaattataactgaatagctgaataaaagtgaaatattttcttttaacaggtttcaggatctgataaagaaaatcaaaaaggtaggagccgtcatctttgtagagaacagcaacagttttctatgtactttttcctctaaaagaatgaagcaaatttttagggagaagagtaaaatttaatttgatttaaattatttgatttctgcaggtcatttcccctatatttccatttttgtaataacttttagatattcaattaaaaaaactgtagacagtatcaaaggccctacagacaggctgaaagatactgtttgtaaaaatacccactgttgggaatatttctgcaaaaaaaaaaaaaaaaaactaataacttttaggccaagtgtctttgtatactaggtatccctctcaagtataattggtagggtattagatgtattaatatttccttaaagaatgagagttgtgttcagtaatgtgttatatatcttttgttcttaaatgtttatacaggccgggcgtggtggctcatgcctgtaatcccagcactttgggaggctgaggcgggtggatcacctgaggtcgggagttcgagatcagcctgaccaacctggagaaaccccgtttctactaaaaatacaaaaaaattagctaggcgtagtggcgcatgcttgtaatcacagctactcaggaggctgaggcaggagaatcgcttgaacccggaaggcagaggttgcggtgagctgagatcacgccattgcactcctgcctgggcaacaagagcaaaactccgtctcaaaaaaaaaaaaaatgtttatatagacctaataaattgccttaattttggccttgataatagccattcatagagtccataactactgtgggtttcaggccattggttagacttgatgatgggctttgtagcatgaacataagctggcaacttggctttgatgcatagttattctttaggtcttttaaaataatctgttagtaatagtccttttgtgttggtacacccttggattttgtctgttgcctgcactatcatccccacaaggacattcatttattcatccattcattcgccaattcatttagaacttaatcatttgaatacttattttctgccagccattaagtctgtgacttaatcgccaagtctcttggtagtaatgttagcagaatataaataaattggagcacaagatattctggactgcccgcaaactagaccatctctactgaagttcagtatggtaaatgatcctatattctgtactctaagtgtcgtccagtgtgactctctgtgattatggaaatgtctgtgtctatgctgtttaatgtggtagctgctatcctcatgtggcttttgagccttgaaatgtggctagtgtgactggataactgaatttttaatttacatttaattagctacacttgcatagtgactaccatattagcataattctgaggtatatagctagtatcttttgcttaactattacttcaaaaggaaatttgtggcttgaagggatattaagaaataatctatgggccaggcacggtggctcatgcttgtaatcccagcactttgggagggcaaacctggctgatcacttgaggtcaggggttcaagaccagcctggccaacatggtgaaaccccatctctactaaaaatacaaaaattagccaggcgtggtggtgagtgcctgtaatcccagctacttgggaggctgaggcaggagaatcgcttgaaccagagaggcgaaggttgcggtgagccaagatagcgccactgcactccagcctgggtgacagagctggactccatctcaaaaaaaaaaaaaaaatctatgtagttactatagatacattatccttaaaagtagtttttccatggccgggcgcagtggctcacgcctgtaatcccagcactttgggaggctgaggcgggcggatcacgaggtcgggagagcaagaccatcctggccaacatggtgaaaccccgtctctactaaaatacaaaaaaaagttagccaggcctggtggcgtgcacctgtagtcccagctatttgggaggctgaggcaggggaatcgcttgaacccaggaggcagaggttacagtgagccaagatcacgccactgcgctccagcctagcgacagagcaagactccgtctcaaaaaaaaaaaaatagtttttacacagtctctttaaatgcatctggttcagaaagacatctggccgacagcccttaccagcttcacctagcatcccagtaaaatttctggaagccagaaaaactatgagtagcagataggtcaggcatcctagtgccaaaatttggatagaactcttagctaacaaaatagctcctggtaagataaaatttttttaaaaattggtgtcttctaattaagtaacagaaaacatgtaggaagatattgtgtacttaaccgttgtctgtcccctgactcagacctatggtcttatcctaccatatctatgctcagggggtgctaagctgttgaatggccttggtacttttcctcctagattctagtcacccattcttcccactgctaattttcctttcagagataatgatatctgttatgcgtgtctgtgtgaagagaccaccaaacaggctttgtgtgaggaacaaggctgtttattcacttgggtgcaagtgggttgagtccgaaaagagagtcagtgaagggagataggagaggggcagctttatagggcttgagtaggcagtggaaagttacagttaaaggtggttatttattgttagcaggggagggggtcccaaggtgcatggtggagagatcttgggactcattgtccagaagaagaatgtcacaaggtcgattgatcagttggggcagggcagaacaagtcataatggtggaatgtcgtaaggttggtcagtcagttaaggcaggagctgtttcacttctgtggttttttagctggctcctgcaggccatctggacgtatatatgcaggttacgggggttacaatggctgagcttcggctcagaggcctgacaatatccagaaaatgatgtgcacaaaatttggatgagggaagaaaatttggacatcggccctttgctttttggaagtaaaaattcttatctgcaattggcaaaagaataagacatatacatcaatggggacagaattaggaagtccagaaatacatccacacaaatatagtcaattgattttttttttaacaaaggtgcaaaggcaattcaatagaggaaagatagtcttttcaacaagtggtgctgtaacagttggatattcatatgcgcaaaaatgaacctagacacagatcttatttattataccttacacaaaaactaactcaaaatgaaccatagacctaaatgtaaaatgcaaaactataaaacttccagatgagaacagtagaaagtctgtgatcttgggtttcgtgatgagatgtaacaccaagagcaagatacatgaaagaaaaaagtagatcagttagactttattaaaattaaaaacatctctgtgaaagacactgttctttttgttttgtttttgagacggagtttcactctgccacccaggctggagtgcagtggcgtgacctcggctcactgcagcctctgcctcctgggttcaagtgattctcctgtctcagcctcctgagtagctggaactacaggcgcctgccaccacgcctggctaatttttttgtgttttcaatagagatggggttcaccatgttgatcaggctggtctcgatcccctgacctcaggtgatcgcctgcctcagcctcccagagtgctgggatgacaagcgtgagccactgtaccctgccaaaagacgctgttaagagaatgaaagacccagtgtcgaaacccatagagctttacgtcatcaagagtgaaccttaatgtttgcaaatttaggtcaggtgatcccaggatggtatgcagactgtgacaaaatctaatccccttcctgaagggagtgggggtgggggaaaaggtgctgagctaactactgtttttagttccaagaaactaaacatttcttaagtaatttatgcttgtggtttaaaacagtttcaaactattcagaaggatataaagtgaaagcaaagtagcagtttctgcccatgttctctaatctcacgctccactgataactagaattaacagtttcactccactgataactagaattaacagtttcttgtttatcttctagaattgtttgaggttaaaactatgtatttgtaattaaaacacaatcaattgggattatatcgtagatactgtatgcaatttgctttttttaatccaccaatgtatctttctgtagcagtatagactaattatttttaaataatgtatttaaccccctattgatggagatctggttgttttattgtttgctttttgccattacaggtaacctatgtgcagtgtgcaccctttgtgcccttgtgaaagtatacctgtgtaaattcatagaagtggaatgactagattaaagggcacatgcatttcgaatatatataagcactgacaaatttctcttccaagtgaatgagtatagctatatatccactcccttgccaacacttagcattatacaagttttaatcttagcagtgttatagggaaaataatggtttctctgttgtattaatttgcatttatgattttgttcatgtttattcagcatctaaaaattgtgttcatctttgacaatgtagttttttctgcaaactacccatgtttttccccatttttctgattttttttttttaaactgatttgtaagagttctttgatgttatgaaaatgtcatcactttagtcttggttatgcctccatattattgcaactatttttcccagtgtgttatttttttattttatgccatatgtaagttttcagtttttatgtagttagattgataaatatttctccttattccttccaggttctgtatcatgcttgggaaggccttttctcagatttattaaaagatatgactgggcacagtggctcatgcttgtgatcccagcactttgggaggcccaggcaggaggattgcttgaggccatgagtttgagactagcctgggcaacatagcaagaccctgtttatacaaaaagtaaaattagctgggcgtggtgggtggtggtgtgcacctctagtcccagctacttgggagactgatgtaggaggattgcttgagcccaggaggtcgaggccgcagtgagccatgattacaccactgcactccagcctgggtgacagagcaagacttttgtctctaaaaaaaaggaaagatatataatgtaaaaaatgataatgtcctaaaactaagattgtaaaaacagtgactgagcagtggttgaaagttctgaaacaaaactgtatgcatatgttttttaggttttcttatgcattttttaaaagaattggcagaatatcatcaagctaaagagagttgtaatatggaaactcagacaagttcgacatttaacagagattctctgggtaattatagccttctttcttaatttcagttctgctgttttcattttgaatgaaggaaattatctgatttaccatattgtgtgattgctccttgaactggagggatgcagccggcaggcaacaagggaattcatttctggaatcatcttgggggaccaggaagtgctctccagtgtcattccctagcctcatgaatgccagggctacactggccaaatcatgcagggattcaaaggcccatattcttccttgtttgttgagtttgacttctcttaactgggaggttcttcctcgtgtcttgtctaactttacagccacccagttagaagattataaactacttgctttgcaaagtactagagaagtcagtgacttatcacttcattttatagttgaggaaaccgaggtcctcagaggaagagcaacttggaaacactcagtctgcatcagaactaatagtggagtccaagttctcccatccatgatctggagctttttgtactatccagctggtctgcagtaccatcctgtctgtcagtttcgtgctcagtagagatgggaaatagctgtttaaaacgatatgcttaatggatttcttggcccttccttactcttaaatggtaacttgcaagaagataagttcataattcataaaatgtattatatgactatgcctttaagtgtatttttaattcaattagaaacatattacttgctaattatcaagcagtgctgttcagtggtgtgagccacatacataattttaaattttctagtagccacgttgaaaaaagtaaaaagaaacgggtgaaatttgttttaataatatatttaacccaatacatgcaaaatattatttcagcatatattcaatataaaaaatactaagatatttcacatttattttttgcactgtctttgaaatctcatgtgttttttacatttaaagcacatctcagttgagtctggtcacatttgaagtgtcaatggccccatgtggctggagagtcctgtgttggacagcatctggaaaatacagaaaagtagatggaaaaacatgtctaaagtcatccctaccagagataaacactatcgatgttttaatctacttctgccagcctttttcccctctgtgcatactttttgggtgggcgttatacacggttgagattgtactctgggttcagatttgcactttgctatgtggttgattctgatccatagttggtttgagggccatggactaagggaagagtcagtagacctcactttaatcctggttatgctgtcatgtagtcacttattaagctatatcagcatttgttctttatgtgtaaaggggaggggttgatatacgtgatctttgattcttttaaagttattgttttgaatatgtaagtcagctttaaccagagtccaataaagagctctctgccttagcacttagagagtaggaagagactccagtattttctgacttaaactgtactcttggctttctttttcctctaacatttcatgatgaacattttcaaacatacagaaaagttgaaacaattttagcgaacacttgtatacccaccacctagatgtcactattacacttgtgttatacttgcttcatcatttttatctgtccatccattcatccaccttcctttttttgtatttcaaagtaagttgcagataatccctacactttcccctaagtatcctctttacttttgaaccagaggtctggcgtcttacgcacctgacgatgtttctatgtcctaatttgatgtgttattttttaatagctgagaagcttcagcttattgatgatcagtttgcagatgcttaccctcagcgtatcaagttcgaatctttagaaataaagctaaatgagtataagagagaaatagaagagcaacttcgggcagaaatgtgtcaaaaggtaagctttatcttgttactgtaaacaagagtgatgtttttgtttgtcttctaaagtcttaaccataggtatatgggaaaatatctagaacttttaataacgaatgggatactgtactgttgtgcaaatttttttttatttctggtgacatttgtttatgccttttgagtgaatcctacaaatagagtgaatgagataaaactaacatgaaataaatatatttggacagagcattaatgttaaacctagatgtagagagagaacttgttcctgtttttatagtataatagttggtatttttaattttttgtgatcaatttgcagttgaagttttttaaagataccgagatagcaaaaattaaaatggaagcaaaaaaaaagtatgaaaaggagttaaccatgttccagaatgattttgaaaaagcttgtcaagcaaaatctgaagctctcgttcttcgggaaaagagtacccttgaaagaattcacaagcaccaagaggtggtatttacaaatattttatgggtggctatttcctgcagctattagtaggttggctcgagatccagcaacaggatggtacagttgatggaacaaggccccagaagagcaatagggactggggccaagagtgcaaatagaaggatggtccttgaaaaggatacacaaatttgcttcctctgagactgatggaaaggcgagaactgtggaggtgaacaatcaagttgggattatgagaaacacaccctaaataagctccatctcctcaggcagattagagggttagatcttgggttttaggagcagattggaggtgcagagtagttcctgtgggtaagggaagaacagccctttaaagcagagaggactgatcacctgtattgagggctcagctgtggttgggggagcctggaattgagagaggtcaaaccaggtgcttgtaagtgagttttctgttctagttctggggaggatttgtaagtatctctctgtccctttcagtgagggtggaaagatggagatgcttgggaagtagagcttttcagagccttatttgactagagaaaggcagcctacttaatcgaagattctggggctctcttgggtagtgaagggaagcagaggagagggcaggtggctgctaacctagggggaaaggaagggttgagtggcagtctcagtgatcaaggactcgatctggatagactggtaggtggaagaatgaggatggtccaagattacagaattgcaggatgaggtttcaggtggagactagaaaccaaatgcagtatgctgccattggagagagccatggaaatgagcaagggtgaaggtccctggggtaaaggagtcaccacaagggtcatccatgtgaccatttgatcttgtcaccccagaaagtaactggacaggagacagagagggtgaggagtgagagggagtccatgttggcaagcaggattggatctactcctttaaatcatattcctttcccaagggcgtgtcttagaccaaactagatttacagcactatttccaacatacatccagaactactgctgtcagatgttgaaagtaggaatgcttccccctagtgtccactctcgcctggggcttctcaataagacctagttgtttaatgctaagggcaccccctctaaaattttgtatagcatttctgggaattgggtttgcttcagctataaaaatgaatgtcagaagcacatatctttgagatgattggattgtgtttagactaataacttcaaccttcaagataggtgactgactagatccctgtttatttatctgatcatctgaaggctttgaagaagattgtcatcctcataagaagcaccatgtctttattccctcacctggactgtccatccccttctctccctgataaaaaccatagtgtctttcaagacccagcttggatgtcacctgggtgatgccgtccctgactcccactgagcgacccatttaggcctcattcctgcatcagtctttatgtacttcagttacaaaatcatcacatcttagtgtgattgtttctcactccctgactaaattgtgaggtctttagagatgaggactatatctgtctacctttttatatccagttcccagtatgctgcttgacatgtcataggtagttagtaaattctttctctgtgaacacacaaatggaaggatggcccattcttttaggagttcatatgagcttgctaactctgagtcagaatgacccgtgaactgaaacattcagacgacaccaccactaaaaaccatggggattcaattcttttggagttttactgctgaatgtacattttgcttaatttttctttctggggaacttgccaaaatttaggtaagggcgccaggtgtggtggctcatgcttgtagtcccagcaccttgggaagccaaggcaggcatatcgcttgagtccagaagttcgacaccagcctgggcagcatggcaaaaccccatctctacaaaaatacaaaaaatcagccggacttggtggcgtgtgcctgtagtgcctgcagctactcggtaggctggggtgggaggaccccttgagcttgggaggtggaggttgcagtgagccaagatcaccccactgcactccagcctgtgtgacagagtgagaccctgtctcaaaaaaaaaaaaaaaaaaatttttttagataagggactgagagatgttaaagaactaaatagcataaatttcacatggcatgttaggactgtagggtaatggtagtttaacagtcattgggggagtaaatttttatgcaactagaatacgcaaaaagtataccttgagtcggaatctcttgaaggtgaaattgttatcctaaatgtctgtactttgctttttggaatgtaggaagcagtatattcattcaaatctgttttgctttcattagcttgcttgctaaaaattaatgcttttctatacagattgaaacaaaagaaatttatgctcaaaggcaacttttactaaaagatatggatttgctaagaggaagagaagcagagctgaagcaaagagttgaagcttttgaattgtaagtaatgcatgttcattttggatattcagaatgatgagattaaaaagaattactaaatatatatctaaatattctaatgttcattgccaagtagagttcttatttgtaaaggggatatcacctagaaggtacaaattaagaggaacaaacactagggttttgtttttgaaatattaaacattaagatgaaaagacgaatgagatgctatcatcaggctacagtaagaccagacagattatttggagaagctgttaatactggaacagatcgtatgttttgcagttacattcagtccctcagatctgatagttccgtgtgtgtatgtatagtaactgaattccatatatccaggcctgcagcttttaccagctgtgtgctcagaaaaggaagtatggtggtccaacttgacttgtacttggtgaaaccatttctttgttactcactgtttctaagtgctcacaaatgtttcatccttgagatcttacctgggattgatggcaagttcacctgtctatagtttgtgcaataagccttctcttcctttgggaatctgctattgacacccatagatactccaggaatcttagttcattaaagaatttggctccattaatgtttttttctcacttctataggcttgatttgtttgatttcaactctctgtctaccttactctctttttggcaataatgaaaaggtaaattgatcaagagagaggaaataggcacaaaattggggcagagagagttcatcattcctttacctccattttctctactcttgttccctccttctcagcatataaactaaataaatgtagtttacctctccatggctttccagattaccagcagagggagctaatacctagagcctttacctgttcttagactagtcagcattttgtagcacttctcaggatggctggatctcaccacccatgaacctacctccctggctaaggagttggtgctatggttgatttaaagtctcactatgaagaccattctattcttcagtatttggaagccctgattgatccatctatcttttgccctctcttttggtacttttttcaatattcaatcaatagggttttttgtttgttttgttttgtttttaagacacagtgtctctctgtattgcccaggctggtctcaaacacttgggctcaagcaatcctcctgcctcagccttctgaaaagctgggattataggtgcgggccaccacacttggctaaagctgattggttattaaatgacaaaaacacatattgtaccttgaatatgtatggactaattaattaaatcccacagttagaaacagcattatagaagatttaagcacataagtacacttatttgttactttgtaactaataatatcattatttcatcccaggattgattttggctatttatcacctataaccattgtttgagtgtttattttcagtgagaaaccacttccctcttgagactctcccactcccctcagcccaaagcacagtcaattctgctagtttcaatatgctgtaactaggtcagttcataaaatacactgaggacttctggctctttccttctacttcccagtagtgatatcatgtagcagttttagtctgtggaactagacacatgtgattttttcctaaatttgttagctcagctatggtagtttatttactttttatatttttgttaatttcaggaaccagaagctccaggaagaaaaacataaaagcataactgaggcacttaggagacaggagcagaatataaagagttttgaggagacctatgaccgaaagctcaagaatgaacttctaaagtaattgtttagcatttttaaataactaatatgtttaaattaaattggtagaaacataacaaaaactgacaaagtagtctgtaacttaggcaaactttagtgtttgaaaaaaaaaaaacatagttttatcgatacagtcaatcctttcctgcatttgagttaggatagtttttaaaagataagggccgggtgtggtggctcatgcctataatcccagcactctgggaggctgaggtgggcggatcacctgaggtcaggagtgcaagaccagcctagccaacatggtgaaaccccatctctactaaaaatacaaaaattagctgggtgtggtggtgggcacttgtaatcccagctactggggaggctgaggcaggagaatcacttgaacccgggaggcagacgttgcagtgaactgaagttgtgctactgcactctactagcctgcgtgacagtgacaatccatctcaaaaattaacaacaataaaaaaatacagagaagcacatcctctgcgcttcttatggcttctctaacgtttattgtgggctgtgatttgctttaattttcaggacaccttgtgacttgcttagcttgcatagttgataagctgtaaaattggaattataaccacttttagttatcttttcctctacctcactcatacagtcagaaggatggggttatctgacaatatataaattatactagtggtcatagtatttgtcagtgaacatgtgccttgtattccttcaagattcagcaaagccagaatcaaaagagctaaaattaactatgtgaggcaaaaagtgatatagggaaaggaaaatatggacaactatggtaactttggcttttctgtagtctgagttttgtgtatcagtgaataatatctcagtgctacgacattatgcccatgtggtaacatttctcttcagtgtgtgggaaagcatctggcacataaaaagtgctcagttaatatttgttgtaaatgtgtcacgaggaaatgattcaactcaggtgctctgggcatttcttatttggcctcttttattgcctttctcataatttgtcatcgatattccattacataatattgcaaaggtttcttgaggtaatcctttaaacaaatcctatttttaaaaaatatggcagcttttttatctattgattttgaaatgatgtattttacccacatcttctatgtcagtttctatactaaaatagctaaaatggaagtgtctgtagttgctgaatttttaggaataaatgaattaaagtatgtgtgttaattttacatagttatggagctagtgaactatttggtgtcattgtgacagcttccacaggctgcatggtgtctgcctggctttgggaatcctcatatgactttggcaggtgttggagtttggaggctcttcgccacaggagtgcttctatttccttttggaaccaaaagggcagctggtaacagctgggaaagggaagtgaaactgtgaaaatgtgccttttggtattgctaatccggatataatgctcttggcagttggctctcaggactgtgcttagtccctgagcacaaaagttcttaccttggttgggggtgggcagatggtacaggtggattggaagtgaccgtctgattatcatttgggattgagtctgttgtgtgctgtgtaaatttaatttacccctttgctctttgtgtcagttgagaccaactgaaaagtgattgctttcagtaagtaaccttatgataacacgacgcttcattttgtgtgattgagttttgggacccagtttataggatcaaggaagggttttactgggcattttatgttcaggggttatatccctggctttagtattgaggactttgaagtttacaagttgtcatgtttagcaccctcaggtgctcctgtgccatagataagctcctgcactgataacagtctttccagaaaaatgcctgaggagctcatatttagtcattctgattctcaggtatcaacttgaactgaaggatgactacatcattagaactaatcgactgattgaagatgaaaggaagaataaaggtgatgtttggggggaaaataagctgtatttttcagttctgctgtaggttattagcttcccaagttgggtcttttctatattctaaaaaatacagcttacacttcattgttcatacaaaattacacattttttgtaattttaattttataaattaaaaatcatggtcttcactgccttttgaggaaccttcatgtttaatagtttgtatattcacaaaggccagtgatttatcatggatattttatccaactttatttcatatattttgataaatctgcaattgtcaggaacgtagcagcaacttattgctgtcaagtacgtattactcctaaccatgagagactttatttttcacttacggaaaacttttaacttctctgtcctctgtgacctagtttcttatttcttttgcttctaatatatttttatgctttataatatttttacttgatgtataaccttctgaactcttgtgtacattggcctgagactatggaagttgaataatttttcaatcttcagatgttttacatttcagtgtatttttttttttttttgagacggagtctcgctctgtcacctaggctggagtgcagtggtgcgatctcggctcactacaagctccacctcccaggttcacgccattcttccacctcagcctccccagtagctgggactacaggcacccaccaacacgcccggctaattttttgtatttttagtagaggcggggtctcagcgtgttagccaggatgatctcgatctcctgacctcgtgatccgcccgcctcggcctcccaaagtgctgggattacaggcgtgagccaccacgcccgacccatttcaatgtatttctaggaaattgctgtaacaagaagttgaagttttggtggaaatttcaagtagattcctgggaggaaaccagggttagatagttgatgttgaccagatacccaatgtgtggctactgtctttttttttttttttttttaagagacggagtcttgctctgttgcccaggctggagtacagtggcacaatctcagctcactgcaacctctgcctcctgggttcaagtgattcttgtgcctcagcctcccaagtagctgggactacaggtgtgcgccaccatgcctggctaatttttgtagagagagagtttcaccatgttggccaggctggtctcgaactcgtgacctcaggtggtccgcctgacttggcctcccaaagtgctgggattacaggcgtgagccactgtgcccagccccttttactatcttgtggagactaatacttcttttatgcattaataccattacgtatgtaacaaattatggtttgatgatatatctacatagacttgtgttagatgaagtgaaaactacaaaatagtaactacaatatagtaacagacagatctttgtcttcaaggaagttaagagctgtgggtattagggccctgtgctttgagcacatggtataactctggttagcatgtatagcaagtggaatttcaccacatatatgacagttacagcttcacatcacctgttgggtaacagggtttatttcttacttgcccgctacatctgctatttggattgtgaaatagtggtcattaggtctgacatactggccataaatattaaatggcttttgtattcactaggaaaacattatggtgtttaattggtgggctcttttttcagaaaaagctgttcatttgcaagaggagctcatagctattaattcaaaaaaggaggaactcaatcaatctgtaaatcgtgtgaaagaacttgaggtaattgttaagcatgttggtttttgaaatagattttaagcaatatatgaaattttagtcatacataatttatcctaagtcatcctgttgagatgtttggactgccatttatatggctaagaaggtgttagctgaagttaattcaatagttcttaatttcagtcagtgtcacataggaaagtgtagatagagctttgggtcctggagtcctgcccacatcctgtctgtgtctctaactgcttgtgtgtcgctaggtaagttctgtgactgcaggttcctgagctgtaaactaggatgttttccacattatagggttgttgagggaattcagtaagctaacttatgtgcctagttcatagcaggtggccattactattagtttctacatcagcctgttatctccttccatcagcagcaggtaaacaaaattcctgtcattacattgttatcttacagattaaaacaaaatgaggtacatttttcacatatcattgcttctttacttttctgttcattcgtgtgcttgctgtctgaaggatgaagctggaactttaggtacttacaacatattttgtatatgaaatttattttagcaactgtgacttatgtgagaactttgtaggctttttactcaaatatgagatatactaagaaaagggaagcacttcacaacattttacagaatcttttttcctttctttcccttttttttttttttttttttttgagacagagtcttgttctttcgcccaggctggagtgcagtggtgtgatcttggctcactgcaaccaacctccacctcccgggttcaagtgattctcatgtctcagctcccaagtagctgggatttcagccatgtgccaccacacccagctaattgttgtatttttagtagagatggggtttcaccatgttgcccagggtggtctcgaactcctgagctcaagcaatcctcttgcctcagcctcccaaagtgctgcgattacgggcgtgagccaccatgctcagccatttttatcttacctttcatatttaaaaaatatatattgctatgatgtgtgattattgttgggttcttggttgcctctggaaaatgggatgataatcttagaaggacttgcttcatgggatgcggcctataaaagttctgccccaactgtagggcggaagataattttcgttattgtagttagagtcttattgtagagaatcagacttctgtctagtgaccttaattaaattgtgacaccatgcttaaaggagcctgccagcttttacttttgcagtactgtaaagtcattattcaaatgtaaattttcctttttgaattttagcttgaattagagtctgtcaaagcccagtctttggcaataacaaaacaaaaccatatgctgaatgaaaaggttaaagagatgagtgattattcactactaaaagaagagaaactggagcttctggcacaaaataaattacttaaacaacaactggaagagagtagaaatgaaaacctgcgtctcctaaaccgtatgtatttttcttttcttctgacttgcgtgttttagtaattcgcattaggtcagtattataaaactatgctttgtacttgtataaggtagggggcttacattgggaagatttataaaattaagattcttggattaaactctgcaaacctgcctataggtggtatcaaagcttcccttgccctctgactgctgattgggtttggccagtggggacaccagcctctacatacagtggccctaggctggccactgtgcctcatggccaagtgaggccatagtgcctgcgattacctcttccaagtgctctgcaccaccaccctgtctctagtgctgagaatttctccctcctctgattccccaggcccaaggagcgctaacagtatggccctgttactagcccacccagggaactccaccatcctttgtgcataccctgaataagtcaacctttattaaagggttcttagatgaccttgaccgtgagagccatctgccttctgcctggatcccaactgctgctgtcagatgcccagatcatattggatcccagggctgtcatcaacaggtagaccagatagagagctccttctgtgcacagtagaggagagaaacaggctttcaggttaatttgagaatttgaaagagttcttttacttggagtaggactccaagggtaataaagtttgcattaacatgcactaaattcttttgttgtgaaatttgagagtcaggattgctctgagctcatttaatagaattattatcatatttattgagtcagtacaaagcaaagaacactttaaaacccctttaactgtttttgttaagttaaataagaaaacttaaggttggtaatgactaggattttttttttttttttaccttcttaggcctagctcagccggctcctgaacttgcagtctttcagaaagaactacggaaagccgaaaaggctatagtggttgagcatgaggagttcgaaagctgcaggcaagctctgcacaaacaactgcaagacgaagtgagtattgctcttcttcagttctagtgtgataccagtacacttcatagttacgtaaacttggcacaagtcacactagtgtaaatcagatttattttaacatcaaacattactcccccaaatatgctaaaggtatcctttctcatctgagaaaattctgcagtgataacgtgactttatattcgtaatagtaataaaatggagaagaaagcaaactcacctaaacataaaattttctgagtgcctgatggtgcccactgttatctctcgattctcaccctgataagtattacaaacattcactgtcttctgatttctgcctgcatgccctagagttctttgatatgactgaaaaagatggtgaagaacttgtttgtgtgttctgcttgtgtttttttttaatagggaccctgttgtttactgtcataaagcttcttggaattggcagaacaaaaagagtacaaacatgataagagaacttttccttttgaagcaagctgtgatttgttttacattgatttcttttcctattctgaatcttttcagattgagcattctgcacagctgaaggcccagattctaggttacaaagcttctgtaaagagtttaactactcaggttgccgatttaaaattgcaactgaagcaaactcagacaggttagagacgttttaacccataaatatttttgtatgtataaagcttctggtgtctgtgaaaatgtaatgatcataatttattgaatattaattattgttttaggggaaaagccatagaaatatgtgtcatcttagaagtaaaactccctatccattttggtaataccatctggatcatcagcaaaagtattttgcttcataggtgcctcatggcttgggagagtctcatgccccaataggaaaggcgtggtggtaacatagaagtccccatattcattataggatttccttttttatttgttaccccaatgttaacaccaattcagtagttttacggattccttgatagatatataaatatacaggacaagcagggtggtttagcaaaaagaatattgccttcagaatcagaactgttcttcttttggacccgttttgaagttgtttgaccttgggcatgttactttaacttccttgggcctcagtctcctcatttgtaatggggataataatacctactgagccatgatgaaaaagatgaaatgggtttcagtccagtgcctgggacataaaagacactcaggaaatggttattggtatcattttattattgtgtcttcactgtggatgcatctctgccccttcctacttcgtaagaaggatattaaagttcagatactttattcttcagttgctttcaagttcaaagaaagtacgtatgtgttaccagttcaactgggtctgagccttccttgttcccacctgcattgtttcctcatcagctccttgctctcttctaccagcacttgttttatttttatctctactcgtttctgcttttttctgttcctcattttctttcagttctgtttgtgaaacttctcacagctgaaatcatagcagtctcctatcaataaaaaatagttgaatgaggatagaactctttcgcatgcatgtgttgccgagggcaagcttctttcttgtagcatcacggggaggcattgcaggagagaggggcaggtgcactggctttgcattaggaaagcccagtagctcttagacttgctaaccgtgtgacccagcctcagtaagctttagtccccccatctgtaaaatgggagcagtgagagtttcttgaccacagtgttgttgtgaatgcaggtcctcacttccttatatgaaactcgggccatatgctgtggatttcgcaatagccctgggagttctgaacagcatcctatagtaaagcacattaattattttgcagtcaactgtatgaatattcatgctgggataaataaagattataaatgggtttacatcagttcaggtcaaacttttcaaccaaatgagttcaagtctggttgggctttgccaccaaataaattatgaataaattttcagttctcagagccttgtggctttcaaaattgtgcataatggattctgaaattatatcatgttacaaaagacatacaaagctgtagctggtacaataagctctcagtaaatgttagtggttatcgttaccatggcttcagaaactgtatagtgcaagtttgtccttattactctcttccatttttcaaaaaaataatattctcaagtatattttcttctctgccttgtccacttacttctgaaattggctttttgtaccctgcagccctagagaatgaagtgtactgcaatccaaagcagtctgtgatcgatcgttctgtcaatggattaataaatggcaatgtggtgccttgcaatggtgagataagtggggatttcttgaacaatccttttaaacaggaaaacgttctagcacgtatggttgcatcaaggatcacaaattatccaactgcatgggtggagggtagttcccctgattctgaccttgagtttgtagccaatactaaggcaagggtcaaagagcttcagcaagaggccgaacgcttggaaaaggctttcagaagttaccatcggagagtcattaaaaactctgccaaaagcccactagcagcaaagagcccaccatctctgcacttgctggaagccttcaaaaacattacttccagttccccggaaagacatatttttggagaggacagagttgtctctgagcagcctcaagtgggcacacttgaagaaaggaatgacgtcgtggaagcactgacaggcagtgcagcctcgaggctccgcgggggcacttcctccagacgcctctcttccacaccccttccaaaagcaaaaagaagcctcgaaagtgaaatgtatctggaaggtaagccacccgcacaaagggttgcggggtgctctggagttgggtagccaccctgcccacgacacagggttgccgtgagggtcagcgggccagagtggcaaggtctagtgtttggcacacagagctgtttagagagtgatagttgccttgcctttgctgcctgttggtttcctgcattttattattgccactgcaatttaatttaggtgcttgaatcattagttttctggatcttatgcatcataattggctatttgtgaggataacagtttattttcaaactagtagagctctttagaaaccacgttggtatcttctccgtgcaattggtaatattcttgccttggttctttctgcaccttaggtctgggcagatcacacattgcttcccccagtccttgtcctgacagaatgcccctaccatcacccactgagtctaggcacagcctctccatccctcctgtctccagccctccggagcagaaagtggggtaagtataacgttctgattgattagcttcagctgaataatgttacttgctctgtcagccttcacttgttttactgggattttttttttttgagataattattatagatcatgtggcagtatagaatttgcaatcagattgcaaaatgatatgtcatctttgagaatcatctaaattacctggagggaaaaagattgcttttagcaaataagtggataatgcttatttgctaaacttgatatatggaccatgcaatctggtattaataagcatcttcctagttctgtgaatagatttggtttattaagataaaaaacaaatgtacaaaatctgaaagcaaacaaatggaggttatttataaagttggaacaattttacacatcattaaaaagtcatttttaaaatattttggcattgaaatataaacagataaggttctgacctgcatatcattgaaataaattcaaacgtggtagcaggctctggtgtatgattgttgaaacaggaaggagtggatgtttttagaaactagtccactgggtcagccaggctatgatttgagtcatgagcagactcctacccatacctgggccccacagcagagggaactgactccttagctccaggctcgatctcgggcatctgcatgttaatgtagttctctgccacatgggcctgtcgtagtcctaaagctttttttttttttttttttttttgtgataagccaaaaggaaggataagacacacacatatgctgagttagggcgctttgctcactcaaggttgtggtgttgcatcttcatctggttcatgctgatagtgtgcagaattttttttcagaaatgttttatggttatttcctaggaatagcattcagagtacaacattattctttattaacaactgtagtacctacttcacagcatgaaatagttacaaggagtaactgattaaacaggtattaattgctgagaacaatgcctagtggtggtggtgaggtggagctatttacaagacaaagagaaagggaattttgtagagccttttcttgagtcacaaaaggctttttgtcaccttgtactctttggttttccattattgaaacttcacgagttttatccttccaatctagtctttatcgaagacaaactgaacttcaagacaaaagtgaattttcagatgtggacaagctagcttttaaggataatgaggagtttgaatcatcttttgaatgtaagttcaaatataaataccagtttttatatgttgaaaatctagaaagcttagttttggtgaaacgtatccattggtttaaaaagaaaagcagttacaaattgggtcattattattttgtgatacaaccacaagtacagatgtatcacctcatttttctaccatgatgattttcatgtgtgtgtttactttttaaaaatttcagtatgactaataatttcagagtttgagctaagcttataaatgaattattaacttatcagattttaaataagtgatttttatttattttttcctttgatggaatacaagaatgtttatttttatttttttgagatggagtctctctctgttgcccaggctggagtacagtggtccgatcttggctcactgcaatctccctcctcctcccaggtccaagtgattcatctgcctcagcctcccgagtagctgggaccaaccacaggtgcatgccatcacacccagctagtttttttgtatttttagtagagatggggtttcaccatattggccaggctggtcttgagctcctgacctcaagtgatccgcctgcatcggcctcccaaaatgctgggataacaggcatgagccactgcgcccggcctaaggatgttattttttaaatatactgattcagttgattgcctcagatttagaaaacctcatttttagtaaaagaatagagataaaagaatattaagagtccagaaactggtgtcctggctatggccctgccttagactgtcttactttgtagccactttgtaagtgtaaaataagcatgtagagcctatcatctctaaggttctttccagcttgagaaatctttatatttgcatataagctattggttagccttgtaaacttcatcttcaaatctgaaagtgttaatattttgaacagttaaatgagagggcttggtaaattttgtaaatatttgttaaagtctttgtgttaaatcattgatattttaatagaattcaaatgatgatcagcaagccaattgaattcttcactgtcactgggttgattttcctgttgggtaacgaatctcattttgtaaacaaagttaattctttcaactacgagaacactctgacaagcaaatacgttgccaagtggttatgttgggaacttcatagaatcctgttaggaaagggcgcacccagttactttggcttcagttcccgtgctccagtcagttgcccccacactgcactgcccttctttgtcttggtgttattattaaggactcatgggacaattgtgcctcatgcagctgcagggaacatgccaaggcagttggaaatgggcgggctttctcctgccggggatatgtctcatgtggacgctgctgcagctgctgtgcccctctcatatcagcacccaagtaagttctttttttgaactaacagtcagcagggtcgcatactaaataccagtccgtgtgctctgtgaattatttcatgtatcactgaagtcatcttgtaggtgtaaattagtcaaaatcttgggttgggggttataggtgtcattatattgttaatgacatttctgaagtaattcccatgtgaacatgtaaagacagtgctgagaaaggacacgttggaaggaaaggcttctcatttaggcttcccaggccagttgcttaaaaagtgttttcatttactcttcagtgcctggcatagtagttggacttttccccaagactcttctgcaaaaactgttccttgggaaccttaaagtttgggaaatcacagtgaaaaattgaaataataattaactcccagcatatatctttaatatgattgtaacatttaaatattatttatttttctatctacttgtttcctttgtgtcttaagaaattaggacagaaaaacttcgtatttcaatctttggaaaagctgtgacaccgagttagcgtagcactggaggaaaactggccatcagacttctcttctctggcccacttcctctttttcctcttctcctccagattacccacttccctccctgcgggtggagggagacgggaagagagccgtgggagctttgtgctttgttccagggctcagccaacagccaggtccttttcttcttggaccaagtgtttaatcctcaaatctgaaaggaattttctcaagtaaagccacctcttagtccctcccaaacgttggaaaaacatcatacccaaaacccctgttagcagtttcttggttttagtcatggtacccaggaacatataaaataactgaaagaggcaagagattttgagagggttgatgttgctgattccagagtaaatctgctttggaaagcattcagtgagacatgatctagagccttgtctctgctgggcactttgctcagcgctgagcatatagctcaagccctcgccttcctggatttctagcaggggaggcagatggtcagcaggccatcacccaggaccgcagcagggaggggctgcagcagctgagtaggggccgtggccacaagagggagtgtctacaggcactcatttggcacagacctgagcgagggaatacaaataatgtgataggataagggaaatcaactgagtaactaggtgttctgctgctgagatggaacatagattataatatttgctttaaaaattattaagcagcatggcgagtgacattttagttattgagaaattgttatatttgtcatttcatctcttcatctgggcacaaagggaattcaaaaaggttgaaatttggtgtctcggaggtgccccgtggacatgcttccttcctttccccttgtgtccaagagatttctgtataccaccctgcagctacaaaatatacaccagagtagagaagcagctcactcttcctctttattttgtaattggtgcttaaacaacattcctattttgagattactattccatataagaaagcaatcttgtttaggagtaactattttttcttctctagcaaggaggaagttgcatttctgcctgtggaaatgatcagctgtctcctctggtattttaatttcatgagaaggattcagaagagatgggggagagagagaagaaactgtgttgcttctctcctattagtaaaactcagttcctgctgatcactttagaacaaggcacagcaaaaaggttcaaagtcctctgctgaacctatgaatttttctacttattagcattgcttgggttgaaaaaaaaaatgtaggttatgggtcagagccagaagagaaaggtcagcataattgtctctgggattggggtctaattaaaacttttgagatatagggacctgtgccaagatgcagagggaacagacaagtaattaaagtatggaccttgcctggaaggaatagaagtggaagaaacaagtacatgtagtttttgacagatcaggtacaagatatcctgcaagtgagatgctggagtggttagttgtcacttcaggaataaggaggaggtggcatttcagttgggtcttgaatagcatttcagactttgtgagagcaagggagtgctacaggctgaggagacagtgaaggtgaatgtcaagcaaggaagatagagccacggccaggccccagtgagtgggttggtacagatgaaatatttctcgtacaaagttggtggtgatgtaggaaatcaatctgggaagaaaagggcaggttgtcagagcccagactaccatggcgtaggactcttatcagagcggagatgctgcacagcagatccacatcttcccctcaggaaatgcctggtgcagatgaccacaggttgttggaaggcagagactggcttcaggaagagccttgactgggctgtttcagtagtccagggagatggtgagaagggcccctgttgcagccacaggacagggagtgtgaacctgcaaacactggtggctgagtggatagagggtagaaagagcatgatcgaaggaccgggatgatcatgcctgggacgaagctagtgctgtggggtttccacatgcggatggcaaggaactatcagaaatgtggacgcgaggctagggagagagaccaggagtagaggaaaagatagggaaaggatccatatacaagtgatggctaaaaccccaggaagggctgccgtcagtttggaggaagtggggaatgaacagtgagatggctggaatggcggggggagggcagtggtgtgatttctgttctgttttgttggggtaggacagacttgagcatctttatgggagtaagacttctaaaactactgtgtacagaaatagggattaatggctcagtctgggtcctaaagataggggagggattataatcaaaggcagaggcagaaatgcagggtttgccttggaaaggagggaggagatctgtgaagaggatgagaacatgtgacatggaaggaggacagttggagttggttatggtgagggtgacgtatttgtctcagtcaagtgaagtagggtacagttcaaggagtggggtcgggagcttgaagtcggtgaaaatgaaatagtgacttgaagcaggtcacagagtcaactaaaagccaagcagagtctccgtgggtcttggcaagggctcctgcagactggtcctgcattcatttgaataatctgatactggaagctactctttattttctgtcctattaggtgtagatcagaaacaaattgaagaacaaaaggaagaagaaaaaatacgggaacagcaagtgaaagaacgaaggcagagagaagaaagaaggcagagtaacctacaagaagttttagaaagggaacgaagagaactagaaaaactgtatcaggaaagggtaataagtatgacttgattctctgaactggttgctccattgtacacctttcgtaagtacattgagctcagggaggggagtcaattggtgtacaaagtcagaggtgcggcagatgccttaaaaggcatccctgtcctctccttgtcttaaaagcagtgggaaaggctgcacagaatgtgaagcttaggagttttgtagtaaaggatagtttttgaaggtaatttttgtacattctcatctgatccttaaaacaagcctgtaaaaaaggtagactgtgctttgctgcagaactttgctttgaaaacagggtttaaagaagagactgtcagtgccagctagctgggactagaacccaagggaggagtggctgccagttcacagttgcttccaggggcacacactccctccctccttcctctatttctcttcttgccttctgtgtcccaattctagtcctagcagatggattactctgtccacttaacacacctgctaagtcttgcttgaattactctaacatatgaatgttccttggactcttggttaattcaagtccaaagcacaggacacttgccaattaataccttccttcattgagatgacatatttgtcttcctttgatgatagcaatgacttcaattttaaaaattagtcctctggcatacaggctgtacttgaaggatcgggattaatattagtgcatttttaaaacacttaaaagttttacaaatgtatttgtgtattttctgttttggtgcctgttttatagaagatgattgaagaatcactgaagattaaaataaaaaaggaattagaaatggaaaatgaattagaaatgagtaatcaagaaataaaagacaaatctgctcacagtgaaaatcctttagagaaatacatgaaaatcatccagcaggagcaagaccaggagtcggcagataaggtgccagtgccatgggcagggcaatctgtgggtgggggacatccagggcttccgtggcttaacttcttgggacgggaatccgtcttctccattgaagacaaaaaggtgaaaagtatagaaaatccaaagttcaaatggaaccttgagtcttttaaatatactattcttttgacaaaaattcatagcttttttgcttaaggtaaaagatttaagagattttaatttgtaaaagttggggtggctcattaagaaagaaaagatctatcaaatgcattaatactgacattaatattttatgtaagtctgaagtattatgggtgttaaatgcataccctatagtttattttgatgtgcttgctaaatttcatgtttaaaagtcacctcttttttagacttttaaattacatatatatttcaaaaatggttcttaaagtatttcatgaaattaatgcatatctaatttcaaaattttccaccctctccatgtaatcagagctcaaaaaagatggtccaagaaggctccctagtggacacgctgcaatctagtgacaaagtcgaaaggtacctgttttccctacacactttcatacacaaactgttaattgcttattttgtcagccaagagaaacagatgtttgagattgcctgtaagaagttattgaatcagtcaaaattagtgactataaaaacaattgagttttttgacttgtgaaattgatcctgatataaattgtaaactagggcagaaaccccccagggaaggaattgagaacattatgaagatagcaaataaacttgacacaaatttttacattttaatttttatctttccctaatttagtttaacaggcttttctcatgaagaactagacgactcttggtaaccatgtttgctgcccagcttctaacttacataccgtgagaagttacgtaacatttactcctttgtaaatgtttccctatcatcagacaaaactcaataaaaatgtgtgtaatccaatgtgggtttttttttccataattaattttgataccatagtgtgtgaaccaagaataatctagtcacgtgaaacctcttctccagtcatagtatttctcattcattataataaaagtaactggcttttaacctcctta

SEQ ID NO: 1579 - DNA, 15409 bp, Homo sapiens
cttaaaaaacaaagaacactttattcccttgacagtttctgtacagcgacaccaggctgtgcaaagcccagtgtcgtcttcactgagcacattccccaggacgcctggtgcagccctcctctgccccaggccccaactagccacccctgtgcccactagcaggccctgtgccttcacagggatgaagccctggcactgagaatgcctgggaggcaccgtttgctggggagcagagggactgacctttggcttctttgtggctggaggtgttccaggcctggtgagggggtcccatactgttctctgctgagccctctgcacactttgggggatcctggctggcggtggtaggtgggccggagactcagttgtccgtcagctggccatgtccccattttatggacaggcagcctgaggcccagaggcggaaggatttctccttgccacagctgcatcacacttgaactgtccagacctccaccgctggcctgtttgctccccaccctagtcccgcaggctgatatggtgcctccagcagactccatggcttcccggagggtgcagggtccccagttcaccctccagcaggagtggcagcagctggggtacccctagcagtggcatgtggagaagctggggtatgcagaggatccagttctgtgacaccaggaggcacaccaagttttcctctgtccctaacacagaccagaggggtggcccaccacccccccgggtggaggatgtgtggagttagaggtccctgggtggccccttggttggccatcagagacccccgggagccagcctgcagggcaggagcacaatgacgtggccaggatcccagaaaggggctggagtgtctgcctcagtttccaggataacggtgcaatggcctcagccaggccaggtgctggctgctgctgggaataatctctgagcttcgtgactctacagtgtgggcatgagggtccttatttcatagatgagaacactgaggcaagtgcagttctcggccaaaactacccagctgatcagcaaaattcagcccacgtctgatagactccacagctcgcagcatcccagcaggaagcagggcaatcgactcaggggccaatttatgtcccaggtttctgagaaggagccctggggaaggagggcggggtgagcgtcacaggctggagggctgcgccagggcaggccccgcaggggcggcgggcacagcctcgccctcgggcccggcctcctcgccgcgcgcgtaggtgagcaccaccgtgacggtggcgaaggtggcagcgttgacggggaaggcgcgcagcagcgtggacgccagcccccgtgtgaagacgcgccagccctcggcgcggtagctctggtgcacgcagtccaggatgccgcggtagcgcggggcgccccgcagtccgtccgcctgcagccgcgacttgaccacgtccacaggataggtagagagccaggacacgatgcctgacgtaccgcccgccaacagcagcttgggcaccagcaggcggtcgcccggctcgcagcccagcgcccgcgtgagagcgtcataggtgaggaagtagacgccgaagctgggcgtctcacgcagcaacgtggacaccatgccccggttgacgccacgcagaccctcgtgcccgtagatctgcgcgaggcagtccagcgagcccttgtaggtgcgcgctgggcccgcgtcctgcagctgcagccgcgtcttggccagctccatggggcagcagatgacgcactggatggcgcccgccgccgcacctgccaggaactggttgaggggcgagtcgtggcccagggcccggagggtgttgccctgcaccccgaacaccagcgcgttgatgaaggtgagccccatgagcggcgagcccaggcccttgtacaggcccagcacctgcggggacagagacgccatcagagccggcaacgcgcacctcccgggccctccacgcggaagggggtcgggggatggcagccccagcccaccccaggggctcctgaggaccaagcagaatttcgttagaacctaggtcctgactggcctcctggtcgtcctgacaccttccttcctggctctctggtctggggtggtggcagcccggaagctagttccccatcctgtgcctcccgagccccaccagcccaggccactcacgctctcttgcttgatgatggacttgaagcagtgcaacgtcccgcggtactgaggcttctccacgctctggacctgaagccgtacctggaaggagagggtccagtgagaggcaggcaggcaggaccagagcacccagctcccgggtctggtgcttaggctgcctaggagggtctcccaaggaggccgggcactcaggcacagtctaagacttttgtaattccagggcagggtgggccgggtatctatgccttctcaggatggggtgccagtaggcaaacagctaaagggacaggctgctggagacagggtagggggtccccaagatctcagaccaattcaggttaagcctcttgtttacactatggctgcacagtgcactgccagtggggcatgaacgacctcctgagactggcccgttctccaggtgatgcttgtcatactgctgagtgagcggcccatgtcccagactaggctgaagggcccctgccctaatgtcccatcagagactggcttcgaggcaataggcgcaaaaagtgatgagcctggccaggtgcagtggctcacgcctgtaatcccaacactttgggaggctgaggtgggtggatcacttgaggtcaggagttcaagaccagcctggccaacgtggcgaaatcgtgtctgtaaaaaaaattagcctagtgtggtggcatacgcctgtaatccctgctactcaggaggctgaggtgggagaattgcttgaacccgtgaggcagaggatgcagtgaggtcatgccactgcactccagcctgggcgagaaaggaacattccatctcaataaataaataaataaaaataaaagcaatgaccttggctccaggagctcctgcctggtctctgccagtagcctctcgtgagaacagcagttatgagttaatagagtggtggcaagagaacagccaacaacctccttggggacccacgtcagcagctctggggcctggggcgctggtcaggccccgctgcctccgagcccagtggcccagaacctcttccatgtcaaagtgctctttgttgcctatgagcttatctttgctcaataggaggctcagagttgcagagcgggcggtgggagtaaactaggtcaagtcacattctcaggggctggttccctaggtctgactcagaaatgatcattcttacagccagggccacagagcaagtgccttcggtactaggcagcatgggacaggggagggcttcacactcaattatctcggcattgggacaactgcccccatttccaagatgggaagacaggctcagagatgtttaacaacttggccaaagctgtcctctccagggacatgagcagctgtgttgctcagagtgagggtgggagggagtgctagcaagggagagccctcaccgggaacagccaggcttctgcccggattctggaaccttttccaattctctccaccagaataggtgggccctctattggtgaatgcacttataaaaaatgttttgttaggaaacaagtaccatctcagtacccccaggacctcaacagctggaagccaatgcttcaagattggcccgaagcaccctcccaccctggaggcccagttcttggccaacaccttgatgcgaggtttgctgctctcccttcaatgttctggggcctctggggggatctctgttcctcctgcagccccaacactggcactaagagggctgtgtgagtagaactgatgtgacatggagctgtcccttcccaggttggatactcagtgccacctgggtagtgttgtgaagtctttgcagatcacagacactggtgaatgcccaagtccagccggctggggaatgtcaggcttaggtcaactcagcttctcccaccaatgtgggcagaggcctctccccactttgtttctgacccctcagtacccctcagtctgtgacgagcccttgctctctgggagaggaactgtggcccagtgtcccaagtcttgtcatttatagctcaggctcttaaaatcttggggtgccaggctctcctttgaggattgatgggaacggacccacccctgggaaactagtcatttggacacaagtttaggaagctcccagctccccatagggccgagagacccccacatgaggacccccaatccagagggggctgattttttttggccagcccgagcccccaccccaggacctgtgctgagcccaagcttgcctcacaccctccctgtcccctgctacggagggaactctggggttggggagatgggcatgacagggtggggtccaggctgggatctggttcacctggtctgtacttactagcgctctccagggtgaggcttacgcccatctacaacaaagttacacttttgctatggatggagacagcccctagctcagaaagtaaaggcggttaaagcaacacaaaatttcaacatcacatccaggcgcggagcccccacagccagcccccacccacactccccatcccatgcccagggatggccggtcaccccctcatcataggtcaagacaactgctccctgattattgctgtgtccaaggaagcaggacagaaaactcccttcgtgtagaaacgtgtgaaggccgtgtgcttcaggacggtggctgtggttctgggcgctatagaggagatccagatcttggattctttcagtcccaagggcctgggggaataaactgtgactgtcccagccatgagatagtctgtggccatgtgacagtacggactgacacagactcgggtggcccctgatgatcctagggtacagctgcaattatattcaaccaggcaaaagggacccgtggtgttggaagtgaggacagtgggccaggcctgtcatcccagcactttgggaggccaaggcaggaggatcacttgagcccagtagtttgagaccagctgggcaacatatcaagaccccatctctactaataacttcaaaaaaaacatgagctaggcatggtggtgtgtgcctgtagtttcagctacttgagaggctgcggtgggaggattgcttgagcctgggaaatcaaggctgcagtgggctatgattgcaccactgcactccacctagggtgacagagcaagaccgtgtctcaaaaaaaaaggaggaagttaggccagtggaagcctcagaaggggagggaggagttgataggagcaggagggaagacttccagagggctggccatgttctgtttctcctgggtggcagctcgccacgcatgtgttttgcgacgacttgtacacctaggatgtgtgcactttccttcttttttcttttttgagacggagtctcattccgttgcccaggctggagtgcagtgacgcgatcttggctcactgcaagctccgcctcccggattcacgccattctcctgcctcagcctcccgagtagctgggactacaggcacccgccaccacgcccggctaattttttgtatgtttagtagagacagagtttcaccgtgttagccaggatggtcttgatctcctgaccttgtgatccgcccgcctcagcctccagaagtgctgggattacaggcatgagccactagcctggccaggatgtgtgcactttctatatgtgctggacctcaactaaaaacaaacagtagccaggcgtgctggcacgtgcctgtaatcccagctacccagggggttggggggggaaccgaggcaggagaatcacttgaacccaggaggaagaagttgcagtaagccaaggtcgcgccactgcactccaaactgagtgacagacacagactccatctcaaagaaaagaagttcagctttttaaggtaggtatgtccagatgtgatgctgctggagcgacagagtggcaaaaacaaaaacaaaacaaaacaaaaggatcacatatagatcttctcaaagaccaccctccagacgccagtgaagtagggtctggggagtaaaatctcatgggctggagaaactcctgtccctgagtcacttcaggggtgctgctcgcgggctcagtggctcaggacagcagagcaccagaacgaaagtgctcccaggcctgccaggggctgcctgagggggccgggcagaagcccagcaggtctggccaattcatagctcagagagcccaggcctccacggagctggaaagaggaagtgaatgtgaagcacttcttggctgcgagaggcgttcacaacacatgaccacgagacataaacacagtgcaacgtggacactgccaggctgtcctgggctgctctggcctgggggaggcttcacgggtggcctggctaggcagcgcgtgggcatggctggggccgggggctgtgtgggcaggctctgcacggcctcactctcggcaggccggtgcagcaaacgtggggccgctgcctgccaagaaagcctggcccttcagcctcctccccaaattggcctacagtggatagaagagttgtggttttcagagctagcatttaatccaacataaattatgctgttgagcactggcacgatgacaacgtttgagcccaaagatacagggacctgcccaaggtcatgcagaaaaccggctggcagaggggcccggacctgcacaaggcccagggacagagctttttaaggtcacagccaatgcaaaggccagaccctcactcttgtgctggatgcaatccaccccttatggtaagtcactgtctctgccaacacacacctaggctcaccagaaaaggagactggaagtctcccgcaaacccagctcagggtgcgcatcctgccttgccgtcagctgtgcctttgctcagtgggaagagcggccacgtgtagcgctgccagcaagcacaaggctggtctggtgcctgccactcacagcttgccctggggccaaggaaaaagagcaaggaagggccccgctgggctactttcagaacacacagcccaaccacaagcggagggtggggggtttattggggaatttccagctggagggcatagatttccttggtttccgttctgggggtctgagaacctggaactccggttcatggaggtgtggggtgttatcaaggaaccggctaacagggcccttcctcaggcctctggcacgtgggaaaccatcactggattctctgtaaggatgatcaccactccgtgaagatcatgttcatgggagatatgagttttggttttttttgtattttctctctgaacttttctttctttcaaggaactgtttgggagagttctgcatgggaacatgtgggtgcccttgctctgggtgggagaaaacctcagcacctcggttccagctggccaagcccaggatggacttggccatgaacccagcatgtggatcagccccagctgggagatgccaggacaaagcagtgaggaaggttcaacccggcctggtgtaaaagcagctgcccacctggggctgtacacggaaacaggcttccagccaccccaaccctgtgagcctctctccaatgtacgcgccgaggaaaaaaaagcagcgatgagactcaccttgaccgtgtcaaacgggtgtcccacaagcacgcctgccacacctggaggaggagagggggacttgtgacccacatacctcagaaacacagtgcagggtgctgggcaggagggggttctgacaaggaagactggcaggagctgctgccggggaaaggacattgaccaagcacctgtgggtgcagcaggcagatcccatgagcccctggaatcctcacgtccactgggagggtatgcatgtgacatcccaaggccaagccagcacctgtcccactcagcactggtgtcccatctgcaggctgctgctctccgcggctgactggtctgggtggctgacagcagaagttgtcccctgggaggctgcacacactatttctgggatatcccattaatccaaacacctgacatgggcaggaggctccagagatgttggactttggggtcagaccctccccagatttgaattttccccctgccgctcatcagcctggcgtgctcacaaatgactctgtctctgggcctcactctgggccttacctgtaaaggtttacctccctcccccagagtggccacggagactgaacagggtaatggccccttgggagtgacgaccccaggtcctgatgcactggctgatacctccgtccccttccctcagtgggagccaccttgagcccagggagacagcttgtgactgtgcggtcatccttggttcttcaggtcctgccaaaaatccagcccctcttgaaggacaaaggttcacccctccaaaatggctcacaaacacttctccagagtcctaaatgctgtgcaggtggtaaccatctctgagtcttgccaccactgtgagtaagcagcctcattacccatttcacaggagaaacaggctcagtgaggtcaggtaactgactctgactcccatgctcctctccctggagtttcacgtggacatctgttcaagctctccctttactgccagtagcgtttatgtataattaaaacagctggcatctgctgagtaacaaactaacattacgacccattctcactcttccacttgatgcctgtggaagttactatgcatctccacaaattgaactttgtatctttacctaacatcctatccatcctttaatactttggacctggccaggtgtggtggctcacgcctgtaatcccagcactttgggaggccaaggtgggcagatcacttgagatcaggagttcaaaaccagcctagccaacatggtgaaaccccgtctctactaaaaatacaaaaattagccaggtgtggtggcgggtgcctatagtcccagctactcaggaggctgaggtgggagaattgcttgaatccaggaggcagaagttgcagtgagctgagatcgcgctactgcactccagcgacccagagagcaagactccgtttcaaaaagaaaaaaaagtttggaccctaaaacccacttgatactcactttaactttgccagttctgctttctctttggttacatgtgactggtatggttttgtccaacttgtaattttggtgtttttgttttttgagacaagatctcactctgtcacccaaactggagtgcagtggcataatcttggctcactgcaacctccacctcctgggctcaatcgaccctcctgccttagcctcccaagtagctgagacaacaggcatgagccaccacacccagctaatttttgtaattttggcaggatgggtcttgccatgctgcccaggctttgttcaagaaaactcctgacttcaaaaaaagccaagcctcccaaagtgctgggattacagacatgagccactgtgcccaatgtgtagttttgaaccttttcttactatcttcttttagatgtttgttgtaaacaactgtatctggattttgttttctaacccagtctaaagcagtctgattttgctggaacaactgagggatctgacatttttatgccactttattttatgtaaatggtttattttactcctttttccatacttttgatggtttgggaaaattactatttattccctttcttttatttattttttattttttgagacagagtctcgctctgtcgcccaggctggagtgtagtgttgcggtctcggctcactgcaagctccacctcccgggttcatgccattctcctgcctcagcctcccgagtagctgggactacaggcgcccgccaccacacctggctaattttttgtatgtttagtagagacagagtttcaccatgttagccaggatggtgtcgatctcctgaccttgtggcccgcccactttggcctcccaaagtgctgggattacagactttagccaccacgcctggcctattccctttctttttttgagagtcttgctagtgccgttgcgcgatctgggctgactgcaacctctgcctcccaggttcaagtgattctcctgcctcagcaggactacaggcccaccccaccacacccagctaatttttgtatttttagtagagaaggggtttcgccatgttggccaggctggtctaaaactcatgacctcattgatccgcctgcctcggcctcccaaagtgctgggattacaggcgtgagccaccacgcccagctatttattccctttctaattgttaatttgtaatttcagcaaagggttacttcctgctttttatttttatttatttattttttgagacctaggctggagtgcagtggcacgatctcgactcactgcaagctctgcctcccaggttcacgccattctcctgcctcagcctcccgagtagatgggaatacaggtgcccgccaccacgcctggctaattttttgcatatttagtagagacggggtttcacctttgttagccaggatggtctcgatctcctgacctcgtgatccacccgcctcggccacccaaagtgctgggattacaggtgtgagccaccacgcccggcacttcctgcttctaatacgtctaatcattatatagaaacagggtaagcaccgcctcccccacgactctctgcctccttctgccccacccaccccagtaagagctacccgaagaaggctcccatccctgccaccttccattgacattttcctcattgagaccgtgagactcaatgcacaacgatgccctctccttcaatcttggggtctctactcatcaactgccatttcattagagcctttctttttttttttttgagacagagtctcactctgtcgcccaggctggaatgcaatggcacaatctcagttcactgaaacctccacctcccaggttcaagtgatttttgtgtttcagcctcccgaatagctggaattacaggctcccgccaccacacccggctaatttttgtatttttagtagaggcggggttttgccatgttggccaggctggtcttgaactcccgacctcaagtgagccacctgcctcggcctcccaaagtgctgggattacaggcttgagccaccaagctcggcccaaaatctatttctttctttttttttttttttttgagatagtcttgctctgtcacccaggccggagtgcaatggcgcgatctcggctcactgcaacctctgtctcccgggtttaagtgattctcctgcctcagcctcctgtgtagctgggactacaggtgcgtgccaccacacccagttaatttttatatttttagaaatggggtttcaccatgttggccaggagggtctcgatctcttgacctcgtgatccacccatctcagcctcccgaagtgctgggattacaggtgtaagccactgagcccggctcaaaatctatttcttaatctggttggggaacagtatgaatgctctggttgagaatcctgggcccaggccagccttggtcctctggctttcagtgctgcagatgagaaatctgctgccaatgttttttttttttttctcctttgtcaatggtttatttattctgtgggaggtcgctgagattttatctgtggatttcaagaatgtcaccaggagatgccaagggtgtgtctttttctttaaagtaaccctgcctggagctctaccaacactttcactgtgcagactcatgccctcttctgatcagggaaaatttccactattatttattcatcatattaatcatctccagacctgttccttcttcttccagagcctctaacattcacaggtgaatgaagaagcaaccaccaagcctatcttttctttcatgacttccatttgggtttctgattttctgggaggcctttgcatcctggaaacaggaaatccatcctcttttccacttcagctttttaattttctaaagctgaaaatcctcgttctagaacctcttttcttgggaagtatctggatttccctcggttttggaaactgaacacttgcccaggatgtgccactggactttacttctccctccagcagggggcccctcgaggcccctccatgtcccttgaagctaggtccagctgtggggtccccttcctgtgggtgcatggtcacgcctctggccccagacctgcccaggtgacagcaacagcagcaaggcgtgggagggagagagcagaaagacccttacgccacttgcctctgttgggaggccccactcccacaaggccccactcaagtctcccaggagaggcactggttcccactttctcttctgacttgtttcagcacccttcggcgaggggcttggtctccttcacccagaagaacccatcctcaggaacagtgtgggctgtggggccggcctccattggaggagcctcctcaccacctttctgagcgcacgaggaggcctccagtcacaccagcagaagcggaaccctgtctcccaactccaaagcctactgtctactgtcctccctaagctgggctccggaggcaatccccaaccagtagtcctcagggctgggcggggtggggaggaaccactgtcctggggatggctggtagcagaggtagtggaagaggcacccttccctcttggggttacctctcctcccgggttctcccacccctagctgagcttttctctctgcgcctgcttctgtccatccagagcccagtgtctatgtggcctcaagatttgggttgatcccccagtaggggagagggggaggcattccaaaccttccaccatgcaaggcctcaaggatgctgtcagtcaagatgctggccccgcctccctgagaagttaaaacacgtgacccacactaggcgaatagtagggggtggacagtccccctccccagccaccaaggagaagcactggcattatctgccctgagcctgtaggttgggggcaccccaagaaggagccaggcaggggctgctggggtacgggtcccaaggtggggtgcctctgggcaggctgtcagtgtgaccccagctgtgccagggacctggagcctgggacacagtcagttcactgtcctgaggggccaccccagcaccctggagtaagggggagaggagaggactgcaggctcaccctggccatcagaggagcatgtggtgtgactttgctttagtacccccacctctctgggcctaggtttctccgatgagaccaggagtgagcccccaggtgacttctgtccttgtccacctgggaggctcaggcttacgcttgtagagccttagctgggtggccattatgtgcctgggggttgcacgaaaagcagggcctgggggcaggggggtggcctgtgccccagtgctacagcaccagacagtgccagtccttgacccacaaacctggggcagggggcatggatatgatctctcccaggtgggcctatgaggatgggcagcgaaggacattccaggcaaggaggctgcgcgagcgacgtgcagaggagaccacagatgtgccgggaggcgccaagcaggcctgctttcaggtgaagtgttcctgccccaaaccccggtgtttccaggagggcagcacggacggtagcgccactgcagaaggaactctgcccatccggggaaagaatccccactccccaaagcctggaaggaggtgttggcctggggacagcccttcacccccacccgctggagctgatagtgggtggggagcaagggtggagcaaacagcgagatcagaagcgggaggggaaggtgagaatggaatccgcagaggacacgccccctctgtctccagggcacccagcgattagcagcaaattctgggctttgtgccccgcagcttcccactgggtaaccgaccgggaagttctaactcccctcagcgcacaacacctccccaacacactcccttttcaacgagtctctcccccaagaagcaggctccgacgccacagatttaatacttaaggccaccgctacccactcttccgccagggctctcagcgctggccgggagctgagggtttattcgagccaaatccaagtagatgaagaggcggtgaacaagggcaggtgctgggagaaaagtgggaccaaacagggataagcggccggccctctcagcaactcccgccgccaaccaccctcccccgcccccgacatctaaatcctggtgaataaattaaccctcaaggtaaaagcagagaagccagaggcccaacagggaagtgccgtgcccgacgcccacggtcggggcatgggagagcctggactgcacgcccgcccgggccctcccggggacaactgcatgggaggaaccccagagccgcgaccgcgcctcggagaaggtgccccacaccggctcgcccgacccacccaccaccccccttccgcccccaacagctcacaaaaccgcgtaggaaggggcggcgttccaaggcgtgactcggcgccagagtggttcagtgccctccaaggccagccgagtagggggtcggctccgtagccccaaccccgctggatggctgcgcgggacggggtggagtcagtcccgaaatatacggccgggggaggggaccctgctcccagtgcgcaacggatggggatgggggaggggaaggagatgagcccgggacctcggcgcggggggcagtggggcatcctcccggcagtcctggcctccgctcagccacggtgctgccccggcgccccagacctcccgtccgagcgtgcccagagagaataaagacacctgccctcgcggacagcccgggcctgaagtcaatttacgcccacgagacccgcccgaggcaagagaactgtggtccccattcacagacgcggcgacccccgccagcgggaagccgcgaggccagggcgtgctggtgggccgacctccctccccggacgcctcgccccggcccggcccggcccgccgcctccttaccccccgcgcatccagccaagaagtccagcgccatggccgggtccccggcgaggccgcctttcctcctcgtcctccccctgaggcccctcgccgggctgggcgccgtcggggtccccgagcgcgcggtgccggggctgggcctggccgctcctcctggcgcggagcccgggcaggcgcggtcagggatggtggggatggcggcagcagctagacccgcgctggtccctcggcggcagctgactcgctggatcccctccggcccgcggtccctcacctcgggccgcgcgccccgcccctcgtgcctgccggcagggcccgggtgggg

SEQ ID NO: 1580 - DNA, 43480 bp, Homo sapiens
gcacttccgccccgggcgcggctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccggtaggaccccggggcgggttcgcgcgtccgcggcgagactagagctctcctcagtcgggcaagagtcgcggggcggggctcacagcaggccgtgcctgtttggggacagggttctctgaggggtgcagtgctcagatcccgggggtatgtggcggggaatgcggggaccacgcagagcccgaggtgaagcttgtttggtggcgtcgtgtgcgcggccagcatttacgcaggatctggctgcgtccctaaaaaaagcgtgaatcgtgttttcgggattgagccagtcggccaggggagcgcggactgggcgccctaggtgagggcttgttctggagtgcacaggtgcgtgggagtgttgctagggcccgtgctgtgtccgtggtgagagtttgccctgtgttcccttggtgccttggtgagtggggtgttcattagggcttggacagtacccgcggtaagggttgcagtgcgtctgctgtgccccatgtgctgggctgggcgagcaggggcctggccaggtgttgctgggagcgtgctgtgcgtaagtggcctgtgtgcagagttcactgtgggcaagacagctcaactgtttgctttgaatggagtgagcgcggactctggggctagggagggcatgttgagtgagagcaggctctcggtgcctggggttagagaggtggtaagggcgcgccatgctttttgtgccttctgtgaacagtctccgtgttacctgagctcctattagtttgtaaatggctgcttttttggggggtgggtgggccatcgagtcttcttcctgttcccaaccaatatagatagtatctgattccattgcctaatggctttttgacattgttttccttcttttcattactttgagtcatatttgagagatgtgaaacaacctaaaaaacaatggtagccaaacctagtgagaaattagtatcctaacaaaggaaggcagataatgttaatcttgttttcccctgcagctcataagctaaagcttaaggcctatcccactaaatttattttgtatttcattgaatggaatcaatacttttaaaaatgcatgctaggccaggcgcagtggctcacgcctgtgatcccagcgctttgggaggcccaggcggggtgattgcctgtgcccaggagttcaagatcaacctgggcaacatggcaaaaccttgtctctacaaaaaaatacaaaaattagctgggcatggtggtttatgcccgtggtcccagctactctgggggccgaggtaggagattcacttgagcccaggaggtgaaggctgcagtgagctgtgatcatgccactgcactccagcctagatgacagagtgagaccctgtcaaaacaaaacaaacaaacaaaaaaaaaacccgctaagaaatacatgcttattgtgcgatacgaacagaatcaaaagacagctatttttaatattttggcatatttgtttctgccttcatgtgcgcgtcatgtgtatctatgtccaaattatatttaggatccaataacatgtatagtttctacgttgcatttttttccttaggagcattcattcaacgaatatgggtcttgtatgtctggtgctattacactggtaggcaataacaaaccattcctattttcttgatccttttttcactatttgtttacacacacattcatgcaggaagataagcagggactttgttttgctcaatgataagtgctcagtgccgggaacacagtagataaccaataaattatttgctaaaatgtattgggattggcagacattaaaatccaaaacataatagtgacaaataaattatgaaccaagggaagtgctctggaggcaagcagtataattttcagatataaatctgacagcatttaacaaatgattggagagagggaaggcttctctgctcatcaaacagactttggggcatctgtgcttgctgttccctcagcccaggaacattctcctcctgacctgctgcagaaacagtctcgctcttctgcaaactcagctggaatgttacaccctcagagaccttctctgatcaccccacctcgcgacccccccatctcaggttgaacacatacaacccagttcaagtccctcttcacttgtaatcacccttttaaaatgaccttttctgttctttgtctcaccctgtcagaatgcagggatcctgtctgtcttgtcgcacttgtggttccaaaagcccgatttgtttacctctgtatctgttaaataccagaaaattaaatatactatttggctggggcttagagcctaggaaaaagttcctcctgcctccaagaggaaggttctttaaagagctatgctcaggatggtctttctgcggtacctaaaaagctagggcagtggcagctgagagccagaaaggatctgtctcccctatttgttgactctgcagggcttccagtacttcagtcttgcatctcactgatcattaaaacgttcattttgaaggagggtaatgggagtagggagtagtggtgataagaagaaaacaaaaggacttttttttttttcttttaagattaatgtttagaataggcttagtgctagaagttcagcctggacagcataagcagacctcacctatacaaaacatgtaaaaaaaaaaaaaaaaaattagccaggtgtgatgttgcatgcctgtggtcctagctacttgggagactgaagggggaggatcactggagcccctcatggtcaaggctgcagtgagccctgatcatactccagcttggataacagagcaagagaccctgtctcaaaacaaaacaaaacacacacacatacacacacaaacaaacaaaaaaagaaacaaaataggaagctgaagaagataatgaaagcgatttgaaatagaggaacatagaattatgaaatgaatagggtgcaacatggaaaataacaaaactaagaatgaagagaaggaaaagcaaggttaagtttgaggttcataagggtaaatcaagacaggtatgaaacctagagaaagtaaaaatgagaagtcacgatgctaggcagagagaatacgtgaattaaaataaacattcaatttttggagcaactcactctcacaaggagaaggtttcgtaagcagacagtgctgtgcatgggagacctgccctctcaaaggtagttgccaaatggttccagatagttgaaggaaacatgtatcaaatttcaggccagtctcattcctccagaagaggagctgcttttttggacaaaacccgcaatctcctgttgtgcgtggtctcttctgcctattttaggtgttttccttatttccagtgaaagaagccaagatcagtaagcacttacacagtagcgtctcagtttccttactgggcatactacaatgcaaagagagcagtccatatctggtcacctgccaggataccagaagactgggagataggcagcacaagaaatggcctaatcttctttctccattgtgctgtagaatgattattttcaatatgaaattgattacaatatattcttcacattgttttgtgtttgacagcagtggattttgaataccaaattttttttgaatagctactctgagtgacatattgtgctgggtgttgtggccacatggatgaatggagttggccttgttaactattaaacacaaaagcatgtgatagttacctgagagatccatgcaggggagagtccaggggaaggtgactgatcactgcttcccagggggaggcagaaaatgcttcctggaggagatgatgggtggattaaggaagatgagttgagcaggagttgtagctaccagccagggaggaagggtattcagagcagaggaagcaaggtgagcaaaggcaccaagatgtgacactactggactgccaagctattcagtgtggcagagtagggcaaaggaggcaagaaagaaggaagaggattaaatcacagggtgagtaattctgaaaagcaacagactcatcaggagtaaacactcaccatcataaattcagactttcacgttattacctgtccttttagggcaacttgagccttttgtttgacttagcacaacatgaatccaaactagggttgttttgattttcccaggcacggtagcagacaatttcttgaatacttatttgcagatagagtttgtcagtgtcagcatttcttgtgcacccacaaggtgagtatagtagaaaaagaagaacatggttcttgacccccaggaacttgccttttaagagaagacaccctgaagtgacaagctgttataagttagtgttttaaactatggaagaacaatctgagcagagtactctatactgtagaagacttcttagaggagaagttacttttgaaatgaatttagaaaaatgtggggaaagatgcatccatatatattttaagatcaaagacattaatgctgtctcttcagtttattgtcgaatgtttattcccaaacaaaccaaaagctaataggatgttacttaaaacatgcaagtcccatttcctccactgctatgagcactcaggtaaaagcatggaacagtcatttaaaatcttgccaagggcctttctgttttttctgtactacctgctgccagaccacagtccatggctgatgaaagtgatatcagtacttcatcttcatgttcctattctcttatccctagatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagtaagtaaacaaacctcttttttttttctgcttgctctagagatttgcatacattttggggtacatattccactacggtgatgatgattttcttcttgtaaaatgaggttcaagataacaatgcatttttgcaagctttgagaaatcaaaatctccaagaaatcattttcctggcaatagattgcctgggtgaatatgaatcttaagtttgcccttataataagtaaataatgaaaattatattcccacccattcaaaagagcactgcagaattttgattttgattcagatctgttttataactggattgaaaactatcaaaattattttctttcaggagaaacatgtccatatatacgggatcctttaaatggccaagcagtccctgcaaatgggacttacgagtttggttatcagatgcactttatttgtaatgaggggtaagttgctccttagaggaaataagggaagtgttagtaattttatttttgttttgcttctcttcttaagcattcctgtaaacttaattttgctttctatgtgacaagttatacttctagccaaacaactcttggatgttttatggagataggcaagatatatagtaaatagaaagtaattgatatttaaggaaagcaaaactacttgctgtttctgacaataagtctgttgtaagcattaagaatgtagtaatcatgagaatttgtccttcacaactgagtgtcccctatttaaatctgccaactcttagagttgaagtagggctcacaaaaatgagaaatagaattgccaactaaagatacacttgtatccagatgactctgtaaagtgttatcagaccaaaactgacgcggttagcctttaccatcatgttgatcaaaatctctcagttgaaaaaccttatttttgagactgctacagtgtgaagcatctcaagagcaggtactgagccctcggtaatagcctttgttctgtagggttttgaagttgtatatattggagatactagacatttaagataaatgtgcatttatagagtaaatgtaagtattctgctataacagaatacttgaggctaggcatttataaagaaaagaaatgtatttggctcatatttctggaggctggagagttcaaggggatggcagtagtgtctggcaagggcttttgtgctgcatcataacatgctggaaagtgaaagggaaatttagcatgtgcaaaaaagacaaagcacaagggagggggttctcgctttataacaacgtgctcttatggtaatgaatccaagcctacaagaatgagaactcattccctgaagaattaatgaagaccctctagaaaggcattatacctcttaatgacctagtcatttcttaaaggccccaccacctctcaatgctgttacactggcaattaaatttcaatatgagttttggtagagacaaaccagattcaaacaatagcagtaacacaccataatatagaaaaagtaagtgagtcttggaggaaaaatcagctgtgactatgtaaggcaactgacagtttttaaaatttggtcaagtagaaatattggaatattcagttgacacatactgcttgctaggcacaccgagggataccaaaactttaagacagtgaccttcctaaaagaagttctaaccttattgagaaataatatatactgagagcaataaaagcaaaatactaaatgagaaataccaaataagtagaattattcatgataattactctaagagtccagaaggaggagagattcctgtgaatttaaatcagggaagatttcattgagtataggggtatacttaatgaaagtattcttatactcagtgagctattcctagaaatacactctgttctaaataatattaatagaagctaaaactcatgtagcactatctatgtgccaaatgctaacttatctaatcccctaaacaaccccatgtactgttatccccttttaatcaattaggaagctgagtgaaggaactttaagtgacttacccaagctcaagaaactagataagttgagaagcagggacttgaatctatccattccagctctagggcctgttctctctacacagtccttgtccttactgtgcaaagtggtgtgagaaaaggcacagaaatgaatgtgtaatgtgattgcaggaggcagcaaagaggctgggtggaaaggcacagcagatttatttagacatctttgctcttggccaatatatattcaaatggggaaactctatttgattaaattgcagatttatttagcactttcgttatatagtatgttgtttaagaaaccaccccctcaaactactgtagtgtagaaaagaaaccatataaaaaattccttcattattatgtgtgtcttattaattgctatacaaaacagtaaccctttcttttctcatttagttattacttaattggtgaagaaattctatattgtgaacttaaaggatcagtagcaatttggagcggtaagcccccaatatgtgaaagtaagtaaattctttttttttaaatttagaccagtagtcctcaaagatttttgcctcctttacaccctttacactttaagattaacaaagatcccaaagaggtttcttttatgtgggttatatctattggtatttatcatattggaattcaaacggagaggtttttaaataattattgattctttttggttttgtttgtttttcctaagacacggtctcaggctatttcccaggctggggtgcagtggcacaatctcagctcattgcagcctcagcctctccagtagctggggcttcaggcatgtgccactatgcctggctttttgtaatttttgaagagacggggttttgccatgatgcccaggctggtcttgaaatcccatgctcaagcagtctgcccccgtgggcctcccaaagtgctgggattacaaatgtgagccaccccacctggcctgattaatttgtaagaataaatgcaatacaaattaacatatgtaacataatttttatgaaaaataataattttccaaatcaaaataaaattagtgagaatagtggcattgttcacattttttgcatatctcttcaacatctggcttaaagcaagattgtatttggcctgttgtgttatcacacaatatgtagcctttggaaaaatatcactatattcttattaggatcagagtgaaaaaagacaataatattttggtggtattgtgaatcaccaatttagaaaatggatatatttataaattgcaaaggatttcttaactagcaccgagttaagcatattttctcattaattgtcagcatttcttgtgatgactagaacagaacttagcatggccttccaaataaatacaggcgtattaggccgttttcgtattgctctaaagaaatacctgagactgggtaatttataaagaaaagaagtttaattggctcatgtttctacaagctgtacaggaagcatggtgctggcatctgctgggggtttgggtaggcctcgggaaacttaacaaccattgggaaagacagaaggagagcaaggtgtctcacatggcaggagcaggaggagcaaggtggggaggacgggaggtgttgcgcacttttaaataaccagatctcccaagcactcagtatcacgagaacagcaccaaggggacggtgctaaaccattcatgagaaatccacccccatgattcagacccctcccaccaggccccacctccaacattgtggactacaatttgacatgcgatttggtggggacacagatccaaaccatatcaataggtatttacactttaagaaaatgagatttgttctgaaagttagttactacattaatggtttgaatttgggatgatatatttgctcatagaaaccttcttttaaatccatattgaattcacaaacagcttgtagaaaccctatattgacaaatttattgaagacacagaaattttactaatgctgtcttaatcttttacatttcctttcctctttttcttcatttttaagaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaaggtagtgtttcaatttatttccttcttcatttgtaaatactatggaaacattttgtaaatagtttcatctacagataaacaaagcaggtgtatgtgcttcctcctcctgtataattggtttctaatttattttaattcaggtcaattcaagtcaaaaaatagttctagctagagttccctatttctcacccctacatgttcttggcatttcattttatacagtgtgaactactgtgtacctgcatgagttagaagtttttgtttgaaagaaccaaaaaaaaaaaatacacactggcttaaagaaagtttcatcttgtattacaagaaatctaagagttctggctatggtagtggtaaactgtgacagactaatcgtctcacaaataaaaatgataaactctggataaaaaaaattttttttttaaagaccaaatgtttaaggcactctggagtgaccaaaagtatgaagaccatgtaggggacttgcccatttaaagaaagaaatcactgaataacagtgatttaaaagtatatactccccaagtacacatgaaacattctccaaagtagaccatattctagacaataagacaacttttaacaaacttcagaaaattgaaatcattcaacatgcattatcacaatagaatgaaagcagaaatcaataacaaagccaatccccaaagaattggaaagtgtacaggacacttctaaataacccatgcataaaagaagtagtcagcagggagattagaaagtgttttgaattgaataaaaacacaacatctcaaaatatccaaatatgtaggatgcagctaaagcattgcttacaggggaatgtatagcataatatacttgtgttagaaaaaaagaaaagtctcaaatcaatgatctaattttccaccttaagaaactaaaaaagagcaagttaaatcccaaactagcagatgtaaggaaatgataaaaatagagccaaaatcaatgaaattgagaaaagaaaaaaaaatagaggaaatcagtgaaaccaacagttgctacttggagatcaataaagtgtgtaaacctgtagccagactgacaaaaaaagacgcaaattaaccaatactgagaatgaaagaagtggtggccaggcgcggcaccccagccagcttgaagaccctgccctcctgcagccggcaggggcagtcactcccggacttgtccttttagaagttccagctttaccacttgctggtggagcccaaccactgccgcagggtcctcatcgccaacacgcctggcagatccaagaggagatggcccaggatgagacgtggcacacacaggcacccgagagtgtggggttggcgttgttccactgcctggtttctgcagagatcctgtgcctgtggcctgtgcccgccatgtggaagccagagggggtgtgccatgccccccgctttggacactgctgcgtgaaggggccagttttcagacctttgctctgtcacctcagcactggcgccaggagccctgaagagcagcatctgggagacggacagccctggggaaaatagaggaggcgttcagaagtagctagatgagatatttgaaatactgaagaccaaaaaccccagtttgcatggaagaactggcctcagatgtggtcagttcctatgatgacctggacacacggtgctgacccacacgatgggaggtggccctgcaaagcattcagaggcttgggcctgctgccgtccggcctcccacctccagctgcaattgcattctgacctgggcaagtaggaacacgtagtggagatcctgatggagacctgagccaggcgtcccggagtgctggccaggcgtggagtacgggatccagctaagggagactggccagcctatagccccccagccttgctggctcctctgctaattccagcagggtctgcagccccagacccatccccttccttcccgtctgcagagggcaggccagaggctggtctcagtgggagctagggctctcctcaagggctttttgaccttgggccagtcttgacatccccacagccctgcgcccctcatcacttttcgtgtctctcggagacggcgagctgcaactgcagcaatcttgtttaaatttaggtaggtgaatttcttagaattaagtttcatatgttttgagcaataagttttcttaagatatatatattttaatctttttagttttatctctgaatattttttattttttttcaatgtattttttttctggaaacattctgtgctgctacattagagcctacacagtttagttggtacatttcattcttttaaggttcaaataagggattttattttccagtgagtttccttgcattgttaacaagtcaacagcgttaacgtatgattttttggttttttttttttgtatactttaaatttgtgtgcaacccttctcatttatgccctgtgttacagtgagagcttggtcaaagtggggaaaacacacacagctgctacactttttttttttttttttgtcattggaacatttgtgccatgtcttcctagacttaagtgtaaattatggagggttttatttgacaatttatatgtaaatgtcattgaaggctaaggttaaatctttggaaatcacaggcaccagttgatctttagagacctcagatcccctcaggtggcgccttgtgataggcggtgttctgggaggcttcctgtcaggttccacagcacaggcacctgctctgggcacggactgagctcctggggtgtgcacggagctgcggtgcgccagtcacatgcgcttggaaacagcgtgtgctgctggattggaaatgcctacgttgctctgttaaattggtgctggagccaaaacctaaggttaaatttaagtctagaatgaaagaaatctgaatccatgtaattaatggccgctcgatcttgagagtccttgacggccctgcctcaggaagtgaggtgggggtgcctacacctttcactttccttcctcacgtccaccccgtatgtgtttctcatcctttttctgacttccccccatcccttagccaaaaagctttatattcttttgtgcatatggtcattctttaatatcagtgatgtaaactttacttgattactttacaaaattattcaacagacaaacaaaagaatgaaaaagagaatatcactaaatatcctacagacatttaaaggatgacaagggaatattataaacaactttatgcctacaaatttgacaactgaaatggacagattccttgaaagatacaaaatgtcaaaactcacttgaagatatggataacctgaatactcctatatctaccaaagaaataaaatttgtagttaataacctactgaaggtccagatggcttcactggggagttctaccaaccatctaaggaataaatcacagcaattctacacaagcgtttcaagaaagtgcaagaggagggaacacttctcatcccattttatgatgatagcattgtccttatacgaaaaccagaaaacaaaaacattataagaaaattacaaataatatccttgatgaacacaggaccaaaaatcttcaacaaaatattagcaaaccaaatcctgtgatacataaaaagaaaagtaaatcatgaccaagtaggatttaccctatgaatgcaagattagttcaaatgcaaaaattaatcagtgtaatttgccacatcagtagactattaaggagaaaaaaaatcatgtggttatcttattagatgcaaaaaacaaagaaaatgtttgacagaattcatcatcttattttttcatgataaaacttctcagcaaactaggaacagaagggtactatctatcttaccctgataacagacatctacaaaaatctcacagctaacattacacttcatggttcaaaaaaattatacttagtggtaaaaagtaacattgtacttagtggttaaaaaaaccttacttacatttctgtctaattaataaagacctaattctggaaggaaaacagtgaggatgtccactcttaccactccattcagcattatattggagatcccacccagtacagtaaggcaagagaaagctattaggcacacatgttggaaaagaagaaataaaaactgtctctactcacaatgagatgccactaaatacctattggaaaggccgaaatgtaaacacacacaccccaaactgacaataccaggtattgacaaggatatggagcagatgaaactctcatatactgatggtgagaatcaaagtgcaatgaccactttgggacatttttggcatttcttataaagttaaacatactcttatcatacaactcggcaacccaaataaactgaaaacattttcacacagaaacttatatgaggatgttcacagcagccttattcataatcaccccaaactgcaaatcgccacatgttcttgagttggtgaatgaatgaaccacctgtgctacctctaaaagatggactcgtactcagcaataaaaaggaatgaactgattcatgcagcaacacaaatgaattttgaaagcatcatgcttagtgaaataagccatactaagaagactgtaatttcatttatgtgacattctgaaaaagtcccactatagggataaaagcagatcaatggttagctggttgtggaagtggggatgagggggaagaggggtaactcacaaaagagcatgaggaaattctggagagtaatggaacttttctgtatctttactatggtggtagttacatgattatttgcatttgtcaaaactgatacagctgtacacttgaaatggtgaattttactgtatgtaaattatatccaataaaccaacctttacaaataacattaggtacaattagacacaacaaaaggtcagtgaacctgaagacaggtgaatagaaattgaaccttatttaagaagaaatgttgactaaagaaagagagaggcttacagacctgtgggagagtatcaagcagtgaaacatacatgtaattggagtttcagaaagacaggagagagaatggtgtaaaatattatttgaaaaaatattggccaaaaattatccaaattagatccaaaacaacctcagatccaggagattcagtgaaccttcagcaggatgaataaattattaaaatttaccaccaccaccacccccctgcagtagtttggtaaaaactaccaaacaaaattttaaaaagcagccagtgagtggggaaaacaacaaaaacccgtattacatttaggagggcagggacaagtaagaatgacagccagccaagttttcttaagaaaatgtggttacaatatggttatctctgttagtgctgaaagaaaaataaaacaccctagaattctgtatgaaggagaatatattagttaacatttaaagtcttttaaaaaatgtttttaacatcttgcattccattccttgtctctgttcacactggaaattactactttgtactactttttctgctaaagcagatatccattaattctgaggtttctctaattttccagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaaggtacaaaggttatcttttttctgtcttggtttgttattgttgttgctgttcattttagactttatttctttgatattaactatcagtcatacaaaataactgaaaagaaacaattttagtatttaactctgtcttgtattcatttctatgccagatgaatgacacgaaattcacataaaattctgctgttgtgattttttgtgcttttccagggttcttagcacgttatgtacattgcatgggtatatgcttttaatatttttatgtataaaaagtgaattacaacaactttttggaattgaaacatgggcatttttatctaagtaagtcaacaatggcataattcatataaatgaaatgagagcaataactcccaagtggttgatcttctaacattattttgtttcctagtgctgcctccatctagtacaaaacctccagctttgagtcattcaggtttagtagcttcttccttatatgtcttcttccttatatgttacaagatataaggaattcctggagaaattgccagcaataactcccaagtgtttggtccaatctacattattattttgttttccagtgtcgacttcttccactacaaaatctccagcgtccagtgcctcaggtttagtaatttcctgcttatagtttttcaaaaatcctttaaattcctggtgattttttataaaatccttcaaatttctggtgatgttcacttatttttagtaatgaaaggagggaggacatttgtatagccattttagttgttatacatagtgattctaaaattatttgccataatctgatataaacaggaatatgaccttgggaaagttgtataaattttgaatgtgtttatatatatatgtttacattatatatagagaaattgatttagtaccttccttattgggtattagtaaggtataagtgggatgcatttaaagcacttagcacagtgcctggtgtagagaaagctcttagagctagccaatatgacttatcctacacttaaattaatgttagggaaggggaaggttcatgtatgtttgttagtatgtgtgtgtgttaatatgttaatatgtttgtttgttaatatgtatgttttgtgtcatcaactttgctattttattcttttcagaagtgatctgttgacacctttactgagtttgttcctattgcaggactctttcatttcctggaatgcaactagtttgagtcttctgatgtaaaacatttaaacagggaaatttctgctgtcctcagaacaagatctgtatttctgcctcttccctacccacccctcttccacacctcataatgttatttattttttttctctttagtgggcagttttatctggcaatagcaactcaattttatagcaactgaaaggcaggaaaagtccttatttactgaaataaaatagaagacttttgcagggactcctggtcaaccactgtgcttatgactggagagattattttgatatgatggaaggaattatcctgatttcagcactaccatctctggtttcactttgcttccagcagaagcaagagacaatagtaattgtgggtagcacttcagtctgggcagactgtgcttagttaacatcatttctgtggtcttcagtttccctttagtataatgtgagtgttgaactgaaatctcaatcactggcttctaatttggttatatatttcctatctccctaatattttaaaggatcgaagagaattatgcatgttaacatagtaattaagataccttcttataggctgggtggggtagctcacacctgtaataccagaactttgggaggccgaggtgggtggatcacgaggtcagaagttcaagaccagcctggctaagttggtgaaaccccatctctactaaaaatacaaaaattagcggggtgcggtggcaggcacttgtaatcccagctgctcgggaggccgaggcaggagaatcgcttgaacccagtgggcagaggttgcagtgagccaagatcatgccactgcactccagcctgggtgacagagtgagactctgtctcaaaacaaaaaccttcttataattcctgtaagagcttggtaactggtagcctcctgagttgagtgctgtagggtttgaggggcaggaagagatgagttttttagtggactgatacatgagcaaaacaagattgcatgtgaaatttatactcagtgaggcatccgggcttaactcacatgctcctagtgggtatatgcactaatactacgtttgttgatacagtcttttgaaagagttgatgataagcatttcataaagtatttataaaacactggtatagcttagtgttggagagcagaagagagaattgcttgggattgtcaatgatttcttatcatctgctagaggaagactaaataacaacatcatgatgttaaggtagatctaaatgtgttaacaagaagaaaagttgaggaagtcctaagtggaaaagagaaagatgtaaattatgtagtatcatactacttacagtttttaaaaagatacatatgtttaccccaagcacattccctttttttttttttgagacagagtcttgctctgtcacccaggatggcgtgcagtggcgcggtcttggctcactgcaacctccgcctcccgggttcaagcggttctcctgccacctcagactcccaagtagctggtattacaggcacccaccactatgccggctaattttttgtatttttagtagagacggggtttctccatgatggcctggctagtctcgaactcctgacctcaagtgattcacctgcctcggcctcccacagtgctgggattacaggcgtgagccaccacacccatcctcacattactttcatgatggttatcttctaagatttccattataaaatacagagtgtggtgagcattcttgtacatacatcttacatacttgtgcaaatatatatgtaggttaaattctaagatgtggaattgcaaagtttgtaaagtgtgtagttttcatttgataaacttaaaaaatcaatatcaaaattaaagtcataattttatattgataaggccctggtgaatttataaaatcaaacttatttttctaggtcctaggcctacttacaagcctccagtctcaaattatccaggttggttaactctttatcctactgatattgttaagaatttatttatttatttttattatactttaagctctagggtatgtgtgcacagcgtgcaggtttgttacataggtatacgtgtgccatgttggtttgctgcacccatcaactcatcatttatattaggtatttctcctaatgctatccctcccccagcccctaacccctgacaggccccagtgtgtgatgttccccaccctgtgtccatgtgttctcgttgttcaactcctacctatgagtgagaacatgcggtgtttggttttctgtccttgtgatagtttgattagaatgatggtttccagcttcatccatgtccctgcaaaggacatgaactcatccttttttatggctgcatagtattccatggtgtatatgtgccacattttcttaatccagtctatcattgatggacattcgggttggttccaagtctttgctattgtgaatagtgccacaataaacatacgtgtgcatgtgtctttatagtagcatgatttataatcctttgggtatatacccagtaagggattactgggtcaaatggtatttctagttgtagatccttcaggaatcaccacactgtcttccacaatggttgaactaatttacagtcccaccaacagtgtaaaagtgttcctgtttctccacatcctctccagcatctgttgttcctgactttttaataatcgccaatctaactggcgtgagtggtatctcattgtggttttgatttgcatttctctgatgaccagtgatgatgagcattttttcatatgtctgttggctgtataaatgtcttcttttgagaagtgtctgttcatatcctttgcccactttttgatggtggtgtttttttcttgtaaatttatttaagttctttgtagattctggatattagccctttgtcagatgggcagattgcaaagattttctcccattctgtacgttgcctgttcactctgatgatagtttcttttgctgtgcagaagctctttagtttcattagatcccatttgtctattttggcttttgttgccattgcttttggtgttttagttatgaagtatttgcccgtgcctatgtcctgaatggtattgcctaggttttcttgttgggtttttatggtgttaggtcttacatttaagtcttcaatccatcttgagttaatttttgtataaggtgtgaggaagggatccagtttcagctttctacatacggctagtcagttttcccagcaccgtttattaaatagggaatcccttccccatttcttgtttttgtcaggtttgtcaaagatcagatggttgtagatgtgagttgttatttctaaggcctctattctgttccattgatctatatatctgttttggtaccagtaccatgctgttttggtcactgtagccttgtagtatagtttgaagtcaggtagcttgatgtctccagctttgttctttttgcttagggttgtcttggctatatggactcttttttggttccatatgaactttaaagtagttttttccaattctgtgaagaaattcagtggtagcttgatgtggatagcattgaatctataaattaccttgggtagtatggccattttcccaatattgattcttcctatccatgagcatggaatgttcttccatttgtttgtgtactcttttatttcgttgagcagtggtttgtagttgtctttgaagatgtccttcacatccatcccttgtaagttggattcctaggtattttattctctttgtagcaattgtgaatgggaattcactcattatttggctctctgtttgtctattattggtgtataggaatgcttgtgatttttgcacattgattttgtatcctgagacttcgctgaagttgtttatcagcttgtggagattttgggctgagacgatggggttttctaaatatgcaatcatgtcatctgcaaacagagacaatttgacttcctcttttcctaattgaataccctttatttctttttcttgcctgatcaccctggccagaacttccaacactacgttgaataggagtggtgagagagggcatccttgtcttgtgccggtttccaaagggaatgtccagtttttgcccattcggtatgatattggctgtgggtttgtcttaaatagctcttattattttgagatatattccatcaatacctagtttattgagagtttttagcatgaagggctgttgaattttgtcaaaggccttttctgcatctattgaaatagtcatgtggtttttgttgttagttctgtttttgtgatggattatgtttattgatttgttaatgttgaaccagccttgtatcccagggatgaagccaacttgattgtggtggataagctttttgatgtgctgctggattcagtttgccagtattttgttgaggatttttgcatcgatgttcatcagggatattggcctaaaattatctctttttgttgcacctctaccaggctttggtatcaggatgatgctagcttcctaaaatgaattagggaggattccctctttttctgttgattgaaatagtttcaaaggaatggtaccagctcctctttgtagatctggttgaattcggctgtgaatccatctggtcctggactttttttggttggtaggctattaattattgcctcaatttcagaacctgttattggtctattcagaggttcaacctttcctggtttagtcttgggagggtgtatgtgtccaggaatttatccattgcttctagattttctagcttatttgtgtagaggtgtttatagtattctctgatggtagtttgtatttctgtggggtcagtggtgatatcccctttatcattttttattgcgtctatttgattattctctctttacttctttattagtcttgctagcggtcatttttgttgatcttttcaaaaaaccagctcctggaatcattgagtttttgaagggttttttatatctttacctccttcagttctgctctgatcttagttatttcttgccttctgctagcttttgaatttgtttgctcttgtttctctagttcttttaatggtgatgttagggtgttgattttagatctttcctgctttctcttgtgggcatttagtgctataaatttccctctacacactgctttaaatgtttcccagagattctggtacgttgtatctttgttctcgttggttttaaagaacaactttatttcagtcttcatttcattatttacccagtagtcattcaagagcaggttgttcagtttccatgtatttgtgtggttttgagtgaatttattaatcctgatttgcactgtggtctgagagacagtttgttgtgatttctgttcttttacatttgctgaggagtgttttctaccaattatgtggtcaattttagaataagtgcgatgtggtgctgagaagaatgtatattctattcatttggggtgtagagttctgtagatgattagtaggtctgcttggtccagagctagttcaagtcctggatatccttgttaactttctgtctcattgatctgtccaatattgacagtggggtgttaaaggctgccattattattgtgtgggagtctatgtctctttgtaggtctctaaggccttggctttatgaatctgggtgctcctgtattgggtgcatatatatttaggatagttagctcttcttggtgaattgatccctttaccattatgtagtggccttctttgtctcttttgatctttgttggtttaatgtctgttttatcagaaactagaattgcaaccccttttttttttgctttccatttgcttggtagatcttcctctgtccctttattttgagcctatgtgcatctttgcatgtgagataggtctcctgaatatagcacaccgatgggtcttgactctttatccaatttgccagtctgtgttttttaattggggcatttagcccattttcatttaaggctaatagtgttatgtttgaatttgatcctgtcattatgatgttagctggttattttgcccgttaactgatgcagtttcttcatagcatcgatggtctttaccatttggtatgtttttgcagtggctggtaccggttgttcctttccatgtttagtgcttccttcaggagctcttgtaaggcaggcctggtggcgacaaaatctgtcagcatttgcttgtctataaactattttatttcttcttcacttacaaagcttagtttggctggatatgagattctgggttgaaaattattttctttaagaatgttgaatattggcccccattcttttaaggctcgtagggtttctgctgagacatccgctgatagttggataggcttccctttgtgggtaacctgacctttctctctggctgcccttaacatttttttccttcgtttcaaccttggtgaatctgacgattatgtgtcttggggttgcacttttcaaggagtatttttgtggtgttctctgtatttcctgaatttgaatgttggcctgtcttgctagtttagggaagtcctcgtggacaatatcctgaagagtgttttctaacttgattccattctccccgtcactttcaggtacaccaatcaaacgtagatttggtgttttcacatagtcccatatttcttggaggctttgtttgtttcttttcacttttttctctaatcttgtcttctttttttcattaatctgatcttcaatcactgatatagtttctttccacttgatcgaatcagctattgaagcttgtgcatgcgtcacgaagttcttgtgccgtggttttcagctccatcatgtcatttaaggtcttctctacactgtttattctagttagccattcatctaatcttttttcaaggtttttaccttcctcgagatgggttagaacatcttagcttggagaagtttgttattactgaccttctgaaacctacttctgttaactcatcaaactcattctctgtccagttttgttcccttgctggcaaggagctgtgatcctttggaggagaagaggcagtctgttttttggaattttcagcttttctgctctggtttctcccatctttgtggttttatctaccttttgtctttgatggggttttggtgtggatgtcctttttgttgatgttgatgctattcctttctgtttgtgtgttttccttccaacagtcagacccctcagctgcaggtgtgttggagtttgctggaggtccactccagaccctgttttcttgagtatcaccagcagaggctgcagaaccacaaatattgctgcctgatccttcctctggaagcttcgtcccaggtggggcacccaccacctgtttgaggtgtttgtcggccgctactgggaggtctttcccagtcaggctacatgggtgtcagggacccacttgaggaggcagtctgtccagtgtcgaagctcgaatgccatgttcagagcaccactgctctcttcagagctgtcagacagggacgtttaagtctgcagaagctgctgcgttttgttctactatgccctgcccccagaggtggaatctatagaggcagtagcccttactgagctgcggtgggctcctccagtttgtgcttccagttctctttgtttacactgtgagctactcaagcctcagcaatggcagacattcctcccctcatcaggctgcagtgtcgcaggtcaatctcagactgctgcgctagcagtgagcaaggttctgtgagcgtgggacctgccaagccatgcacaggagggtatctcctggtctgctggttgttaagactgtgggaaaagtgcagtatttggtcaggagtgtactgtttctccaggtacagtctgtcacggcttcccttggctaggaaagggaaatcccccaagtccttgcgcttccgggtgaggcgatgccccgccctccgtgggctgcactcactgtccagccagtcccagtgagatgaaccaggtatctcagttggaaatgcagaaatcacctgtcttctgcatctatctcgctggagctgcacaccagagctgttcctattcagccatcttggacaagatttttttttacttaaaatttttttaaattaaaaacttaagacatatctaaaaaaatgttaagaatttttaaatgatgggtgaaaaataacatcttgttttaatttgcatttcttggttcttggtttttagttgtttttgtttttgcttttttgagaccgggtctcactctgttgcccaggctggagtgcagtggtgcaaccacggcacactgcagcctcaacctcctgggctcaggtgattctcccacctcagcctcccaggtagctggaactacaggcacctgccaccacacccagctatttttttgtgtgtgaattttttgtagagacagggttttgccatgttggcaagtcttttctccaactcctgggcttaagcgatcctcctgcctcagcttcccaaagtgctaggattacaggtgtgacccaccatgcccggccaatttacatttctttaattatcagtgaatctgaactttttttgatctacatttatttattcatgtgctttgtctatttttctgttaggtttctaaaatatttttcttagtgatttttgagagctcattatgaattaaagcccttttaatatgaagtgaacagttttttccaggttcttttgttttgtcagttttaagcttgttatactactggatatagattactttttataacttttaattacatgagtagtgtatgaatatacttttgtagaatttcaaacattacaaaagtatatagagtaaaagattagttttatttttaactcattacccaagttaatcactgttaatagtttagggtttctttttaaatctatttttgtacatcaacatctttttttaaaaagttttattttagatttgggggtacaggtgaaggtttgttacataagtaaacgtgtcacagggatttgttgtacataactatttcatcacccaggtattaagcctagtacccaatagttaccttttctgctcttcttcctactcccaccctccccggtcaagtataccccagtgtctgttgtttccttctttgtgttcattagttcttaccatttagcccccacttataagtgagaacatgcggtatttgggacgttcctgctgaagacatgcgctcgttcttttttatggctacgtagtattccacggtgtatatgtaccacattttctttatccagtctgtcattgatgggcatttaggttgattccttgtctttgctattgtgagcagtgctgcagtgaacattcatgtgcatatatctttatggcagaatgatttatatttctctgggtatatacccagtaatgggattgctgggttgaatggtagttctgcttttaggtctttgaggaatcgccatactgcttcccacaatggtggaactaaattacactcccacgaacagcatataagtgttcccttttctctacaacctcaccagcatctattattttttgactttttaataatagccattctgactggtgtgaaatggtatctcactgccgttttgatttgcatttctctaatgatcagtgatactgagcttttcttctgtatgttttttggccacatatatgtcttcttttgaaaagtgtctgttcacgtgctttgcccactttttaatggagttgtttttctcttgtaaatttttttaagttcctgtaaatgctaaatattaggcctttgtcagatgcatagtttgcaaaaatgttctcccattctgtaagttgtctgtttactctgttgatagcttcttttgctgtgcagaagctcttcaatttacttcaatcgtacttgtcaatttttgcttgtgttgcgattgtttttgatgtctttgtcatgaaatctttgtctgttattatgtccagagtgatattgcctaggttgtcttccagggtttttatagttttgggttttacatgcaaatctttaatccatcttgagttgatttttgtgtatggtgtaaggaagggatccagtttcaatcttctgcatatggctagccagttatcccagcaccatttatttaatagggaatctttttcccattgcttgtttttgtcagttctgtggaagatcagatggtcatagatgtgcagccttatttctaggctctctattctgttccattggtgtatatgcctgtttttgtaccagtaccatgctgttttggttagcgtagccttgtagtagagtttgaagtcaggtaatgtgatgcctccagctttgttctttttgcgtaagattttcttgactattcaggctctttttggctccatatgaattttaaaatagttttttctagttctgtgaagaatgtcgttggtagtttgataggaatagcattgaatctgtaaatagctttgggcagtatagccattttaatgatattgattcttccatccatgagcatgggatgtttttccatttgtttgtgtcttctctgatttctttgagctgtgttttataattctcattgcagagatgtttcacctccctggttagctgtattcctaggtattttattctttttgtagtaattttgactgggattgcctctctgatttgactctcagtttggctgttgttggtgtataggaatgctagtgatttttgtatattgattttgtatcctgcaactttggtgaagttgtttatcatctggagcagcttttaggccaagactgtggggttttctaaatatagaatcatgttgtctgtggacagagatagtttgacttcctctcttcctatttggatgccctctgtttctttctcttatctgattgctttgcctaggaccatcaacatacttttatgtgtaattatacatgtagtttggtgttttctcttttcttaaaaatgatattatgctgtacatatttttctgcaactttttccacttacactcttagattgtagttgtgtttagatttattctcatactttctaatgatgacttaagtatataccataccttatttaactattctcctatcagaggtcatttatatgttcagacgttttatattaataggtagttggatgtattgatcttttccctaatggctatgactttggtgtctttcttactaaaactttaggtcttctgtatgctgaaattgtatgaagatttcaaccatgtgttctgactttggtctttgcacttaaatcattagtaaatctgaaatttattctggtgtatataatgagatatatggttccacctcgccccaccccagcaaccaccatccaatagctaaatagcaccattttttgaataagttgtcttctccccaactgatttgaaatgtcaatttgtatcatacattgcattcataggtgttccatcctcttttctcctttgaactttgtccattcttctattcttgtagcaaaagcaagtctttttttttttttttttttactgtagtactatatgttttaataactgccgggaacacttccttttcagaaatttctaaggaactctatgttattttttccaaataaactttttatcttatcattttgaccattttaagtttacaattcagtggcattcagtacactgacattgttatgtaaccatcagtaccatccatctctagaatattataatcatcccacactgaatctctactcattaaacagtaactctccattcctccctatccccatcacctgatgataaccactatctactttttgtctcatgaatttgcctattctaggtaaatttatataattataataagtggagtccacttatatggcatcccactatttgtccttttgtgtgtggcttattttacttagcataatgtttttaaggttcatctagatctatcttgtgacatgaatcagaacttcattcctttttatggctgaataatagttcgttatatgtatatactatatttcatttattcattcatctgttgctagacacttgggttggtttgtttttaccttttggctattttgagtaatgctgttataaacataggtgtacacatatctgtttgagttcccgtattcagttcttttaggtatatacctgggagtagaattgctagatcataagggaattctatttttaatattttgaggaactggcatactgtattccacagtggctgcaccattttacattcccaccagcagtgggaacctttaacaaaggttccaatttttccacatctccaccaacacttattaaattgtttttttagtaatagccaagtgtcttagtctgttttgtatgtgataacagaataccacagactgagtaacttataatgaacagaaatttatttcttagagttctggaggctgagaagtctaatatcaaggcatgggcatctgtgagggccctcttgctttgtcataatatgatggaaggcatcacatggtggaaaggaaaagagacggtgagagagagagtaagagggacaaaaccatgccctaaataacaaacacacccctgcaataacgacattagtccattcatgaggacagagccataatgacccaaacacctcttaaaggcgccaccccaataacattacattgacaattaaatttcatcatgagttttgaaggggacattcaaaccatagaccgtcctaatagatatgaagtagatatgcatactagatatgcatttccctaaaaattagaaatgtgttgagaatcttttcatgtgcttattggtcatttgtatatcttctttagagaaacatctttttaagtcttttgcccattttcaagttgggttgacatttgttactgagttttaagagttatttatatgttctggatattacttccttatcaaatatatgatttacaaatatttcctctcattctgtgggttgccttttcactctgttgatagtgtcatttgatgcacaaaatttgcttttaattgatgaaatataatttttttcttgtcttgcctgggcttttagagtcacatccaataaatcatagccagatcaaatgtcaagaagcatttcctctgttttcttctgagagttttatagttttacctcttatgtttaggtctctgatctattttgagtttgtgtttgtatatgataagggtccagcttcactttttttgcatgtggatatccagttttaccagcaccatttgtagaagagactccctttccccatttgactgttccttgtcacgcttgttgaaaaccgtttgaccatatatgcaggggtttatttccgaggtctctgttctattccattggtctgtatgtctgcctttttgtcattaccattgttttgattattatagttttggaatcagaaagtgtgagccttctcaactttgctctttgtttctaggattgttttggctatttgtggtcccttgagatttcatatgtattttggaatggatttttctatttcagaaaaaaaaaaccaaaaaataccatcatcaggattttcataggggttgcactaaatctgaagattgctttgtatagtattgacagtttaaaaatactaaatttttccaatccataaacacaagtgtctttccatttattttatatctttaattttttttagcagttttgtagttttcagtgtacaagtctttcacctccttagtttattcctaagtattttattctttttgatgctattacaaatgatattgttttcttaatttccttttcagattattcattgttagtgtatagaaatacaactgagttttgtatgttgattttgtaacctgccacttaactgaattcatttattagttctaagagatttttgcatgtgtgtgtatatgtgggatccttagggttttctaaataaaagatcatgtcatctgcaaacagagcgaattttatttcttcctttctaatttgaatttctttttcttacctaattgctctgattagaactttcagtcctatgtcagatagaagtggcaaacatggacaccctgtcttgttcctgatcttagggaaaaagccttcattcatttaacattgagtatgatgttagctgtgggtttttaatatatggcctttattatgttgaggaagtttccttccatttcaggtcaactctaaagcatttatttttattaatccctcttttttttttttttttttttttttttgagacagagtctcgctgtgttgccagactggagtgcagtggctgtgtctcggctcactgcaacctccgcctcccgggttcaagcgattctcctgcctcagcctcccaagtagctgggattacaggcacgcactaccacacccagctaatttttgttttttttttttttagtagagacggggtgtcaccatgttggccaggatggtctcgaactcctgacctcgtgatccgcctgcctcggcctcccaaagtgctgggattacaggcgtgagccactgtgcccggctaatccctctatcttttaattttaattagaatcacattggatttatagactaattttgagaaaatagtacagataaatttgcatgttgaaccacagaatgttgtcacagaaaatgtgagtggggaggaagaagaaagattatgacattaaatgtaagtttataaatttttatgatactactttgagaaacattaatatagtttataaggaaaattatattttaagggattttctacaaaggtgaaaaaaaatcaccctatgagtttaaaggattttaagctttatatttaattctttccttcttttattaatttaatctatatttcttcttttttcctaggatatcctaaacctgaggaaggaatacttgacagtttgggttggtatagctatcatgacaaatataagtggtagtatgtgtagaaacgtgtaggtaattagtttttatgaggtgcccaaacataggatccttggtagggtaagataactttcttaaatgctgtgtttgtatgtaggttaaaatatataaaacacaattttctttccacattatattgttattttgtgatggtaatctgtcgataaattttctttctattcatatcttatatacatgaaccttaaagcaatctaagttgggtttattttttctgtaacacgctgatttaacacacttgatgtaggcttacgcagtttacacaatgcatgttaaaaaaaaagatgaagtgcagttgtgatataggccaatgaaaaataaagatttcttaataagtaaaaacaaaaatctattacctttcatttcttagactagtttggtaatggttaatcattttatataatgcaccttaggcttgttttttagtatttgccttacctccaaaatctgtggtccaagtaaatctgttgccatcttaaactgttaaacacttgataactgtttatgagatgagaagagcagagttgaacatagcactttatgctttgacttatagcaatttaataaaagtaatggcagtttagaagcaaaggtactagggacagaaacagttctaaaaattaagattttataggattattttgtgttctctagatagtcaaaaatgtattctcaaatttctctgtatattttttatccatgtgccctggtgtttcatttattatgggaatcctattggtatttaggactatgtcttaattttggggcagggcagagtatggaagtagagaggatgggaaggggattgataagataaagtattgtttgtgaagactttgtaaataccatctgggcaatagaataatagaaatttatttatgactcactctacagatcacttttggaggaaaaaatacaaattaaatgtctaccaaaataagaaatgacagaatgactgttgaactaaaccaactctcatgggataatacttttcaaaaatcattttcctttactatagtgaattctaattactctaataactttaccgctaaataacctgatgtggtagctatagagaaaaacagtgaaaaatgaggttcccattaagagtttcacaagtggaacccttaacctggaaactggttagaagggttctatgatcaaaatgacctggatgccctagcagtcatgctaaaactatataaaaaatttttttttcctctgtagtcttgtattagtccattctcaatgctgttgtaaggaacagtctgagaccgggtaatttataaaggaaagagatttaactgactcagttctgcagggctgaggaggccccaggaaacttataatcatggaggaaggggaagcaaacacattcttcttcacatgatggcaggaaggagaagtatgagaaccaagtgaaggaggaagccgcttataaaaccatcagatctcgtgagaacttactatcatgagaatagcatgggggaaactgcctccatgattcaattacctctcatggggtccctcccacaacacgtggggattatgggaattgcgattcaagatgagatttgggtggggacacagccaaaccatatcaagtgtttagatgatctgattgaaataaatgctatctggagatccatgtgttcaacatcttggaactgttttctttctcagatgtttgggtcattgctgtgattgttattgccataggtaagtatcacaaattttgacaccacttaagtcaaaaaattattgtgaagacatgcattttaaaaatagtttttcagtttctatagttttttcagcttgtaaattggttaaaccgatttaggaaaacctgactttttatttgatatacttaactacctaccttgtgttagtgattttatactctgttatattctgtatatctacttagtaacaaagcctaagtaatacatattttctcaagatgatcagtaatattagttggcttcccaaatgtgcttttgatagttttctaaattaagcaaggacttttctctgacttactatggactgtgtaagtgattatggggagttggatttagatagcaaagagtctggatggaatataaatgtgtaggtgcttaaataacatttgaccactgaaatgtaaccaacatttatttcttctgctagatgttgaatcttggtgattagttttcagaattatatgtcatttgtttcctggtttcttatagttgttggagttgcagtaatttgtgttgtcccgtacagatatcttcaaaggaggaagaagaaagggtaaattaaagcatgtttcttttaacttcttggtccttcttatacttaacatgcttttgtgcagcttcagtttgtaatctgtattgcatgctatcttttttttttttttaaaaaaatgcctgcattagtttgtcctaccaattgcatttctttgctaaaaatattttcagctacttctaacatcactgcaacataaaaacatctgtgcagagttcctacagctattatgactttaagaaaaatttcttttggatttgaggtttaagttatttagcaaatcatggaccactcactatgaggccttctctaccctattccctatttccaaaattgcactaatggccaaaattaaatttaaagtatttcactgtggagactttgacagttgtattcactggaatttttataatgaaagtttccacttgtctatatagcttagctagttgcaagaagctatgtaggcatatcatttaaatacccaatttggtgtcttttcatttaaagttgttatttatacatgttaaactgggggattcaaaacaacactatccgatttccctcttatgttctctgaatttaccagattgcagtaaaactgatagggttaaagttaaaattgctgagaggggttagatctataaggtacctcaattaactgtgtcttttaatatataaaaatgtaaaaagtgagtgggtttagaatagaagaaaaatgtacaagtacatatcttctaaagaaaatagggttttaaaacatcaaactcaaattttagttaaagagcttacagtttaacaaaagacttagaatgaatcctggaacacagactaagattaggtgctttgaaatttctgaaagataatatacattcatttttactgatttttaaaaactgttttcccctatagttttagaaatagctttgaaatcaaacctaataattttaagacttttggtactcatggttttatgatatatattccttttatactgatcatcaggtttgggctaagtcataaaagtacaagctttactcataaggaactcaaacttttttcatattacttggttatcttttgaaatacccataatcccttcacttgaatcttaaatcttgtattaatggaacacgatatgcatatttgatttatctatcagttgtatattctaaaagttacatatctacaacgtgagtacaaaatattatcaatggaatatttttacaaatccataaggtttgcgtagaaacaagttctaaagaaaacaaaacaaagtcgcattctgcttattttccttctttgtttaaaatatcactgcatcagaatttttaaaggttcattaacaagtattaatcaaactctctctagctagcagttaatggtttttctgttgttgttttttgcttttttgtgatggagtcttgctctgtcacccaggctggagtgcaatggcgcaatcttggctcgctgcaaccttggcctcctgggttcaagggattctctgcctcagcctcacgagtagctgggattacagtcgtgcaccaccaccaccggctaatttgttgtacctgtactagagatggggtttcaccatgttggtcaggctggtcttgaactcctgacctcaggtaatccgcccacctcggcctcccaaggtgctaggattacaggcatgagccaccgcgcccggccttaatgggtcttttaaagctcaacagttatctgactgttacactcccaaatgaaaggttcaatagcagtagtgaactgagattccaaaattaatttgtccagtgatttttttttaaagcccatattttacagcatagggtccaactgacagttgccattattaaaattttaaaatattttgggaaggtatgatatctttagccaatgcaacataattaatcctgcaaatagtagcacaacttgaggaaaaatagtccagaaaatggtgtgagagacgaaactcctaattgcctttgaactttaaaatataaactgcgtgggaatcttttagaatagatgttaccctttttatgacaggaacatactcgattggaaattcagcatatgtaatggctgaatccaaagctaggctctctttatggatctattattttgtagttccatgttattttgatagctgaactgaatgtgagggtggtttatctttcttcttcagagtctagaggaatgtttctctgactttaatgtgcacattagtcacctggaaatctgttaaagtacagattctgattcattgggtttggggtggagcctgagaccctgcctgtctagtgagctcccagtgctgatgctgctgctgtgcctgggctacactgaccagggtgttgcccactactgatgtgcctatattgttgaagtctgaagaaacactatgaagcttattggcaaatttttctaatatttaagataattgaagtttttaagattcctcatccatgtgtatccttaaaaaaaggctatggggtaataaatagtacttggcttttcttaccttctttaactcttaaaaaacaaagatttccagccgggcctggtggctcacgcctgtaatcccagcactttgggaggccgaggcgggcagatcacgaggtcaggagatcaagaccatcctggctaacacggtgaaaccccgtctctactaaaaatacaaaaaaaaaaaaaaaaaaatagtggcgggcgcctgtagtcccagctactctgggaggctgaggcaggagaatggcgtgaaccccggaggcggagcttgcagtgagcgagattgcgccactgcactccagcctgggtgacggagtgagactccatctcaaaaacaaaaaacacaaaaaaaccccaaagatttccattattttctttgcactgtttaatgtccataatcttgtccccccagattggctgttgtggccttagaaacttcttataaagactataaaatgtctggaggcacttctccacttccgggggtaactggaagcaggctagcaggcacaaataatctcaaattgttgttaaagcctggcacaaaatgtatttcttgtaaactggtatttatggtgatttgggaacgtaattactcttctgcagccttcatctcaaaatacaaaaatagtgtaaggagtcattttaagatcatccaacatcatttacattacttgataaaaagtgggcaaaaggttaaagtattctgccacttttctgtttcatagctctcagctgagaacagtataggataccagtgggtccgaaacaggtcccatccacatgctccctccttttcccttcccatttcctttctttactaattcttctaccatactttttagtcttggaagccacagccctgtctttgctactgcttcagtcctgtattgcatggcatgactgtgcttctgaacaacagatgccttttgtttacataaatatttaagtaatggttttttttaaatgcatgattattttttaactctagttaagcatccctggataagtgacagtttggctaagttagtgaaagttatttacataatttatatatttattacctgtgacaaatagtttttccttttttccattaatggtatttattattttgtataacctaaactgacttttaatgttacattaatattgactgacccaattactttattaaaaatagtggtcagttcaggtaattggggcatatagtgacatggggcaaaaaaaggatcaaattaacttaaatgtttttctagttggcccttaaattcttgagcatttaacccttcaaaaatttttgagcaactacaaaaatgttttgtaattagtttagaaagcatccttacaaaattagatccatctcagaaatatgagacgccatgtaatacaaagttttgcaacgatgtctcctcaggttgaaaacagatgtgccacaggaagacacttcttaatgtaaaagtccagagacatctgaaaatacatgatgtcataaagttgatttctagataatattacatggatttgatacatactcaatgtattccctcaaaattgagggtgttaggccgggtttggtggctcacgcctgtaatcccagcaactttgtgaggccgaggcaggccgatggcttgagctcaggagtttgagatcagcctgggcaacatagtgagatgctgtgtcttgaaaaaaaaaaaaaaaaaaaaaaaaaaaatcaagagtgctagagaccggtaccatttctccccaacaatctgttattccttgaaaacattttgacatgaatcacttcatgcaaaatggcttcaaagataaacatattaaacaggaatttccagtctgtttatctgctggatgatctatatgacttcaaagttcaagtagcttctagcacaaaattcatgtttccagtccttcagtgagaatgagaaagtcttaagttatgaacctaattctcagctttcctgctactctcttacactggattttatcccacttgttatgctactcgtttctttttggtttgaagtcactattttattcagccgttttctcttcctctgttcagcacatacctaactgatgagacccacagagaagtaaaatttacttctctctgagaaggagagatgagagaaaggtttgcttttatcattaaaaggtatctgttttctgttgtttattttcagatgtcctttcttttgaaaaatattcagtggatatatagatatcaataacctgagcaaagagatattggcagtaaatatcaaagaggaaatttacattcctgttccctttgctaaattattgatgtgttcttataccattccctttgaaaacataatgtgtactgacaggctttgacgtaggctttaaatagagttatgttcccctagtccttttatcagacgatctcacttctaccttgtaaaacagctgtgaatccaaaagtaagaatttgtgagccaactgggaaataaccacagaatcaactcattttaagtgcaaggaggaaaaatgcccttttatagaaaccaaaatatattttacttagttttgtaaatttattcaattccaacgtataaataactctgtaaagacattttatcagtttccctgggctgggatatttttagcatatcaaaggaaaacaaaaaagtcctcagattttgaaaagtaatggattgcattgccttaaacccttggaccctgtccaccttctgtctttgaactgaactggaattattcctctgtttgtgctagaatgtgtgtccgcagagctgggaagagatggagatacatatcccacctcttataatgtgaggccctaacctaggttataattaaaagtttgggagcaggatctacaaaggccagctggaaggacaatttcttagtaaaagcaaagtgatgtctttggttacaggaggaaagggaaagacaaaacataccaaccagaattggcggtctgggcctacccagtcctatatacagtagttccttcttatccacgggggatacattccaaaacctctagtggttgcctgaaacctgggagagtactaaaccttatatatactgttttctcttaagcatgtatacctatgatcattcaatttataaattaggcacagtaggagattaacagcaataactaataactaataatatcaattataaaaatatgccagcatcactactcttgtgctctgaggccactaagtaaaataagggttacctaaccacaggtactgtgataccgtgacagtcaatctgataaccaagacagctattgagtaacaggcacatagtgtccacagcatgggtatgctggacgaagggatgatttatatcccgggagggatggagtgggacagtgtgagatttcatcatgatactcagaatggcacacaatctaaaacgtagttctgtaattttccatttaatatttttgaccgtatttgactatgggtaactgaaaccgtgcaaagtgaaaccgtggataagggaagcctactatatcttcttagtctcttaggacacttttgagactaaagccaactaggaaaatagtttttagactctctctgagcttcagggtatctgtaaacatttgaagataatttaatgaatgctgtagttaatattttgccatcttcaaaatagcttcattgttatatccaataaatgtttctttaaatttatgttaatgccttttatctttggcatagattggatttttatttaaaactttatttaaagaaagagattctactactatgggaaaaaaatatttacttagaaaaatatagtggtggccagtcctggtggctcacacctataatcccagcactttgggaggccgaggcgggcggatcacttaaggtttgagaccaggttggccaaaatggtgaaaccctgtttctactaaaaatacaaacattagctgggcatggtggtgcacacctgtaatcctagctactcaggaggctgaggcacaagaattgcttgaacctgggaggaggaggttgcaagtgagccaagatcacaccacactgcactccagcctgggtgacagagcaagactctgtctcaaaggaaaaaaaataaagaaaagaaaagaaaaatatagtggtcttggagaattcagtgacaggccaaaccattaagtctgtcatcacaacagtccttagggaactgcaatattataagtatagtaatgacgcagtagagaaccataatgatggcctccccggcaaagaagaaccaacccgtttacgcctgaggttgcaattttttgaatttttgcagtcagaccctggcgatgaccttgagcagtaggagataaattccacatgcttagcgttccagtaatggaacactaggcataaatgggttattaaagtatccagaattaacatgcttagctgtgacattggaaaggcaatgtgtttgctgtggcacacatactagtaaataatgactggtccgaatttggttttcgtttgtctattaaagtcaatttactaaggcagggagggcccagagctgtgctgtccagttcaatagccatgcgtgactgctaaggacttccaaagtggctagtccaatgtcaggtatgctgcaagtgtcaaacacacactggatttcaaagactaagccaaaaaaatgtaaaatacatctcaatattttggttatactcggttaaagaaaataaaattatttttgcctttttatgtttttaaaagtggcttctggaaaattttaaattacatgtatgactggcatcatctgtctttggccagcactagactagaataataggttttataaagatgtctattgttatactaaaagtgtgacgtaaactttagttatttaggagactcttagtggaatacatgattttcttgacagtgaggggtagatgaggcatcacatacttgaacagttagaaccactatctttttaaaggttctgtgccagagctacagctttaaaatggagggatcaggaaagcatgcgtttgtctccagtctttcccattggccctacatcaaaatgaggacatagttactaagtactttgtgtgctactgctctatttcttgttttggaggggatcaaaaatataagacagggataaaggaaggttttttttacagtgagaccagttgaacatttgaaattattttaaaagaataatttatttcccaggttggtggctcattactatatttttttaattgttcattttctgaataggcttctggaatttaatttctgtacttaattatatttatctttgacatgatctttataccttggtttgcaggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttcatga

SEQ ID NO: 1581 - DNA, 43480 bp, Homo sapiens; identical to SEQ ID NO: 1580

SEQ ID NO: 1582 - DNA, 43480 bp, Homo sapiens; identical to SEQ ID NO: 1580

SEQ ID NO: 1583 - DNA, 43480 bp, Homo sapiens; identical to SEQ ID NO: 1580

SEQ ID NO: 1584 - DNA, 43480 bp, Homo sapiens; identical to SEQ ID NO: 1580

SEQ ID NO: 1585 - DNA, 43480 bp, Homo sapiens; identical to SEQ ID NO: 1580

SEQ ID NO: 1586 - DNA, 43480 bp, Homo sapiens; identical to SEQ ID NO: 1580

SEQ ID NO: 1587 - DNA, 43480 bp, Homo sapiens; identical to SEQ ID NO: 1580

SEQ ID NO: 1588 - DNA, 18239 bp, Homo sapiens
gatacccaatcagcggccttcaggcgcagatcgtgggcggagcggtagccaggccgcgggccggccaatcagcgggcgagcggctgcctcagcgcgcgcggcgggcggggcggggcctgtccgcgcctaggagcagtgggcgctgagagcagcaaggccaggtgaggagtagggacgaccccgagcctggagagggggcaggagtgggggcgcgcgagggtcggggcggggtctcaggatgcagccgggcggcctctcagggctgcggacgcggcggggagaggtgaggggccgggttcagagttcggggagggcgtccttcccggcgccgcggctgcgggcggaggggacactgttgccatggcagcgcacgtgcgctcgctggcgcggcccggcacccctgcgctcttcaccccggaacgcgcgtgccccttcagccaggcccctgcccgcctgcgccccgcggcctccgtcgccgccggctctgggccggggcctgcgcagggaccgcctgcctaggccgctgcctctccctcgcaccccgggctgcctggctgtctctccctcctgctgtctcctccaggcggcgctgggcaccgcaggcctctgcgttttgaccacccgcgccggttcgcggaatggccacatcctggcgactggcaccagagagatgcaaccgtctgagggccttggggtgtctgtcccccagggaaatttttttttttttttggaggtggagggggcggggttctccctctgttgcccgggctgatctcgaactcgtgagctccagcggtctgcccgcggaggcctccctaagtactgggatcacaggcgggagccccaagggatctttttaaatgtcttactgcattaacaagtgcctaaggagtgctcagagaatagctctgattggatgaataaagacccccaagggcagctttccattcctcccaccaattctggtgggcagaaatagaaagcaaaccacatatgtaattgtacatgttctggtaaccactttaaaataataaaacaggttaaattaattttaatatatttgatttaacccaggatatccaaaatgttattacaacatataatcaatattaaattattggtaagatatttgaaattttttttttcatgcaaagcctttcagatttgtcgtgtgtcttacacttaacagcacacctcagtccgcaccagccacctttcaagtgctcgctggtcccatagtggctatcgtattaagctgcgcatttcttgtgtatgtgtgagctgttgccaaaacatgacatcaaattcagtgttcttggaagccctcttcaaagaacactgattgtgttgcagtcaggcaacgcaaaacatgaggcacggcccttttcttcaaggagtttgcggttcggttgagaaaatagacacccacagataagtagtattttaaatggatgcaatttgggcgatagtaaagataactgggagtatatgattgacagtcagatgactgatcattatcgtttcgaattcaagggagggctatcttcaggctcatgcaggaggggaagattgggcctggtcttgaaagatgggtaagtcttggactgttgggaaaagatggggagggccttttggttgaatggaactgaatatcgctgcttttgtttttagagttgaaaacttacagagtcctgaggctttcagactgaaaaaggctttcttctgtcactgacaatcgccaccatgatccatagtcttttcttgatcaactcctctggagacattttcctggagaaacattggaaaagtgtggtcagccgttctgtttgtgattacttttttgaggcgcaagagagagctactgaggcagaaaatgtgcctccggttatccctacccctcaccactatctcttaagtgtttaccgccacaagatcttttttgtggccgtgatccagacggaggtcccccctctgtttgtcattgagtttcttcaccgagtggtggacacatttcaggttcgtgaatgtgggaaagttcatatatgtaaaccgtaaagtgtctttgtagtcctgtttccattgtgtaaagcctccattaagaaacttaaaaaaaaaaatcaaaactctggtattactcacttcctctcccatctgataagattctggtttctatttattgaattggctgcatgcaaaatgacaaatggaatacttttgaacctcttgcgtgggaaagtcatcctatttgcgatgactatatatagcctttctagctctgattctactttttgctcacaaattagagtttagattgtttttgcctggtggtcttgatcctaaccattgttatctgcattgctttgagttgcatcagaaagtgattgtataaagttttagaaaagaaaaagtagaaaaagctaaggaatgcttaatttaactctcccagtcaggggtaactcatgaacctgtactagttctcaggtttgaggtggttctttatagtgagagagtggtactgatgagctctgcttgcaaagatgagattgggaaatctcatgtgcctgtaagaatttaagtgagccattttatgaggcagttttcattttaagctttttcttcaggaatagatgttaagaacttagggggtgatgtccaagggaggtcagtgataccaggacacgacaccatttgcagcacaggagttcagacagcaccggccctggattcacacagaggaactttctcccaaaagaaccaatcaacttctaactgttgtggttatttgcataactcaaatgagaagcgagggccttttggtttaacttctgtgtcatatgaggtctggaatgagtcatatgaacactggaattgtggaattggagaagagaatgaggacccacacactatgataaaagttaaaaagcaagtcaaagagttccttctcttgtactcatatctgcaccacgtctagaacaacttcccttcccaagagaattaaaatacattttttgtttttccctgcaatactctgtagtactactgttctggaatttcagttctcatgcaacataccggcccctttgcacagtgaaaacgtaagtataagtcccagtatgtggaagaactagaagaacccaggagttgtgatcctaaacaacttttaactgggccttgttatgatttccacgtgtgatactttactcattctgagattaacagtcgcactggtgaaactgacagccgctatatggccatactaatgtaacttattacaagacaggaagtgagaagagttgtttgatctagttgaaaccatgggggaatttgggaaagcagagtaaatttgctaatttggaagtctgagacttcagagcttgttattcttgaagcagttgttaaaagtcagtggacatcctgattctcaggtctccgatgtggatgtgcatcctctccggcagcatgatttttccaggaccagaatgtgacaggagcggccccgcaatagaattgcaggctcacaggccggctgcagcacttggctgtattgcgaggctcctttccagctgcttagttcacatgatgcctggtttataaaacctagtgaagtgttttattttttaaaaataaatcacttttgggaaggaaatgtgtgactttttcttcttttaaattatcattcaaaatgagaattttcctcttaaagaggaaatctttttgttttaggaatacattcctgactcttaggtgacccgggtattggaatcttgtggataattgacgttatctaatgtaatttagactctagtagagtctgttcagttttggatgtcaaagaaatggaaagatggtgaaacaacctggaaaccataccttatcatgaacagcggaagtatcttgaaagtgtggccctgagaagaaaaaaactgaggtgaaaactcgtagttttcagataattgcagggctgttatgtacacttgctctgcaaaacagagctaggaggcaaatttcagtttagcaaaagaaagaactttggaatgatcagagccattcatgaatagaatggactttctcaaaaggagtaaattttccttcattctatgagttcaagagggttgcatgaccctctcagaggtcctggaaaagacatactgacattgctggaagggaacattgaatagccacaaacatttcttgctaaataatgatcacgcattccattttgtagtgctttatagtttacaaagtacattcatgagcgttagtgtttaattagtcatgcctaattcttacagccctgtacctccagtggtgttatcctgattataccattaaagaatcaagatcaaaattaattaacatgacttaatctacaaatgacaaaattataatccaggtcttctggtttgaaatccagtgctttcccacaatgcagataatttagcacctaacgttagccttttaaataaaaggacaaagagttcttggaatgctagcgtcttaaagatagtccaaaggaattttcaggtgtgctagcttgtccccttcatttcatttttttcccctcaactcttattcactgcatgaatgttaagaaatagcacagcagtaggggtaaagattttcatgtactgttctttgttatatcaagtattattttgtataattctttcaaattcttgttgataagcacataatcaagattcaattttgtattctgtgtattttatcaagttgaggaaattaacccaaaagatttaagttcctcttgtttgtagaagaagctagtaatgacagtagtaccataagccagtctagtgctttctaccaaacagactgcctaagagaactatggttatgctgcattccctcgttgtagaagagtagcccagaaacacatggacaggccagatccttattctctgtaggcacattcttttatttatttatttattttacagtatctgagtgatcaatgtgtatattctgtctccatcaggattattttggagtctgttcagagccagtgatcaaagacaatgtagttgtggtttatgaggtattggaagagatgcttgacaatggttttccattggctaccgagtcgaacattcttaaagaactcataaagcctcctaccatccttcgaacggttgtcaacaccatcacaggtacggcagagggggaaactgatagatagtggccatcctacagcctgagtggcttagtcgagtgtcgcacattgttttgagtgtttgtctttggggatctcaggtgtcccagtgctttaattttgctctttgtagttgttttttttttttttttgagacagagtctccctctgtcacccaggctggagtgcagtggcgtgatcttggctcactgcaacctccgcctcctgggttgaagtgattctcctgcctcagcctcccgagtagctgggattacaggcatgcaccatcacacccagctaatttttgtatttttagtagagatggtgtttcactatgttggccaggctggtcttgaactcctggcctcaggggatccacctgcctcggcctcccaaagtgctgggattacaggtgtgagccaccgcgcctggcccctcttgtagactgagtacaacctgaaataatatttttgctttgtggaaaataccctgattttaatgacaaaatgaagtgttctttaaaaatatttttttctgattacagaagaaacacatgattattgtagaaacttcagaaatacagaaaagcacaaagaatgcaaaaattgcttttaatcccaccacacttttaacatgtgatattttatgaacattatcccatgatgatgtcttctacatggttcttttttttttttttgagatggcgtcttgctctgttgcccaggatggagtgcagtggtgcgatctcaactcactgcaacctccgcctcccaggctcaagcgattctcctacctcagcctcccgagtagctgggattacaggcacacgccaccatgcccagctaatttttgtattttttaggagagatggggtttcatcatgttgactatgctggtctctaatgcctgacctcaagtgatccacccaccttggcctcccaaagttctgggattacaggtgggagccactatgcctggccttcatttttaataatttatagttttcttccatgtggagtggacccaaagttacgtactgaatccctatttatgatgttactgatttttgttcttttaaataacaaggattaccattcttacacttgaaccttggtgcacatctgggatgatttctttaaagtagtagaggtagcaatgctgtgtcaaggggtgtatacattttaagtactgtaatgtgttgctctccagaaaagttaggccaatttatactttcagtaacaatttcaaagcactgtagtgaaccctgttattgtcattaataattttttagaaacattggcaatttgatagtttattgatatcttgtatttacagtcattttttgttattaaggagactaaaatcttttcaagtatttattgactgtttttcctctattgtgaattaccttttcatgtcctttgttcatttttttgttgttgaaatgtatttcttttttcatgtggatttaaaatctcttttatgggagatctttatgtcttttgattactgcattacagatattttcttacagtctatcacttgtgatttagctttgttctggtggtgtttagccacattttaaatgttttgatttaatcaaattaatcattcttttcattaaggttttacattttgggtcttgtttaatgcataagcaagcattttcatggaattttataaactgattgaaaaatacattttaaaagtataaatattgcaagaatagccaggacagttttggaaaagaattacaaaggggttgttgggaggatttgccctgtcaaatatcacgacacgttaagtttgtatagtacacaagacaaatattcatacagtagacatcctacaagacccaagagagttttgaaaataatatttttaaaaagaggaaagataaaatgtgtcctaccagatatcagatatattacaggtttaacatcccaaatccaaaatccagaatgctctacaatccaaaactttttggatactgacatgacactcaaaggaaatgctcattggaggatttcagatttttgaatttgggatgcgcaactggtataatccagatattccaaaatttaaaaaaatacaaaatttgaaacatttctggtcctgaacatttcaggtaaagattactcaatctgtatgaagtttgggtagtttttaaaatttggtatttgtctgtaacagacagataggtcattgggataaaatagtccagaaacagacccttgcttttataggaatttggtgtagatagatgtggtcatttatcaaatcagtggaccaggggctggttgttaactatattgtattagggcagtcagcttcaatatggaaaaaattaagtccctccacttcacactatacacaaaataaagtctagctaggttaaggagttaaacacagactttataattattagacaaaaacaggagaatgtctttttgatctcagagaagggaagatcttttttaaaagtctagtttgtgattttatttttggatttaattatttaatccatttgaaaattatcttggtgtgcaataatgtttatttcttcaagagttttcctagcaccattgtgtaatttatccttttcccctgttttagaatgacatttctatcttgtcctgtcattatggattcttggtctgtttttaggctttcctgccttttccctagactgctttgattattatatcttgatgatacattttaatacatagttcctctttttaaggaaacaaatttggtggtttcttcaatattctgagttcattttaagccttaaaagctttgttagtgcctgaatcatttacgaatattatgaagtgagttaagcctgtatctcactttaatctagaaaagggtatctaagaaccacttttgaaaagttgaaatgggcctgacatattggctcatgcctgtatccaatactttaggaggctgaggcgggaggatcactcatgcacaggagttcgaaatcagcctgggcaacttgatgaaaccctgtctttacaaaaaatacaaaaattagccaagcatggtggtgcatgcctgtggtcccagctactctgaaggctaaggtgggaggatcacttgagcccaggaggtcgaggctgcagtgagttatgattgtgcctgtgaatagccactgaactccagcatgggcaacataggaaaaccctatctcttaaaaaaattttttaggtgggcatggtggctcacatctgtaatcccagcactttgggaggccgagttgggtggatcattaggtcaggagttcaagaccagcctggccaacatagtgaaaccccgtctctactaaaaatacaaaaattagccggatgtggtggcacgcgcctgtagtcccagctactcgggaggctgaggcaggagaattgtttgaacccggaaggcagaggttgcagtaagccaagactgcaccactgtactccagcctgggcgatagagcgagactctatctaaaaaaaattttgtttaaagacagaaaataaaaggatccaggtaatggaagaaggaaatagaatttaaattaatgtattttattatgtcagtataaaaccttttaaattaaaaaaagtttatgcctgtaaaggaaaaaacaagtgaaggaattgatctacaattcttaaagacagggagagatcaactttgtgttcttttcctaagtttcagtgttggaacttgggaatgagacagatcatattgatatgtacattttagtacctaccataaatgtacctaagaacctatctcaggctcaaatactgtttttacccatgaaatttttatatcaatatgtagattacgaactctactgaaagccaatacattatttaagctgcatctgagatactaagttcaggttactttcaaaaccaaaatatgatatctgtttctcaggtaactttttcttaaacctttattctgtttgaaaaggcagaccagatggcaacaaggggttttaaaaatagactaggttaccccatatagaagttgggaaaaacctcatcttctgtttgaaaaattcttcaattgagtgcatgaatagtgggagcatagaaacttctagggaggtgttctgtggtttctagagtcaaaatggtgttaaaatacagtaatattaattgcctcaggaagcacgaatgtgggtgaccagcttcccactgggcagctgtcagtggtgccttggcgacggactggggtgaaatataccaacaatgaggcctattttgatgtgattgaagagattgatgcaattattgataaatcaggtaggtgcttttaatatgttctcagaaatatgaaaatagaaagggacctctttcatataatgcttgtagtttcagaattaacccccattcaaggtcatccacttcaatttagtgcctactttgtgccaggcactgtgctgggtactgggaatggacgttaatattatgatgcagaccagggtttatttcatatgtttacttgctttattggtcttatcctcttgaataaaaaagagaagtaacaggccagatgtagtgactcacgcctgtaatcccagcactttggaaagctgaggcgggaggattgcttgagcccaggagtttaagaccagcctgagcaacatagtgagaccccatctccacaaaaagtgaaaaaaattacctgagcatagttgtgcatgcctgtattcctaactttgtgaggggctgaggtaggaggattgcttgagcttgggaagttgaggttgcagtaagccctgatcatgacactgcactccagcctgggcaacagcaagaccctgtctcaaaaaaaaaaaaaaaaaaaaaaaaaaaagtaacaaattaatttcttattgattaaattaccttctcgaaagtatttggctcccagttctgatggcagaactaaagttgtaatcacaaaattcagggagctgccttttctatgtgttctgaattaggtaaatatgactagaagtcctggagcttcagaatttgtagaagccagtcatgatggtatgagcctatagtcccaattattgggaggctgaggtgagaggatcacttaagcccagtagttggagactgcggtgagctatgattatggctgtgaataatagctgcactctagcctgggcaacatagtgagatcctgtctttaactaaagaaaaaaaattgtaaaaagtccttttcacattagtgaacttattaaattcaacagatgtttactgaaaacttgcatcatagcacagtgctagatagtgggcacttgatgatgaataagacatagtctatggctgcagaagttaagtctagtgagggagagagaaaggtaaaaaggtagagcatatgagaggtacccacccctgagcaaagtgcaacagagaggtgggggtgtttatgcttcatcagtggattgaaatgaagttattaagatgtgtggatttgggagcaaagtatgcgcaaacatcacaatattgagcaaaaaatcagatgcataagattatagacagtgggattacatgtatatgaagtttgaaaacagatgcaatttagtctaaggtaatagaagtcagaattttggggatgtgaattacctgggatgggtaagagggagtgcttggatgctgaaaatgttccgtatcttgctgtagctagtatttgcataaatgtatatatatttaaaaattcattgagctgtacactttaagatttttacattttactgtttacctcaacgaaaaagtaaaatatatatggccagatcatgaagaaccttgcctgccagtttaaggagggcagatgtgagtgattgaagagttttaagttgggaatgacttgatgagacttgtagtttagagcgatgagtctggctgctgtgtgaagaatggcctgaagtggggtgggcctgaaggcagggagcagctacgaggctgaaatccaggcccaaaacatagatgtccatagtgcaatgaggacagagaggaatgcacagaccagagagaggtgagtcctcgaaaagaaaggagctgatcattggctggatgtgggcgggagaagtggacgttgtcagggatgcatctgtgtttctggcttaggcagcaggatagatggtgccatcacacagatttggaaatgggagcaccgggttcagggcatgagagaatggactcatttctgacatgtgcctcagtgtcatccaagtggagatgtccattaggcaggagtggggctgaacttgaaaaaagaataggtaataatgggctgtaaatgaacattgaagccttgggaagtaggtaaaataacccaggagagtgtgtaaagtgaaagaaaatagaagttcagaactgaaaaagcatttaagggatgtgcaaagaaagagaacctgccgaagacactgaggaagaggagctgggaaaataggacaccaggagaggttaggagggagggatgtttgagaaggcagaagtgattgacagtgacacatgccacatagaggatgtatagaataagagactgggagtgaccactcactttagcagcagagctcattggtgaccttagggagaacagtttctgataggaaactttctgaaccattggctaaaataatgatgctctgtttaattctgatattagactgacaactcctttaggctaataactacttcattaatctttttatcaccgttacctcaccatagtgtctcatgcttgatgtgcagttgataagtgttcagaatgatggatagatggattgtataaatgaattggatggctaggcagaaggaaagaaagggagagagaggaaggggagggagagagaggaaggtgagggagagaggaagagaaggagggaggagataagtttgttgagaaggacagagaagtattcagtaatctgtgttctttttgtcttattcctgtctcaggctccacaattactgctgagatccagggggtgattgatgcctgtgtcaagctgactggcatgccagaccttacactttccttcatggtaaaatcctgggccagagattaagttcttgggatgagaaattaaatgctgctggaaagacagagtagtgggaatggaatagaacaagaagaaataattaggacagccacgaagcttgtctcaggcttgaattttctagaagtcactacatgatttctgtgtgtgtgtgtgtggtgtgttttaattaaaaacagcatttaaattgctttcctgaaagcactgcgggtgtttaatgcccacttcttgcttctcctctcctgatgactgtagaaccctaggttgttggatgatgtcagcttccatccttgtgttcgtttcaaacgctgggaatctgagcgcatcctctccttcatccctcctgatggaaacttccgcctgctgtcttaccatgtcagtgcacagaagtaagcagctcttataattaagaatggaatccgtgtatgtacatgtatgtggaaaccgtatctgtggtgattaagaactcaggctctagagttacctgggttcacattccagcttctgtggttactaattgggtaacctcaggtgagttgcttaacccctatgtatctcttttctcatctgtaaattgaaaataataaaagtgccttgttctgaagattgaataagagaatctgaatagtgcttaacacaaagaagtgctcattaagtttgctgttatttttgttgttatgtgtctaaacaagaacattattttctcaaatcagaatctgggcatactgtgttcaatgtccctggtctaaaagaagcattaagttatgctatgaaaaagcataaaacgcagtgatttttggtcttgaacattctctttaatttggaatctaaaggcttttggaagcagttttgtatagtataaggtatgcagacagaagagagtcaggaggcctcagagccaccagtcccttcccgtgtgatgtggaatgaatcatttgggaaaatatctgagtgcttgaggtcaaagcctctggaatcagactccctggacttaaaccccatcttcagtacttagaaccttgggcaagttacttaatctcagttaagtataaggacatcagtattcatctataaaatcagtacctactacatagttacagtagcagtatctacttcatacttattgggaggattaaacacggtaggagttaaatggatagaaaccatttagcatagtgactggcaaacaggaagtactcaatacatgttaggaactgttattacttcagggttattccgtgacttctctgaatccttttcttctgtcaaatcatgacagcctaccctaccttatggggtttttgtaaggaccagatgatgtcagatgaaagcattctaaaaaaattatagagacaagaggatcacttgagcccaggagttcgagaccagcatgggcaacatggccaaaccttgtctctacaaaaaaaaaaaaaaaaaaagtaaaaattagcggggtgtgatgttgtgtgcctgtggtcccagctactcaggaggcagtggtgggaggatcacttgagcctggtatgtcgaggctgcagtgagctatgatcgtgccactgcactccaaccaggctgaccgagccagaccctatctcaaaaaaaaaagaaagaaattataaaaggtccatgagctatgaatattatactccccagtgcaaatgatgactggtcacatgttacaagttaaaaacatggagacataatgacaatacatttttgtacattatgcctttgtcatagtagtgtactttttgattttgtttgtattattcagagtcattagaaaagttaatttagttactagacagtagcttttcaaaaagaaaaaattagattactggggtttttttctgtttattttttcagataaaaagtaaggacatagttaagggagaagaagctacccacagggcagaaaaagcatcatgtgaaaggaagaactaccattttcccagtgcacgaatgaaatgactctttgtctctcatttccagtctggttgcaatcccagtgtatgtcaaacataacatcagtttccgggacagtagttcccttggacgctttgaaataacggtgggacccaagcagacgatggggaagaccattgagggagtgactgtcaccagccagatgcccaagggggtcctgaacatgagccttactccatcacaggggacacacacattcgacccagtcacaaaggtagggatgagcaggacatcttgaattgctgatgttaagcagaaaccagtctgcaggttctctgtgtagactctagaccttgtttggaaggtgagatgagtcaaagggaccttgttttctcctgccaggtaacttaacagtaacacgtaggattctcaatggaaagatacccagaggcagcttataatgttgtggacaggtgccctgagtttagatctcagccacctcaaatgcaggattctgctgtaactattttttggaaagaccacttctccatttttattttctttgaagatgctgtcttgggatgtaggaaaaataaatccacaaaagctaccaagtttgaaggggaccatgagtcttcaggctggagcttccaaaccagatgaaaaccccacaattaacctgcagtttaagatccagcagctggccatttctggtaagtgacccagagctcaagaggctccaaagggaacaaaaacggctttctgccatatggcgcaggcaccaggaagcctttctgggcttcctgtttacaaggtttagtttcattacctgataaacaatctttagtaacatcttttctggcatgtttctggggaaaatttacaatccttcctttgaagttggcataagtgacctgaataaaagtgcctaagacacactgagaaagaaacagtattggtagaaggaagtattcactagccatttttggatcatcttagggttgttcatttcaggttcccaaggttttcagtatgagaatccatgtgcattctcagctataactgaagtgtaatttccactcctttcttctgttttcagaagactttcatgtttgctcttatttctattttggaaccactgggcctttccaggtcagttcactatagtctgtgccgaccttagcacggtagtcatcagttaccactttgggggcatttaccatgttccaggcactgttttaagctcttttcatgtgttttcttttttaatccttagaaactctgtgatgtggaaaggagatgactttagctttatatgaagtttctgtttttctgtacaaacgggccttatacaatttaagtgattggaattcatttgatgtataagctcttcaatcttaaaacaataaactataaagctctataccatataaaatattcttggcttagtctagtgagaatacttaggaagcattcatttattaattactttcattgttaattcctttatttataatttacttcattattcatttgttttgttattcattttttcagtccaataatttgagaaaaatcatgcagtggtctaattttttccttatcctcattttagtctgcacattactttgtaccctttccacttcagggacaggtcttctcataggtagcttgtctgttggagcctttttttgctgtcagtatctgtcccaagactggagaatccatctgctctgcataagtggttccctgtcacagcaatgtcggtcccactgacttcagtgtattgaacagaaacagttaggcgacctgctccttttgaataatactcatgtctattttccctctctccctcctttctaggactcaaggtgaatcgtctggatatgtatggagaaaagtacaaaccctttaagggcataaaatacatgaccaaagctgggaagttccaagttcgaacctgaagggagcatttgctgagggaatagtcttgcacattttttcatttcttacttgtctaaaagtaaaaaaaaatatcagcctgtctcctaggtcagtcccctcctggacccacccgctcccttttttccttagccttcagtgccatggaactaatcaagggaggaaaaggtcaccagggagaactggacagaactgaaacacagcaacaccagttctcaaggacaaggtgtgtgatgggggtaggaagcttggtgcttatgtaaccattttaaacgtggtttctataggaaagaccaacatttgtttagcttgcttggctttaattatctaaagccaatgaaagacttctttgttgattttttaagatagaaagattaaaaagaaagaaagatgggaagaaaatgaatgtcagtcaaggaaaggccacttaaggatctgctctatgaaggagaagaaagaggaaaaagaagtaaaggagttaggaggagacacttaaatgaaagattggcaagaaaagcagtcggactctaccttaaggagggatgggaaggaaagagttgagttggtttctttctgattcctctactcatgtagaaaacacttgtacttctggaaatggactggagactttttaaatttgagtccactattgacatggaaaccccagtggaatcagattttccctcaaagaccatgatggtatcggactagttttcagacactgcctgttgctgtccatcagcacttggtctcttatcttcagtgagaaggtgacccgccttcttcccatggtggctgcctaaagtgcttcttttctaacccaaaacagttctactcacttccttttacagaattcaccggccattttcctgttacctgatccttctacaggatttttaaaaagtaagagagtttcagagaagccgatcccataatccccagtgcagccagggtttgtgtgtcatcgtactggagtagagggccgactcttcccatgaaggtgagcacagctgtgagtgagtgagctcatatctccatttgtcagtgctggactggtaccagatcgtaaccttcccgttggtcggaaacttttccatctgtcgccctagaaaaagagaaagcttaccatcgagggtgtggttgatccttgaagctgcttggtaaagttatcatttcctcagtcttttcttttgtactcctatcatgtattcattaatatctaccagtcccttttcattctaagacaaaacatttctcctaaatctctgaataaaatcagtgctgtaggaagatggactgtgttgatcatgggtgtaagcaacccagtttaagaaacatggcaactaaagggatacctcaggctttctttcccagtgggtcatttttgtcctagttcagtgtgtctgttactatttaaatatttatacaaaagggtttttgtttatagcttaaggaatgatactgtgctctgcttggtgcatggagaaaaaggaagacccgtactctccacaccctagagcttttctctaaatattgtgcaaagtttttgctagttttatcttctgactttgggactagtttttgctgcagagttgtgttgctttgtgattttcctctgggatagtgtactgtacacaaccagatgtgttccacactccgtgactccgcagtttgtcctggagtgacatacacatccaccatggaaagggaagcatctctgcctgtggattctcaagtacttggaagcacctctcctgaggaacctacaggattctaaggtttcctaggtcactgaacaactaatcttggtccctgaatatttctaggtttgtaagtgcagcagttttatttcctctagaactcatcctgtttcaagggaagtacctaagaagatatagagtgtttctagggtaagggacctgcaggtgtaagcatagatgaaataactgtcctgtcacatgtgcagcaggccatggagtgtagcgggcatcgctgccgccattcctgcagcatcaccataagcagtgcagggtgtctccatcgagctgtttggttccatgtgtgtttaacatgtgcagaagtagcttctctgtttaagtttaataaagttgagtttcaccagtc

SEQ ID NO: 1589 - DNA, 18239 bp, Homo sapiens; identical to SEQ ID NO: 1588

SEQ ID NO: 1590 - DNA, 86 bp, Homo sapiens
atctcatgatgtgaccatctggaggtaagaagcactttgtgttttgtgaaagaaagtgcttcctttcagagggttactctttgaga

SEQ ID NO: 1591 - DNA, 979 bp, Homo sapiens
tttaactactgaaagccccatttccctggggcccacttcctctgcaatgtatggtctttctgagggctgcctttacttcatggttcctcagacagtaaatgatggggttgaggagtggaacaatgacagtgtagagaacagataccactttgttggaattgtaggcatacatgagtttgggacgggcataggtgaaaagtgtcatggaatagaagagaattacgacggtcaggtgggaggcacaggtggagaatgccttttggcggccctgagcagaagggatcctgaggatggtggcaaggatagcagcgtaggatgccaccacaacacaaagaggaatagcaatgaccatgagggccaagaagaagtccaccatctcagcctgtgaggcatcctcacaggagacgttaaggagtggagagatatcacaaaagtagtgattgatctgaggcatgccacagtagtgaagttgtgctataaaaaccatcttaatcatggcagtcatgagtccacagaaccagcatcctccagccagtgtgccacagagctggttggtcatgatgactgggtagcgtagtggattacaaatggctacatagcggtcaaaggccatgatagcaagaaggatgtactcagtgcagacaaaggtcacaaaaaagtaaagttgagtcatgcagccattgaaggaaatactcttgtcatgactgaggaagtcaacaagcatcttggggctgatgactgtgacataccacatctccaggaaggagaggtggctcaagaagaagtacatgggcttatgcagctgcccatcactgtggatagctaagatgataagaagattctccagcagtgtcagcagataggttgccaggaaaatggagaaaaagagaagctggaaggctggtcgtgttggaaaccccagaagaatgaaacgtgttgtcactgtatgattatctacttccagaattatggtggtcat

SEQ ID NO: 1592 - DNA, 119010 bp, Homo sapiens
tcattgatagtgatcttaaaatatttaatagtctttctttaaaatccaaaatgtgattcttacaagttatgtgccacatgaagcaggtgttattttttgagaaatgcaggtgataactgaaaaacatagcactgaggtattttttatttttaaaattgaaggaaacaaagtctggatctaattatttttacatttacaaaaactgctactgcttggctcttttgctataagtttaggttctgaatacatgacaagagtatgggaaagagcagaataatagtacacgcagttttaaaagctatgcacatcataacctggaataatgattacacagcaagaggcctgagtggaggtaggctaacaacacattttgactttctcctcaaaggatagctttgaaaaacaagtgtaaccaattgttacaccaaattaaaatggcaatattaaatcggtaacaaaacgatccacattttatacaatattgtatttccaaacatacataggtcatgaaaatcagagaacctaatatagcaccgttgaaaccattcattatccttcatgtgtgtatgcaattcagaatttcggcagaagacaacaaatggaaaatgcctttcgtttctataaatcattttggatttcaattaaatctttgccttagtaaagggtattcttatctcaagatcaattagccgtttttagctccaccgttttggaagtaaaaatgatgagctacatctactttttaatttaaaaccaagaaccaagcagtaaggacagcaatgtcaagaatatcacattgagaaccacacagaacattataaagaatttggtgcatgttttaacaactaccaactgatgttaacaatgaaaaatttacaaaggtaaaactttttttttttttttgcactgactggtttcaatacagcactgaatttaactcatctttgggcttcaatctttacatagagtgaatatgaaaatgccatactgaggccttccccaacttaaaccatagtaaagatttcaaaatcattccagtatggtctgaatggtaactgttctggctgacacatctttttttttttttttttttttaaaaagacatttcctggccaatttttttgcttgaagatgattgtctggttatacaagacatcaatctgaaggtaacaacttattttaacttaactactggcataaccattgccagcagtgaacttgcactagtccaagccaactcaaaaacacacattataaacatttgaatgtcatttttaaaagcgatgtcacagtttgtttcctaagaaatttaaaagcttttatttgaaaacgtatcttcagtttaaccctcagagttaagaaatattttttagatcattaaattcaattgtggttgacgtgctttaactaccgttctctaagttgtgtgctatacctagcctgtgggactccatagcttctctgagtcctaaagtggaggattctgttccaatgcttgtgagcaagaaggatcctcaaatgtctaggtttccaatattccaacactgctttactgggcagtgctgtgtatggaagttttgttttgttttcaaaggaccaagtaacttgacaccatattaaagacagcaaacattttttgtagaagtttacagcctgtatacattattccgccaaatttaagaactttaaatggattttaatatggatatgataatgacagccattaaaagatgctatttcttttactaacatttccccaaatgggcaaaatagaggcatcatgtgccattggttctgtcatactggcctttgactgtgttggggaagtaatcacacaaaaagtgcccataaaacaaagaaggcagcaagtgaaactagaaaaaggttggaactgtatgaatcagatttgaaaggagttatttctaaaattctttcttagatgacttgaggagggaagtgcaggggcatctggagttggcccctccactgccgtcctgaagtaaagtagattcagactgtccgtaaagattatcatgagagttggtgactgcaccccaaatcagagccagttccctaagaagaatatggtgcaaaacaaaacaaaccacacattaaatacatgacaccgaaatcactttgatgagaaaacagaacacacaggtattttaaaatataaataaatacatttagccatttttattcaagaaccccagagaactgctttaaaagcaattgcttctttgaacccctttctaaattctttcataaatacttactagtttgattgtcacttaatgcagcacctcagtgtttgctggtggtggtgatggaatttcacttagttgtctctccataaactatatcctattccactaaataatgtttccctgaggaaacccaggcagcttacaaaatactgttataaacactcacaacaaaacctgcagagtattttatttaagaaaaacaaggaatgtagtgttatgacatagggggaaaaaactatgcaaaacagtcacatggaaagaaagtattttaatttttaaaatccaagtttgcttaatttcttgtgaactgttcaacactgttttaaatatcctgaataactgtgccaacaaaattcatccccagtgtttccacaggagacattaaaattaaagaccaaattatactatttttttcctttaaccaaagtattctttttctcagtcctttttgtgcaaaaatattacaagagcaattcaaatggaaatgctgaaatgacatgccaacatttcagggcacatttaaaacactcagaataattcttgaaattattatattctaaaatgttactagcaatcacttttagattagttctgtacatctactcacacggatgcaattttcctagacctctgaaaaataaacaggctcattggtctcttttggtgtccacacaataggcaagataggtttacaatagtgtttaaatcaaactaggcatctacaatctcttgactccaccacattcaaaacaaaaatcaaagttcatttggctatcttgaaatcactcccataaaccaactacggttcactggacctaaacatttctcagaaatgtgtcattttatataatttcacctaagtaagtgatgatttggggatcctttagaaatggttaacgcctaagaataaactttatcaaaatgagtaattgcaataaagtgcttgttacatttcaaaatgatgcttttagactgtggtatgttgttttaaaagtgtgtgctattccttccgtaaaggatccccaggcatgagagttgggtcttctcacctgtctcataaagcagcagcactatcttttggtaggctgacaataggcacattacccatgcggatgaggctatactagtgctatggcaaaaggggaagtaaattagaaaagtgggaggcatgtagagggttcctattatagttatatacaaatatattaaatatactataaaaatagtcgattctattcctttgcaattacttcagaagctccttttagaagaaagctcacccaatccaaacttaaaaggttctctttctccaaacacttaaaatggcaagtgcctttgtgctgtttcttctctaccattcaaaaattccaatcagcttgtcctggctagaaagactcactcagcaacattaatatccagtgtttacccccttccaacagggactcctgtgggactaagggccacaggtaattggaaaggttatagacttgaatgcgttttacacaaatattcatcaacaaactttcaattaccaaagaaacagaaagaaaaaagcagaaatactaaagtaaaatgctatttgcattccacttttaaaaagtttgcctcaatgtagtggaaacatctgaaaacatgttgagtaatatccagtttaaaagaattttcacttgtctgcgtagagtactattttaaggatccctttctaaggcttcctgaacaagggttcttctcccttcaacagtgctcttgatggagctggactgcttcagtgctcctagcgtcaagcagactgctttaaggcaatgaccaacaactacagcacttctgaagaccaaacattttcactattttgcactgaatgttctataacaaactattccaaatcactggcatcttgttattactattccattcctaagccagatataaatgacaaaggagagcacagcactgtcaagttacccccggaatttgggatgctcgaaggctagaccgtagtatttactcacatgctacctgcatctcccatacttttctccaatattttccattcaaaaaatgaagtactttttaagtgtctcggttctggtttgacaccactctaaggagcaactttattaacccttctagttctcacttgcatttgttaaacaatactgactctcccaaaactatgataactgcaagtccaaagcacggtaactgcagagtagctagcatttttcctgaaactcagtagtttcttacctaaaaagtaccacccagaataagtgtttttaagaaagtgagaataaagcagagggaagacttttttttttttttttttaaagctggaaggtgtttctatttggtatctttaaatgctatagatttgggattttaactaacagctttggctatagaaatgaagaacagacactgctgaatcttcatttgaatgctcaagtttcatggggcagggtggggggcgggatagctttgcaacccaaatttaagagaatcaggaggaaaacaaagcagcaaagaggcagctggtgcttactacctcttccactactacgcttcagactgacagaaaagcagctagctgctcctttaaattagcaatggttaattctaagcaggaaaagatgagctgcgaagaacagtaagaatcataaaggaaaattttaattttttcccccgactatttgtggagatgggaaataattgaaggggctggagtaggacaatgtgagtaaacagtttagacgtttacctggggcttgtcttatgctttgttgctgtcaacctaagtagtactcacagttcaccatcttttaagtgtggtatgtagaggacaggcctcaatataatagttcttcatatcttttgttagctaaatccgtatcactaggtattgccaataaataaatgaggcacaactcagatatatatggaatggcataaggtcaagaaaggcaatttgaaaggggagaagaacaatgctattgccatattccacaacatcccccttgtctgtgtacatatgctcaggtacatacatattctgacaactattcttgatattcatgggaatgtgggaaatctctactggatggtcatttagctagaagagctccttgatatgttaattactgattgatatctagtcacacttcttttgtagaagggtaagtaccaattttctttggttgttttctttttcaacattaatgttcaaagtaattgtagccaggtagaattttctgcagaaagacaaagtatatgccttaaggataacagcaaagcagaggacagagaagtcttaagaactggcttagcattcccctgacctctttacctagcaattctgcattaggttaatcttcattattcagaaccttttctgttttaacaacctcaactctgttacacattttcttttgaggtcaattttgatttattacacttgtcctctcctccctttcctcagtaataacattttttatattctaataatgtattttctactaatcctcttttgttctatcactgtaaatttcattagtaccataaaatctgtaaaatgttttttaaatgtatgtaacttgtattggaatttattacttttagaatatgatattgccaaaggaaatcttagttcacgtttagaaggcatgtgagttacaatattctaatgttgtagtgaaggcatagccaaatccctaccccttcttttttctttgtaggaatatcaagatcatattgagcaaatatttctggtaaattcttaaatgactaaagaaaaatgctgatttaggaaacaattttaggatcacattaataactatgatagtgttaggttatcatcttttatttctaaattatttgtacctccagtccaagagactgatagcagtcttcagaggaacttattaggagactaataatgacactgacacccacatgctgttaaaaaggtactaaggtttcaaaactgctacggaaaccggacaatgacttcaagatggtgagttatcacctgaattaaaatcaaggcactatggggttttttcccctcaaataaccctgaatcatttctgactaaaagaagcattgaaattgtgaaggataataaaaaagatttcaacaaatcccaaaagttaaaattcccatgattgagaatgttaaaaagtgcctaagatgttttgtgtgcaaattttacctctataactgaaacattcttgaaattactttcaggcttgttgaaaaccatttacgcaaatatttccaactatgaactataacaaaatatgcaatcaaaactcccagccacctaaaataaagcagtgcaaatcctattttcaaacataattgaaaaataatgaaatgagggatatttctgaataacttgaaaatcctgttgtatcaataatttaacctgaaaaaaaaaatccattcccagcagcacatcatacctcactgaacaaactgtgacatcacagccaaagtatgaacaaaaaaacttgtgccccggaaaagtgaacagaacactactgtgttgtaaacaaaaggaaaaacaggatggatcagtttgcacatggtgtcagaatttcaggaaaggtgctcacacctgtaaggaagagataacgctttcatgcagcatacaaaatgttttgctttctctccttttatctagacatatacatatttttacatcatctgtacatagagaatttgaacccacacaacattctgaaagtaattactgttccatcattatctgaaaagggagaggggttgggggagggggtcgctaccaagtctactggactgtcttcatggcatcactgtaagcaaacccctgacatggcagtggtatgtcctctgtaacacttgataagaggcacagaaccactaaaagttactaacatcattagtgcctttctgattccctggaggtcatttcatagctgagcttcttaatatttggcaatatattctttttccatcaaaaaatatccaggcacctaaaacactgtcagaactggctatgcccctatgatcacctcctgctggctggtatttaatgtacatctgtagcactaggcagcattttctctgccaactaattccaggaactagaacactcaatactgcatctcatgaaactgctggaactttccctcctttcctcaggtcatctgagtaactcttaatgggccatccccttcctcccttgatgtcaagagaggaagcacgtgtgctactgtggttgaaccttggaagggtcgggcaagctgtcagtcctgtgccggctgagttgctgctgttgctgagactgatgttgctggtgatgtgactgagggaaggtgctctgttgtagaggaaatgcagcagagagaatgagttgagttgagggattcccatggagcaacctagaagtctaaaaaacaaatggattatgcagcattgctttactccctttatggcacccacataatagttactcacactctcccctgtccatagggacaaaatccttaaaattctacataatgcatatcactttcactctctggtttaaaaattctaatttggaaaatgcttatgaggccttccctctttctgaaagtatgagagagtttcattttttaaaggaatctgagctacagattttatggtatagaaagcaatctatatcttgagccaaatcacacacgttctttcactttatgtcctaaagacccatattttaaattacaaaatttgagcatagttatgactatatgaaaaacaaatactctgaggccagacagacaatgccttctgcacacaggttcgctcagctggttagagcggcacagttaagtggccaggagcgtggtgggccctgaggtagactgaatggttcaaacttgggctgccctacttaccacatgtgtgacttggtcaagctgtttacttctctgggcctcagtttctttctttagaaaataggaataacagtgcctaccacattgggttcttaataaagattaaatattaatattatttaaaagcatcataaatatgaaggcaaagttgcagccttaggtccgataagcagcagtgtggtataaagacagacaaacaaaacaaaatgaaaaaaggcacaggatttgcagacagaagccctgcatttgagttttgctctgccatttacataagtaagctgtgtgactctgggcaagactcaaatagatgagcctctgttcctttcaccaaatttgtacttctgacatgctgttcattaatgtaaaactctcagatacaaaaaaatgttaacagaaagaaagtgaatttttacaatgaaagtcctttccccattactgacagtacaacttgatgcagggttcttaatttcaaaatggagctgtggtgggcaatttttgcaaatgtatatgaaagaaacatgcacaaacacacacacaaaagagcaaatccctgacaaaccttaaagactactacactttgtcaaggatcttcagagttttctttctctctttgttattaggaaaagctgtgtaaggcaaagacttgatacttatgagccttataagattacaacaggagcatgttttaaaactaggtattacataatttagaaaagccaaattgtgtatttattacctacatacaagtgtatttatgaggggtattgcctatcttatttctttgtgggtcctatgtctttgggatgccttttttttttttttttttttgagaatgtttattcttttaagggcctttgttccttgacatacttagaagactgagatgttaaggcaggtcctctcctttttttagcttatgcttaattctcattggatacattttccctacataataatttagaacttgttttaaattgttgttatttctttatttgtaatagtagctaccccagttatgtctgcagcataggcttaaggtctaaaagactgtatgactctcagatatttaggcaactagcctgttttagttttctacatcacaaagacaaggattatatttggaccaggacacaaagggtgacaaattaagactatatttatgcctgaatatagagtacaataatcacatcacatgttatataacccagaaattgatgataagtgcccagcctagatgaagtggtctctagtacacatacagactagcctacattcaaaattgctccagctaggccagaaggggaaaaggtagatttctagtgaggatcctgaggtccagataagggttttgtacatttctctgctgaggatcttgcctagtgactttcttctgtatcctatagataaggagagcctgtctgattcactaaatgatatctgtgtctatattttggctaatccaagtgtctattacatttgtcaatatagcggtcacaaataacagctagccatgtgccttgtcttatattcagtgatttacaagcactattaatccatgaggtatcaattattatgacctccactttacacgtgacgtttaccaagagtaagcaacctgccaaaggtcacgcagtacgtggtgcagcagtgactcaaccccaaggcagctagactttacagcccaagttcttagctatacatatacttagctcatagatatactacacctccatggtatttctcctctgatattaatttacaactgaaaaattataataagattgaattcaacaaaataatttaaggtaacacctatactagtaaaaagaaatccctgctctgtacagagcagagtttatggttggctagaaaaaggaggaaagaggtgcttgcttaagttccagaaactctagccagagactaagaaaacaggtgggcaggaagtaggccactcactctgtccagcagttctgataactgggtatgcccaatggcacgtctaaagtcttccaacgactgagcaagggaagaaaaaaaatcgccaaccagaacaagctttctatctttgtagagatttaaactgtacaataagcttttgtgaatttttcacatcactcacaaatctgttcacttaatgcttaatttcattacatgaaagtaaatgagtttgaagcagcttccccatggggagaattacctgtaaaaattgttgcggtggctgggtcagctgagcctgagatggttgctgaactgaagtgagctgctgctcctgggagctctgctgctgctgctgctgcgttactgacaatgtctgtgactgttgctgttgtgtagcaaaagtaggatatgcagtcaccacctggcccataagcatagtactaggtaccatgactgccccacaagctacaggagcagtcactaatttggtcacaagttgttgaccttgagaaaatctgttagaagaaagaaggaaaaaaattggagtccaaagtacaaggtatacatcataaaacgcagtggagtaaatacttacctaagataatacccaatgacattgccagtttgtttttcaaggtctgtatattcctactttgtttcattttaaaagattccctttggtgtaacagtaaaacaaaaaattcatacagcaagatcaatgtgtaacaaaaatacaaaacgtctttggatatccacattcaaaagaataaagttagatccttacctcacatcacagacaaagattaacttgaaatggaccaaagaccaaaacataagagctaatgctataaaactcttagaagaaaacataggggaaaagcttcatgacattggatttagcaatagttagcagctggaattagcaataatttcttggatatgataccaaaagtacaggcaacaaaagaacagataaacagataaactggactgtatcaaattaaaaatcttgtgaatcaaagggcactatcaacagagtaaaaaggtaactgtcccatcccacagatgggagaaaatatctgcatatcatccttctgataagggattagtaaccagaatgtctaagagctccttcaactcaacaacaatcaacccaattaaaaaaatgggcaaaggtcaaacttgaacaaacacttctccaaagaagatacacaaatggctaataagcacatgaaaaggtgctccacatcactaatcattagggaaatacaaatcaaaaccacaacaagaggctactttatacccatcaggatggctattataaaaaacaaacaacaatagaaaatgaccagtgttggcaagcaagtagagaaaccttgtgcagtgctggtgggaatgtaaaaatggtgcagccactatggaaaacagtatgcagttcctcaaaaaattcactataggattactatatgaaggaattccacttctgcttatataaccccccaaaatgaaagcagggactcaaagagatatttgtacacccataatcataagcagcattattcacaggagccaaaaagtggaagtaacccaagactccattgacagacggaatgaataagcaaaacatagtagagtagaatattacttagccttaaaaaggaaagaaattctgacaattgctgtaacatggatgaaccctgagaacattatcctaagtaaaataagccattcacaaaaggacaaatactgtatgattccatttatatgaggtacttagactagtccaatttacagggacagaaagtagaatggtggttggggagagaagaatggggacttgtataatgggtatggagtttctgtttgggaagatgaaaaaagttctggaaatggttaggggagatggtaacaatcgtactcagtgacaatgaactgtatattttaaaacggttaacatggtaacttttatgtcatttgtatttttccacaataaaaattttttttaatctataaaaaaaaacctttttctttttataaaattactaggtactaggggtgtcagatatatgtggcacatgattcatctgctacactggcacacagttcatgaataaacaaagctattataatgtattttttaaactctaggtttatagaagaaatttacacaaaattgtagcttacaaatttaattcaaaaccaaatgacattctaacagtgaataaaaactcctctcaatttataaattcatcaacgcagcatagcgtcctctgtgctagaattcattaatttttccctctttccctgcttccttttgctttttgaaatgaaagaacaataaccccaaaaaaatgatgcttctttgtggaacaatattatttccatttgccttttctgtgagatgaagtttataacattggtcattacagtgagatatgacactaacatagatgtggcatgacataactgtatttacaaactgtttatgtaacaatattacacttagtacagatcttgacaataaaatactctattttatacactacacaaccaaatactttaatgcaaaacaaaaaagaattaaaattgtccatattaagaaagtccaaagaaataagtaatatttacaaagtacacttagtcacagaagtactaagtgctgatttctccataatcttaaattaatacctgaattagcccatggctcactggtaaatgtgataagaatattttctttaatctgctttcgtgtaactcacacttctgcagctttgtatactctgggctccctctgcccagaatgcctccctagactccatgccacacccacatccaaagccaagctcaagtcttgaagagtcagggcaagtatctctgccttggtgaagctttcctgaccacacctttattcacctgcttgcctcaacccatgaaactgcttacaaaaacaaaacaaaacaaaacacaacacaacaaaaaactgctcacttcctcctttctaaagacctctgaagtattcatcaccccaaacaataccgatttatctttctattgcttttactagtttggtctttcccttggggaaggaacgatgccatactcatctaggtaggccttcaaatgtttgctaagatgtggtttctgtccccctcaaaagatagatgttcagggaaactcaacttaaaaccacaattaaatatcaccttacccagccagactggccattactaaaaagtcaaaaaacaataatgttggcacagatgtggtgaaaacacttacacactgctggtgggaacgtgagatttctcaaagaactaaaagtagatctaccatttgatccagcaatcccactactgggtatctacccaaaggaaaagaagtcactgtatcaaaaagacacctgcatacatatggctatcgcagtacagttcacaattccaaagatatggaatcaacctaagtgcccatcaaccaatgagtggagaaagaaaatgtggtatgtatacaccatggcctactactcagccataaaaaaagaaaaaataatgcattttgcagcaacttggatggagctggaggccattattctaagtgaagtaactcaggaatggaaaaccaaacaccatatattctcacttgtaagtgggagctaagctatgggtacagcaaaggcatacagagtgatataatagactttggaggaggatggtgggggtgagggataaaaaactacatattggatagaatgtgcactactcaggtgatcagtgcactaaaataagttatagatggttgtttttccagagcagtccacaaaaccttcctgtaatatatgcttaagcactcaagcactgaaatgaagacaccaaggtctgtgttcagagttcccttcctcatcaccttaactagctatagatcccttggctaattactgaaaactcacttttttcttatctgggaaataaaaggaggccctcacatacattttcttttaataaatgactatttgagataatatattttgagcatttaacaaacttaaaaaaggtaagctaccctaaccactgttactacatggaaattctctagcatctatattgaaaagacaaaagcttcacagtgacacagagcctgtcataaaccttttctaacagtgtgctgcagaatttgtattctataatattttgtagcatatttttggacaagaaaaaaaatttgttgttaccctttaattatgaagtctttaaacaatgaatacattcagtgtttttatttcaaatttaagaacattggctgcagtgagcatctcattaaaatcacattaaaaaatttgattaagaaatcaaattattgttttctaatcaatcggtttacaattttaaaaataacaaatgaaatatgacaactaccttatctgcctgtcctgagtgaatgtagttactgcagcactctgggtgctgttttgtggcatactagatggaatctggaccatgcttccggctgcaggctgagaaatcaccatagtgttatacagtggggctgtaagagtgctctgtgtctgactgggtagagatgtttgctgactgtgcccactcagtacattttgttgactctgttaaaaataaagagattttatagacagattaactgaaaataattatttgggaagtatgctagaattcatcattctaacaatatgacaatatgacagagaaagaagtggcaggatatattactctgggggaaatataaccacaaaggaatgactcgtggtaactgagaatgaattagtcttgaatatcttgctggaaggcaagctatgactttagaaaggagtgtgattgtaatagagatgatataaaatatactcaaagaatttctgttaaatgcccaaagtgaatgactaattagtgggcatttttctatttttcatttaaatccttgggatttacagtcacagatctacagtaattaccaacattttctggaatattcaataaaccattatgccccctcccccaacagtctattctgcacatatgggaacaggcttcctggtcagcctcttgagcaagtcataccttttaaacacagaaatagtctaagttacaagaacttggtataactactagactacatctttaaacagattgtgacatattttaaagctcagccaggcgcagtggctcacacctgtaatcccagcactttgggaggctgaggtgggcgatcacctgaggtcaggagtttgagatcagccaggccaacatggtgaaaccccatctctactaaaaatatgaaaatcagcctggcatggtggtgggtgcctataatcccagctactcgggaggttggggcaggagaatcgcttcaacccaggaggcggaggttgcagtaatctaaggtcacgccattgcactccagcctgggcaacaggagcaaaactccgtctcaaaaaaaaaaaaagaaaaaaaaaagctgaaaatatttgatactaacatgatttgcacaaaatattttaataatcactctcaatactatactttctaaatactattaaattttgaaatgatattttatcattagagctttatttctgcttcagcaatagtgtgccttccaaccactgatcactccatagcccgctgtgctcagtaacattacctgagttgatgtactctgtaaagtctgttgttgtatcatgtgctgagttgtgccaatgtgtccagtattcattccactttgaatctggttagtaggaacaacttggccttgcatatttataggtgcaagttgctggatattagatgaatttccagaagaaagttgaacggaaccaaaattcaacccaggatttgattgttgcaaaaacatctttaaaaataaagattatgttaaaatgagctttgtagattgaaaagaagaatgagcattaaaaagaaggcaaaatcaagctacaaagtatgtttaaaaagcaagtaacaaggctaagtcactttgaagaattagcaataaataagtagtgaataaaatatgaaactttatattcaatctttcagttatcttgtttccaattgttagaaaaagtgtaactagtgttagtctgtggattgacagctctgtatcacttatcatttataatttataacatcacacagaagtagttttcactccaagtttccctttaccaaagtcatagtctcctagagtggtcctgctggttggtcatataagactaatttgaatcatacatactggtatcttaataaaaatattactgatgattgatttataaattctgtacccaagatgtacctaaaactttatgtaaaatataatttttatattatggattcaaacttactaaaatttggactggtaaaaaaagatgactggagaaacaaggatgttgacagaaataccctcagaaacaaattatctttagagactgtaagtataatcatactgagtaggtaaccagtgaatatttattgaactgaattgataaaacgtatctcttgcatctcacttttaattaagaaaagttaattttcctagaaatccaaaatgtgaatgggatgctttgtttgtattcaaatataacaattacctgcagcccctgaccatggaccatctgaagttgttcttgaatttttcttagttcttcttgttgccgatgaatatttgcttctatcatgcgtgtccgttgttccaattggtctttcagatgttgcatggctcctaattgagctgaaaactgaaactgaagtaccatgtacggaaaaagtgtaatatattttagaattacttactccttataattgcacaacatgaaaagtaagcagtataacatgagtgaaggatgataacatccttcactagttatgtcccttagtttctaatccacccatctttgctctgctttgtaatattggacctggaccttcaaaatatttctcctttgccagcaggcacaaagttatccacatcagtaggtggtgctggagggacactgccaagaaagtgctcaactcctggttctggtgcttcttgctcttatgtcagggtgccaacgggaagcttttaatattttctcaaccacgtttaacatatgatatggtctggttattgttaatttctgaaatcaaagttgtgtgccctgaaatgtaatttagtatcccaaatacaaactattgaagatagagttaaaaagctttggatgggaaggacatttctcacttttacatacacctgccccggcaggtggctttccagcaagtctcaatgacatcctagtgggcagcttccctgcaagctttaccagtaccccagctgatggcttccagctctctacctctaatctgtggcatgtcagtgaacttctctattatccagttgctatagccacatttgccccaagaagatctgcatcttagcctggcatgggggaagaggaggttaggagcttgtggggagtcttctaagtatgttccttccttgggtactctccatctaccttacagctagtggttgctctctgcatctgctatttctatattcttttttttttttttttttttttttttgagacaggatctcactctgtcacccaggctggaaagcagtggtgcgatcatggctctctacagccttaactttctgggttcaagagctcctcccatctcagcctccccagtggctgggactacaggcatgcaccaccacacctggctaacataaaaatgtattttcttgtaaaaatagggtcttgctatgttgcccatgctggtcttgaactcattggctcaagaagtcctcctacttcggccttccaaagtgctaagaatacaggcatgagccaccacacccagctttattcctatattctttaggttctctttacttcttttaggagttaatccgtgttaccagttaataattttttatattattcctgttcaaatttctggtatgcttctggcttctgactggatacttgactgattacacatacaccctggatttacaagacctgagctcatattgtggctaccacttactggaaaaaaatttaacttcttttttttttttttttttttgagacagagtcacccaagctggaatgcagtggtgtgatcacagcttattgcagcctcaaccacccaggctcaagcaatcctcccacttcagcctctcaagtggctgggactacaggcatatgccaccatgcccggctaatgttttttttaagagatggggtctcactatgttgcctagtctgttgtagaactcctgagctcaggcaatcctcccacaagccaccatgcccagccttatttaacttcttagcttcatttttaccccttaacaaaggaaaaagtagtctgcacctggagttaatttgtatcaatttctgtcatccctagaatgccctctatgtgtacatgagtagaattacccaaagttgcaaaaatctgacagataaccaataatattttcacttttatcttcaatggaaactatcctcagataagtatagaacatgggcttttaaagactaggcaagtatgaatgaataaacgcatacatgaatgaaaataaaattatattttcaatcttatttctctgttttacttgagtcatgagcagctcctattttcttctgcttataatttacccacatttggtgattcatctcttaagtctatacaggctctttaattattcccatgaattttcagtatatgatacagtataagagcagaaagagtttcactttattggaaggaaatctgtcttaaagtagcctcttacagtgaactgtatgtaaaagtgagaaatgtcctccccatccaaagctttttaactctatcttcaatagtttgtatttgggatactaaattacatttcagggcacacaactttgatttcagaaattaacaataaccagaccatatcatatgttaaacgtggttgagaaaatattaaaaatttagtacctcaactccctcaagtttttttttttgtttttttttaaatattagtcaaaatgttataattatggccgggcatggtggctcacagctgtaatcccaggactttgggaggccgaggtgggcagaatgcttgagtccaggagtttgagaccagcctgggcaacatggcaaaaccctgtctctactaaaaatataaaaactagccgggtgtggtggcatgtgcctgtagtcccagctactcgggagactgaggcgggatcgcctgagctcaggaagcagaggttgcagtaagccgagattgcgccactgcactccagcctgggtgacagggtgaggcgtcgtctcaaaaaaaaattaaaaagttacatttatgtcatacaaatgttattttattataactaaagttatttgtacctttggacaagcattatattgatagcaatatagcacttaaaggatttctatcaagtacaaaagaaaatagtaacaaacacagaaggtaggataacaggaagtaaaaccacagacctaagaggcaaagcatttggctttattggtgaacaaaatgtgagacatgaatgcttactaacatttttgacatagtaggtatcctttatttcatgaaaatatccccataacatgttaagaaatgctttagaatcctgagattaaaaaactaataatatagaaagtatgtatctcctatcatatatgtatgacttaaattaaataaccatataagatggagctatttttaaaaatattgttttcacctattattaatgatcattccttgaaatcaagacctgctaagttaaggtatatttaatgccaaacaaaacagaaaagttgaagaaaaatactacttctccatagtatttttaatgtgtttgaggcactgaatgagtacagagtcataaattacaagttgggaagttaggctctaaagtaacagcatcactcttggaattactcccccttttttttggctactttccacattcaggcctccttctggacttaggccaagaaacaattctcctagaaagttttccttcacttcctcaggttgcattaaggattcacacaatctgcttacatatcaacttacatactttcagcacaggcaatatagcatggtattgtaggcatctgtcattccctctagatgtaatggttttttagttcatatatttgtactgtcggcatctgcaatgcctgttacacacaaagaactcaataaatatcaaaagaatgagtatacaaataaagttactcaattcttccaatattcataggaggaacaaaatgaacagctacatttcatccttaatatctttatgtctacagtgttcctcaatgagggagtgttatggcatattaggcaggacaattctttgttgtgcaagactcttatgcatcctgaaagatatttagtattcctggaccatgctcactaagggccagtgataccccacaatcattacaacaatcaaaaatgtccccagatatcctaaatgaccccagttaagattcactgcatctgtaactataattatatatgtgcgcgcgcgcacgcgcgcgtgtgtgtgtgtgtgtgtgtgtgtgtgtgtgtgtgtgtgtgtgctcctacctcagcctcccaagtagctgtggctacaggtgcttgccagcaagcctggatttttaaaaaaattacattagcttaaaagcaatttatcatattcaaatacgcaactgaaacaaaaaccaaaaagtacctgggacatgccttgtggaattggtaaatttgtagcttgagacatcactggctgtgttaatgatgaaccaacagactgggaatttatggactagagcaaaataaaaaataacactgaagtgattctcattcccatacatgagtacttccagcagaaatatcaatatgatattcgtattaataaacttaccatttgcctcatacttttgttagctgaatacagctatgtcttctcatctatattggaaaggcctgttccctatttatcttttattttccaaggaacttcctacagtaccttgaacaagctctcaataaaagttggccagacttaagacaattggtatttgaacttagacataaaacagctatcaattttgagctttccacaattaaaaaaaaaaaaactaacattttacttgaaaaataattagaaggaccaatacatatgacaaccacttcatacaagaaaaggaagtcttaagtaagtgtcacatatcagtaactattttgatctttacaaagaggggtgacaaatagatgaatttctgaagatttagatcatttttcccctcttaataaatctttattcagaagaatatccactaaagagcttacctgactactaaatgatgaccttctttgcaccatcttctcatgagctggtaaatgctgcctgggtggagtgctcgtatccgtcgggatcttggttggtgttgctgaagtcaacaaaatcagaagagcattagtactttataaaatatagtttttaaagattaatctcaaaatgtatttcagttaataaaaatggcttttgaattatttttccaaaccattcaatgaaagtgaagtccatgacagatgattcaatgtagttacttctatctttttatgagcacaaagaaaatagttgaaataggaaaattttaaatacaaaaagtcactaatttaatgacaattatacaagtcttcaaaaagagaagacaataaaaaactttcaaaaagcaaacctaagaacacttactggccctacagtaaaaaaacacaataaatagttgcctttctttttgagggatgattaaaaacatcaccatcaccattaccacctacacattttaataggctacttgaagaacttaattctttgctgaaagtgggcaatgtccctttaactcactggaaaggttactacatttcagaaatgtaaaaacttataattttaaagaagcgtttgatgagaaatgctgatataagtaactaaaagtttagttagttactttaaaggaagtctgctttgaagcaagggtactcacaggaagggtctgagacggccgtgtgagatgattttcttgaactccgagaagaggcagaaggggttgggctgtgatcaaacctttccaatgcttccttgagactgactgtgtttatacgattatctgacccagaatcttggctctatggagacagagtaaaataaatgttttcttgtggttcagttcagagatctcaaattcacaatactgttaacaacaacaaaaaaatcagtttttgtctataacaaggcaaaagtacctgtatgtacatacacatgtaaagaaatgaaaatttatgtgttatagccagaaagttttggcttcattttctatttaaagaaagagaagaagaatgaagttggaatctcttacaccatatacaaaaattaactcaagaccaggtgtggtggcttacacctgtaatcccagcactttgggaagctgaagcaggcagatcacctgaggtcaggagtttgagaccagcctggccaacagggtgaaaccccgtctctaccaaaaatacaaaatttagccaggcatgatggcagatgccttgtgatcccagctactccggcggctgaggcaggagaattccctgaactgaggaggcggaggatgtagtgagccgagatcctgccactgcattccagcctgggcaaaagagcgagactccatctcaaaaaaaaaaaaacattaactcaaaatgaatcacagacctaaattttaacagctaaaactacataactcttacaagaaaacataggggagaaagccaggtgaatgcctgcggtgccaactacccaggaagctgagaagagaattgcttaagcccaggagctagagtttcatagtttcatacagcgacactaatctttcccttcaccaatgtttctttctccatcagctcattctcatcagtatacaaacatgctgttatttctctcaacttaaaaaaaaaaaaggcaaaaaattcctttaagcccactttcccttcctaccactgccccatttctcttctctttgtagcaaaacccctccctattcactgtccctaattcccccatcctggaaaactgtcttttaaaccaactctaatcatgctttcacccacactgctactccacaaaatctgttcttattgatcaccaatgaattaaatgttaaagttaatgctcagttctcaacactcatctaaaatttaacttatttcagctgaatctgatacagctgatcattcactcctcactgatactcttgtcttctaagtaacttcctggttttattcctaacttactagctattacccccctgttgttgattcttccttgtctccatcacctcttaatattggagtgctccaagacacacccatccctttggtgatcccatcaaaattcatgattttgaaaccatccacacattgaagtttctcaaaaatatctcagaaggacctcgtccctaaaccccagggggatcatgatgctggcagtaaatatggtgggaaagtagacatagctggtgtgtattttggaaacagggctaatttaggatttactaggattgaatctttgcataagggaaaaagaaggataattaatctctgtattacttcagttttcataatggtcccctaatcaaggaaccctagattttaagaacttttctcagaaaataatgtcttctaccaaaacatactatgtcctcttcttctaaacatacaaaacctctttggaaaagttctttcacgtgggatccatgaaagcagggaagttgtttgcattattcagtgctgtattcttagcatctagatccatgccgggtagaaggtactttataacatttgttgaatgactgaatgacatctaccatattgtcccctggaatgctgcctatttaactcaagttttatatagatttttgactcttttcattctacttattttctgcaggtccaaaaatactgtggtaggcaatttctgacatggctcacaattcctgcctcctgatattcatgcccttgcataatcctcccatcttgagtgtgggctggatctactgatttccttatataatgcatagaatagacaaaagtggtgaggtatcaatcctgtgattaggttacaaaagactgtgacttccatcttgcaggtagtttctctccctggctcatcttgcatgcttgctctgatggaaaaggtcacctggaaaggaactgaggatagccttcagccagcaagaaaccaaggccctcagtccaactgcccatgaggaactgaagtgtgccagcaaccactaagtgaggtggaaacagatgccacctcagttgaactttgagatgactgtggctcccaccaacaccttgattacagcctcatgaaagaatctgaagtagagggtccagctaaactgtgcctggactcttgactcaccaaactaggagataacaagtgtgttgttttatatcactaaattttggagtaagttgttacacagctatagataactaatatactatacttctgacctgatataacaaaaaagaaaccagagttccaattctgactataatttcccagccagtgtctttagggaagatttttttttcccctcttgaaaccccaatttcagtattttcaaagtggggatattacctacccgataaaaatatctgatgtgtaaattatatttcataattcatataaataacctagccagagactagtacatcactgggaataaatggtagttttgagatcagacacatctctcatccaattttctttttagaggcaggtgagactctaaaatattaaattaaaaataagtagtaaagtataatcacatccccgttataagtgaggaaataaagtatttttgaaaaatagttttcctattaattattgagtttcatcttttattggggagaaattaaaaataattttttttaattataagaaacatactttgtcagcagctgtctcaggaagagactcttcaatgccaagttctcgtcgtctttcagccctaacttctgcataactacaaatggaaaaaataatcaaattttagtgtctggtcattcgtttaaaatactgcacagctgtaactattcagtgttgttacgtgtctcatctgttcatctagactatttgctatgtgctacacaaacctaaaatatacctataatgtcttaatttaacttgcatttttctaggtatcttaaagtttcatacactgctgtaaacgatccataaccacacaatacttaaattaagaaaaataaataaaggaagtgtatgcttatctacctacagttttccttttacatgactgacattactacataaatgacagtaacaacttctgctgtaaagcacaaaatttatatcaagacttatatatctatatcattcctatatttatatataatgcctataagtaaatttaataatatattgaaaggatctatcagcaattgagaaaagagcactttgtagctctttaacaacttacgcataaaagttacaatgccaaaatcatcataggatgttacagtaattcagaaattctctaaaagaattattaccttactacagtgtgagtacaaacaataaactctggccttgaattccactgatggtaagtgatataataatgagtctgaagccaaatccactgttgccccttagtcaggaacctataataacatgatttgcctttcccatattgcattactaaaaggaaaatagagaaatattttttctttaattcatattatataaagattgttttttaaccaaaagctatcatttacatttaagtttacacatactattatttttctggccttttgataacatatatgtcaatatgaaaatgttattctttagagctagtttaaggtcccaagcaattatcagatctacagtgcccaattcacagctagtcactgctgatcttacaatctttccatacacaattaatacttaagaattcacactgctgacttcctcctgcctagatatacagagggtaataacaataaataatcacccctgagttttttctcctaactactctggcaggcacagaatctttgaagcatttaattttaaaccttaactaaccaaaatcaaagtaactgagtctgaagtaactgagtgcagtaactgccaaaacatgtgctgtggattttaagttctgaagcgttttaacagatattaaacaaaaaaatgggttttgggccaggtgtggtggctcacgcctgtaatctcagtactttaggaagcagaggtgggaggatcacttgaggtcaggagtttgagaccaccctggctcacatagtgaaaccccatctctactgaaaatacaaaaattagccaggcatggtggtacgtgcctgtaatcccagctactcacgaggctgaggcaagagaatcacttgaacccgggaggtggaggctgcagtgagctgagacacgccactgcactccagcctgggtgacaaagcaggactccatcccaaaaaaaaaaaaaaaaaaaaaaaaagggtttgtagttaaattaatttgggaaactttttgttaaataggtgtcttcagttttctcaaaacctagagtatgctaatgcatgtgcagattctctgagggattatgaagtgtttccccatcttccttgactataaagtctttttttatggaccaacattcggtggaacaaaccttagaaaatgctagtcaagaatctctcaatctgtccccccaccccccaaccccgccgccaccgcctctcactctctaaggaggaaatcaaggtctacaaacaaacttgctgtccaaagttacccagctagttaatagaggtatcagctctttagacaacatcatggtgcttaatgcccacatcttttgtgctgaaatgactttactctgaaaattttccatagagttaatgctattatacaacctgcttcattttcatacagtgaggtttataacagcagcataaaacgtcatgaaaaggtctaaaatatctagttaagctttagtgaacactcaagatggtaagcatctgggaggaggatcagagaagcaaataaaacatatcattaaggcaaacctcatcattaaaacaaacttctaaaataaatacatgtgataaaaagagtaggcctaggctccaatcctgtctctgccaccaatgagctatgaaattatgggtgaattacttagccttactgtgttctcagcttactcatgaagataataatagcatctaccttttagaactgtgatggagaataatgaagataatagatgtaaagtgtttagaacagtgcctggcacaaaggatgataatgctcctgctctaacaacaataataagcagataacaccaagcacttactatgagctttctaagacagattttccagacatgtacctagctcctgaaaagattcacatgcctcaaaatcaaaatttaggaaacaatactccaaaagtttgaagtattacaattttcaaaggaatctacttctcttactccagatatagagctcacgtgcttcagaacaaggtgtattagatgcaatattataaaattctacttattataaaaataggaacaagtttaaacttgatctatgattcctactacattggttatatacataaagcaaaatcttttagcatatttcaaaaatatgaaaatgattataaatctgtgtcttactacctatcatttcaggacaggacttctgcttataaaacagttattatcaccagaaatgttaaaatctacttacagtgctcatgacattttgccaaattttctaggtcatccacatgatagtaatcatagcctgatgttcccagaacttcaaatggcaaataccctattatgggtggtgccctaaattacacagaaaacaatcattattataagtttttccataataagaaatatttcaactagaaataaactttggggggggggctttatttttcaaaaaatgggaacaggtttcaaagtcctaatttaaaaaaaagtttgcccttgatccattaatttcaagaattatataacatgactattaccttttcatggaatttaaaaatggaattacctgtgatctagaaacagaaacttccattctaaactatgtctagatgtaaactcttcattgggttcttcaacagtgcacatttcctacaaataaataattaaaatttataaatactttgtgtccttaagaatattaaatattgctacatataaaaataagtcatggccaggtgcagtggctcacacctgtaatcccagcactttgggaggctgaggtgggcaaatcacttaggtcaggagtttgagaccagcctggccaacatggtgaaacccgatttctactaaaaatacaaaaaatagcagggcacggtggcgggcacctgtaatcccagctattcggcaggctgaggcagcaggatcacttgaacccaggaggtggaggttaaataaatacataaataaatagtcattactagataaacttttcctaaacaagttagttgtttctatgtatgtatatatttacctatttctttgtttgacacagggtctcactctgtcactcagcctgaagtacagtggtgtgatctcagttcactgcagcctcaacatcctaggctcaagcgatcctcctgcctcagcttcccaagtagctgggactatagggatgcaccaccacgcccggctaatttttgtatttttatttgtagaggtggggggtctatgttgtctaggctggtcttcaactcctgggctcaagcaacctgcccaccacagcctcccaaagtgctgggattctaggcataagccaaaatgcaggcccttctaaacaagttaatatattttaattttccagtactaaagaatgtggtaataaataacctttagatgcaagcttttgggtgggtacttctcactctacacattttccattcacacatgcctataaacgcttattcaaaattcagacctctctcctgaattacagttccatatttccaaatatctgaatgtcctcatacatctcaaattcaatatgtcctaaaataaactaactgctttactcctcacacccaatcacacaattttccgtattattctatacatgtgtagtggccagtgtctagaaatctgatagttaaaaaaacatactctttcatttttacctttcatcatctaagtggccattactaaatcttttccatttcatctaagtattttaaaaatcaattctatctcatccatcttgagtgcattggtttagacccctgccatcactgatttgctacagtgttcaccagtctccctgtccttcaactcatcttctcttctagggccacaattaccttaccaatactcaaatattatatgacttccctgctaaaaaaccttcagtggttccttgtgctaaactctcttcagcatggagaaataaacaagaaagaaacaaattttatttctggtttctgattacttttctagccttacctcccactatctcttccccctccacacactaaccctagactctagtcatactaaacaatgtattccatcctgcctctgtgtccctgaatgacctgcagcactctgtaatagttgagagcttgggctttgagaaaaaaacaattattaattaatagaatcaagtcccagtttcatcactaatagctgagactttgggcaagtcacttaacttccctaagcctgtttccttataatgtaaaatgagggatcgtaatggcatctaacttatagggttgtcataagaattaatgagataatgcatataaaatacacagcatgtagtaagcactcaaatgttaacaactattatttcataagatcaaaacaaaccaagcaagactggcttaagatcttctattaattcagtactttgtcctatactatgatgtccccccaaatttatttgagacagagtcagactctgtctcaaaataaaatgcaaacacagttcactgcagcctcgacctcctgggctcaaatgatcctcctgcctcagcctcctgagtaactgagaccacaggtgtgtaacaccatgcctggctaattttttgtattttttgtagagatggggtcttgtcacgttgcccaggctggtctcaaactactgggctcaggcaatcctctcgccttgctctcccaaagtgctgggattacaggcatgagtcacctcgcctggccccgccgaaattttaaatcttagcctggctgcctctttccagtcagtttctagtggttaactctttcactttcccacttccctacttgtcatctgtttgttgggtccaggaaataaaaataaaatacctaattttacatttgaaaaggtaagttatatgtggcaaagagccacttgtacatttcaaataaaaatttaaaagttaccttctaaaaataaagattccaaaaacctagatttttggactttcccttttaatagagataatgaacaacacacaaaaggatcctaaaatcttccacaaaagtagggcaatattgatatataataatcactggttaactgcaaaggatatatactaaaaaattagttatacaatttaatgagtgtcttgataactcatcgtttcaaaaatattatcatgcatatttaatgactcatagccattccacctcaatgtctgcaggaagtttcaggcagctctcagcatatgaactgaaatcccctttgggaaataaaattaaaaacataccttgatgaactgaggtgtagctaacctgacagtagctacaaaacaaactctatcttcataagatggcctatgtgtgcgttgtatagttccttcaaaaccattgtgtgctgaagaggatactaaaacaatagggaaatatgtatcatcagttatgccagcaaaacctaattgtcactgatattcaaacatctatgtctttaagagcacagaaaaataacaagttaaaacacattgtgagagaagcattttaactcaccactgtttaaagatttgaaatttcctataaattttacatattcataggtagatggctcctttgggtctattgttcctcgcagcatgtgacaacagaattctaactgattttttgctgaaataaaagagattttaaaaatcacatatttctgatataaaacaatgattgatataccacataaagtaagatcataaaagttgtgtaagtttacaaccattattttccccaacagaagtcgtcaatgacatttagttcataaaagtagagcaccttcaggagaggatctcactttgtctttaatagaaaaaatagattttctggtgcaaacaacttaatgtttccctatttttagctactcatccttttcattctttactcactttcaaaggaaagttttgcttcacattctaaagctaatccttccatctctaccatttatagtctttcctattttctctaggacccgggccacatcactgttccttattcctttagcatctacacctttgggtccttactttcttcttttttttgagacagggtcttgatttgtcacccaggctggagtgcagtggcatgatcactgctcactgtggcattgaactcctgggctcaagtgagccccctgcctcagcctcccaagtacgcaagactacaggtgtgagccaccatgcctggctaatttttaattttttatagaaatggggtctcactatgttgcccaggctggttgcaagcttctaggctcaagcaatcctcctgcctcaaagtggagggattataggcgagagccactgcacctggccaagggtccttactatctacttttaaatttgctcacgtcttccatctgaaataaaggagtttcactaattatttggtattatagatctccttccttttcattatgggctccatcttccatatattcatttcccttaacttcacacactgtgacttacacctctacagcaattattcttctcaagattactaacatttgtatcgttaacttcaatgatttttcatttccacttcttaaaagtcatcctttgtcattcccacagcataaacttaccttcccaccttactgactattcctatctcttctgctaatccattttcatactaggggttttcacaaaggttcttctgatcctaaatctctctctccaactctagcattttacgtgagacaaagttacctatcatttgctttcaggacattcgaacttgattgtcccattagtaacttaaattcaaaatacttgaaagtgaatttatctttctttcaagctcccttcgtctatgtatgcttatttcccaagttagaaaccgttaacaatttggtctcttctcttcccatcacaagtcccaaacctaatctgtcatgaagacctgctacttatttcaccaaggaagcctgccaatttagtgcagttgcaaattaccttgcatctaggtaaccgaaatatgtattcattatgcctccacattctgccactctgattcagtcttgtctattactcttagacttgtaattactttcatggtattatttccgcactcaaggactagtaacacctttctttgctcactacttcaagcttatattcttcggttattatcatcatagatggctttatcatctaacctaatcagtaaaaatctatctatcttcaaccttccccactgatgattcttagtcacttggtcacctgagcctaccacatcaagtcctattgagtttacacacttaacagtcatatactttcctctcctttttttttttttgagacaaagtctcattctgtcacccagcctggactacagtgacatgatctcagctcactgcaacctctgcctcctgggctcaagtgatcctccagctcagcctcgagtagcaggaactacagacatgtgccaccacaccccagccaacttttctatttctctttattgtatagacggtgtttcaccatgttgcccatgctggtcttgaactcctgggctcaagcgatctgcctgccttggcctcccaaagtgctgagattataggcgtgaacaactgtgctcagcccatccttacttttattgctaggattatatggttttcctttttgtctcccagtctggtccttttcaaaattttctacctgagtgattttttttaatctcccaaaccagatgacgaaagtggcagcaacttttataagcaaggtactgctgctctttctaggccagagatgctggtgaaagatgctttcattgcaatgaagacctggacctccatgaggcaaaacagctgttacaggaaaagtagtcatagctactgtaccaggcaggatggccagcttgatcatcagaatggtctgatccataagatctctggttgtgtttaactgaaccctaggaatgaaactgaggagtaactccataaagctatcacttgatttgtatagtaggaaatctgcaggtcaggtgagcacagcctgagttgagccactatgatgagaaatccagggctcttattcagctctcagactcagggtctctttatgaagcagaagccaggtaagcctggggtaggcaacccactgctgcaagtcttcttcctagccttctccaaatgaactttccactatttacctgattttgtttttcctttttttgcagataacaaaactacccaaatctccttcactggctctctactctgtaaaaaataaaactcaaattccttagcccctttataattctgtccttattctttctctagacacaaattttaccacctgtacaacctcaacttcattatggccaaaatgacctaccaaattttctaagcaattttctctgtgttttaacttgtgtttattcttttggcatgaaactttcttttttctggggcaagaactcttttgtatatcacttgtttaactaggagatcagcaagccatttaattaagacttttcttaagtattcttgccattttcatttctgttcttggaagcagaagcctaagctctttctgccaaaggcttttatttagttctccagtcgattttattcttagtagggtcttcaaagcaaacgccttctcctttgtcttcctattgctatctccaaagggttccacctttctttcttttttttgagacagagtctcgctctatcgcccaggctggaatgcagtggtgtgatcttgactcattgcaaactcagcctccggggttcaagcaattatcctaccttagtctcccaagtagctgggactacaggcatgcaccaccatgctcagctaatttttggtagagatggggtttcgccatgttggccaggctggtctcaaactcgtagcctcaagtggtctgcccacctcagcctcccaaagtgctgggattacaggcatgagctaccgggcctggctggcttccacctttctaatttttctctccttgttctacgtatttacctcaagcaatccattccatccatggcttcaaatactaattgtaggtatctattatatacagcctaaatctttctaagtaccagactagagtggcctaatggtcaatgtcatatgaacttggttttaaaacaaggcttgaaatgaattctccaactctagtttttctcaactctcgctgaaaggccatccactcttaccaaagttatagatacacacagatttgtgtgagtgtgtgtgtgtgtgtatctcaatttttagacagtatgctatagaatttgaggattcaaatacaaagaatctttaagataatgtcagtattagcagatgagacacatttaaaaataatgaaaaaggtgattaaacaaggtatctaatagctaatggtgaaatgtactgctgtaacaattctggattttatacagggtaatatatgaagaaaatgaggtactccggtcaaataaatttgtcaatggacctagtagaaatgtctgattctaccataatatgttgtgtatcttgatggtgataactattttcactattgttgatatttttatgatacagcacaagtacctagcaaattagatacatctaacaaatgactgtttaattgtttaataaagtagataatttatctttatatttaataattttaaaagaaacatagaaattttttccagtttgagtgtccaattggttaacaatggtgaaaattagaatgtttaattttcccttattaaatacagtaaagttttatttataaattaataactatatattgccaggtctcacttttgcataaaatacagctttatggcataatgggagtccaggatttattataacaaataagatgggatttcaatatacactgaaatagattacagatttttaatatggtcacaatttcattttatatatattttaatattgaaaaaggacctaatagggcatatggagtaatgctgtatttaaagaagtctgtatttttcataaacttgcaaaaggatagtgctactgaatacaacatttgacttttttgcttaacagctactacttacattttaaatattctggggttaatgaatcactttccagcagatgagtagagagtattttataaacctctgaatgttccccttctgggataaaattaaatatactttgatccacaagatcagactgaaaagaaaattgttaaaagtaaaataacttcaatgattcaagagacaattgctttaaaagtacataatcgctattaaacacagcagttaactttcaattatctgtgaaaaccaacaaatgtcaagttatagaccaaatctcaaaaaataagattgagatcatactaacgtcatccaatccatgaccaatatgaccttgaaagcctgataaattatttgcaaagctgtgtttcaccaaaatgttctgaacatttcaaaatacaacgggaccaagagagttaataagaaaaatctctggcgacaagtcatagccttaccatatactcaaacctatggtaaacaatggtggtatatcctactataaaggactatgcacaagctaaataaagaggagattttgttttggtgtgatttcaattgtccaatgtgtcctttatttcatcttttcctggcatttatcctgcatcccattgtacaaaagccttgtgtttagttatcccccctcaaaaggacaactaatatgttaagcattagaattcttgttaatacacagctttaatcgtgattaatcaatagcaatttgacaaacatcaggttggctacaatgtgccacggctgtggaatcaaagatgaataagatagtttctatacttaagtaccactgataacaaaacttccatgactttacatttgccactacgcattctacctggtttcctgcgtttcaaactgctctgtggaatcctagggatgctgagacagtatctcaaggcctgtaaaggtaggactagagggtggggaagtaaaaaggagctgagaagcagggcccagggtcctgcccctgcattaaactaaagcagttatactttttgtttttattttatgcatctgtgaagattttgtttgaagagctccactgcttaaaaacaaaaaacatacaacaacaaacagaggcagtaagaatggtgagaggggagaaaggggtgttgtattaggttggtgccatacttttaataacaaaaaccgcaatcacttttgcaccaacctaatactattcttcatataggccacacattcccatcatttcttctgtcttttctccagccctccaagcccactccatgaagtgagatgaccttcccccctctctacatatctgtatctttcccctttcaaagaccagttcaaattacttctttcaagaaagcattcccttaacaccataatccacattaaaaataaaattcttttattatttattacttgtattattcatttcccatttagcagaattcagccaaccatggatcaaaactattcaggaaaaacaaaaaacagatggttgtgtctgtactgaatacgtgcatttttctaatcgttccctaaacactatagtataacacatatttacattgtattagttattataaataatctagaaatgatttaatgtatgtaaatgggaagatgtgtgtaagttacatgtaaatacaacaccattttatctatgcggcttgatgatccatggattttggtatctgcagcgggtcctggaaccaaccaattcccccatggataccaaaggatgactatattttaatgtctatgtcctgttgccctatagctgaataaaaggggcctatctcttacacctttatctttctcacttccaatcagggcacattaacaccgtgccttgtgtttaacagttattagtaaaataaatgattttagactaaggaggtatttgataatggcttaagggataaccacaccaaaaatatatctgtatttcagtaaaggatttttctggaagtctgaaaagcctctacaactaaaggagtgaactaaaaattcagggatggctgggtgcagtggtcatgcctgtaatcccagcactttgggaggctgaggcaggtggactgtctgaggtcatcagttcaagaccagcctggctaacatggagaaaccttgtctctacgaaaaacacaaaaattagctgggcatggtggtgtgcacctataatcacagctactcaggaggctgaggcaggagaatcgcttgaatccaggaggcagaggctgcagtgagctgatatcctaccactacactcaagcctgggtgacagaataagactctgtctcaaaaaataataacaataaataggcctgaataacacaaatgctagaaagttgccttctactgacaaaataaagaatcaaaatatagtatatgatattgatgcaaaaaataatctgatatggtttggctgtgtccccacccaaatctcatcttgttgttcccataatccccatgtgtcatgggaggggctgagtgggaggtgattgaatcatgggggaagttacctccatgctgatgttctcgtgatagtgagtgagttttcccaagttctgatggttttgtaaggggcttttccccttttggctcagcacttctgcttcctgctgccatgtgaagagggacgtgtttgcttccccttccgccatgactgtaagtttcctgaggcctccccagccatgccaaactgtgagtcaattaaacctctttcctttataaactacccagtcttggggagtcctttatagcagtgtgacaacagactaatacatcatcttaatagaaaaacatgccaccaacttgaaatattaataggaactaaaattttcatttttgagaatgattatagttttctactattatttgttactaacaatttcttctactactatttggtaaattatgatgtgacctatcttatccttgttttttcatctataacttcataggatgtttcatattcatagagaaaagaaaatgaatgcctgtatcaagagtagtatgatcacaagcaatgcctgccccaacaattctgcctctcctgccactttaataggtgtcaaactttccattaaccactacacttaaaatctctaaatgaggctgaccatactttatgtgaccatacatacactcagttctcaaacacaatcaaacgtaagaaaagaaaatggtaactacttggatctttttatctcccttactcgtttcatgaaaaggaaatataagttctgctgatttacttatatgacataaatcagtagcctttgttttttctacattaggtcaacgttaccatttagtgattggatgacacaaacaattttttaaaatctagaagatgttaataacagaggaaactgggtatagtgcacatgggaattctctgtactaccttgtccatttttctgtacatctaaaaatggttctaaaattaaaaatattttttaaaatgtccagaagaaaatgggaaggtgacagggtttttattgagggaagtgttaatcaaacacttcaattccaatgagatctatcacatgttgtctatttcaaagggcaattaaactcactaaagattagaaagggatttttttaaaacagtcaaatcaagtagcacactcattttcatacattcaacaaataatcactgagtgacgctccaaggaactagctagctcctctggatgcagagataaagttcctgcctttaagaagctacaactaccataactatccaaataaacagaaaattataattctctgtatcatgacagtagtacatacaaggtaacagtagaacagagatgaagggcatcgaattttgaatggaattcaagcaagtgccaagaagcaggctttgagaaagtgtgaacacattgcaaatgatgctctatgactagattatatagtttctgtaaacatgacaaaacctaatacagttatatatggtttaaaagcatacaattatacttattttaaattacttagacattatcttaatcctataatgggattctttccctgggttttcttgctatgaaaacaaatttttttaagttgtccagaaaactcagttaatcagtctgtccttttttctgcctatgctagtttacttatgcattgctaatatctcatgttttactctcaaacatgtttttaaatgttgggcttatcctactatttgagcttactagaaaataaagccccagaagagcagtaaagtcaaagttattttctgtatgaaccaaagaaattagcaaattatgtactgcatggctttcaactttaaaaaatgcccccttgagagcctggacttttaagtgctaaaatccattgattctctttataaggtatgaagtatcagagtaatcagagggagagaaataccacttttcagtatctcttgaaagagacacttacaagcagaattactttaccctgttatagagataagctatttttttaatttttttgtagagacaggatgcttcactgtgctgcccaggctggtcttgaattcctggcctcaagcaatcctcccaccacagcctctgaaagcattagcattaaaggtgtgagccactgcacccagagagaggcattataagagtagtttataagtaactttagaatatttataccatgagctccatcttcaataacatcattacatattaaaaactgaaaactccccccaaaagcctatcagctgtggcacagcacctagcatggtgtctggcacagagcagatattaataaatacacattagaaaaaaagtaagcacataaaccaggtattcaccatcctaatgaaacaaaatatacttttctaattctctatccttctggtcatatagataatgaattaaaatatggccaatatgacattatcagttcaaagtcacatagcataaaaagttctgtatctactatttttagagtgttttttataagtaattctattgagaaaaatatttacaagttgccctaattgcaacaagtatctcagcagaaatttagttattctcaagacattctcagtgatttaacattttcaacaggctgattaaaatggaaacgctaaaaagttagcattagaataaagaagacaggaagaagaggggtcagataaagtggtaagaccttgcactgcataacaatgttttggtcaacattggactgcatatatgaccaccggtggccctaagattacagtggagctgaaacattcctactgtctagtgatgtcatatctgttgtaatgtcatagatcaatgcattagtcatcctttgcacttgtgcttgtggtgatgcttgtgtaaacaaacctactgtgccaccaatcatataaaagtttagcacataaaattatatacagtacacatgtacatgataataaacaatcatcttactagtttatgtatttactatacttttaatgatttagagtattctctatttacatttttttttttttgagatggagtttcgctcttgttgcccaggctggagtgcaatggctcgatctcggctcaccgcaacctctgcctcccaggttcaggcgattctacaggcatgtgccaccacgcccggctaattttgtatttttagtagacacagggtctctccatgttggtcaggctggtctcaaactctcaacctcaggtgatctgcatgcctcggcctcccaaaagtgcagggattacaggcattagccaccacacccagacttatatatatatttttaagttaactctaaaacagcctcaggctggtcctttaggaggtatttcaaaagggcactgttattacaggagatgactccatgcctattgtttctcctgaagaccctccaatgggacaagatgtggaggtggaggacagtgatgttgatgatcctgaccccgcgtaggcctaggctaatgtgtgtatgtttgtgtcttagttttacaaatgtttaaaaagttaaaaaaagttttttaaatagaaaaaagcttttgaaataaagacataaagaaaggaaatatttttgtacagctatatgatatatttgtgtttctgaggcagggtcttgctctgtcacccaggctggagtgcagtggcaccatcacggcccactgtagccttggcctcctaggctcaatgcaatcctcctactagagcctccggattaactgggaccacaggtgcataccacgacacttggctaatttttatgtttttttaaagacagggtttcaccatgttgcccaggctggtctcaaatgcctgagctcaagcaatctgccagccttggcttcccaaagtattaagctaagtgttactacaagagtaaaaaagttaaaaaaaaattttaagtttacacagtaaaaaagttataataagctaaggctaattattattgaagaaaacatttttatataaagtagcctaagtgtacagtgtttataaagtctataaaggtgtacagtactgtcttagtccttcacattcacttatcactcactcactgactcacccaaagcaacttccagtcctgcaagtttcattcatggtgagtgccctatacaggtataccattttttacctttgagactgtactttttattgtaccttttctatgtttaggtatttttaaacatataaatactgtgttacaactgcctatagtagtattcagtacagcggcatgctgtacagattgtagtctaagagcaacaggctatatataccatatagcctaagtgcgtagtaggttacacatcgaggtttttataagtatactctatgatgttcacacagtgacaaaagtgcctcagaacatattcccattatttagtgatgcataactatagttgaatattaagttactacagattagttatgactgagctgagaaaacacatgctgaaacaaagacatacttagagctctgattcctacccctttaacgactgttgtacactgctctcaaagtccacttcccagtgctttagaatatttaaaataggcattttaatacgaagtagattgtaggatctttatacttactggtaaatgttcaagtaatgaagttacactctcagacacatatattatgcttccatctgtcatgattgctaaaaaaaaaccatcaagagcctgaaattaaacataatgatatgttaaatgaaaagaaaaaagtattttgcaggacagaaataaaaatttgagataaatgacaaaggatttaatatggaaatatccaaagttctgtcaaaatataatactagctttccccctttacaataccttggtatgtatctttgttcatttttaaatgcttctggagaaaaaaagtctctctctggccatctattggacaactggtctctaaaagatagagacaatgttctaccttcatcactaggtatattacatgatccaatcatgtatatacagtattatggcttatttgaagatgctaatgtctccaaagcatacaagacatcaacaatgttttgtaggcacacaaaggaatactttgttattatcatggatatgttaacacagaggtgtacatctgaagtttaaggagatatatgaagaataaaataaaagggagtagcaggaaattaaggtgaaaaattaggctgagttcatatcataaaaggctttgaatataaggttaagacataagaattttattccgtatacaatggtaagccaacagaagattttagggcagggggctgtgcttcaataagagtagtgtggaagcagggtgtaaaatggatttagagggaaaagaaaattcagttaggaaaatcatagtggcttttggactaattaaggaagttaatgggaatctgaatgaaatcagtagtattaggaataaagaaaagtacttcgagcaagcattgagaaatgtgaagttcgatttcagaagagaagtcagagcagggagtacaagacttaataaaaatgcaattttgtattttatacactacaatgtattttcatttgagaatcctaggcacagaagtgacagctgaagaaatgagatctacaaaagacaaatcctggaagaattatctacatataagggatgaggaagagaaaaaggccagagaaaatgacagagaagcctgcgtgcagtggcttacgcctgtgatggtagcaatttgggaagccaaggcgggaagatcacttgaacccaggagtttgagaccagcctgagcaacatggcgaaaccttgtctctgaaaaaaaattaaaaaattagccaggtgtggtggcacatgcctatggtcccagctgcttgggaggctgaggcgagatcacttgagcccaggaagttgaggctgcaatgagccacgaccatgtcactgcactccagcctgagcaacagagtgagaccctgtctcaaaatagtaataaaaattgaaattacaaaaaagaaaatgatagagaagacagaatacactgtcgtcaaggaatcaatggaagaaagaatgacaaagtgaagaggagaggaatggtttggtataaaatgagataaagaataagaaaatgagaaatgaattttggtgattttcaaaaagttatgttaacaggaaggcaagtcggactacaatgagtttaaaaatgagtacaaaatcagaaggctattacaagtcactcattcatgaactttagaagggaagaaaaaggcaaacagttctaagggggtgaagtatcaagagaaggcatttgaaaaaagagcaagtatatttgtagtctaagggaaaggaagatccagtggagaagaagtagaagatacacagcacaaaagatactataaaagggattcttctattaaaatggtcaatacactaaattctaatttcttgtttacttaaatggctctcgaaaaggatagtgacctctgataggaaccatgtatatcttattaatccttgtatctgcagcactagtgtagcgcaagtaaaaatacttgcagtatataatttatagagctgggagttagagtaacctttcctaactctatgtaattgacgaatatatagaaaatggtcccctcccccttgtccccccccttcttttgggaaagagatctggatatcacaaagaacttattttaagtagatgcctatcttctagaatggctcaaacaaacccagtctttgctaatatagaagtagaaatcttgtcattcgagcaaactcatgaattatttttttaaatcctttagtacaataatgccagtattattatttcataatagggtcaaaagtagacaactgttcgccaggcttacacctgtaatcccagcactttgggaggccaaggttggtggatcacctgaggctgagtttgagaccagcctgaccaacatggtgaaagctcgtctctactaaaaataaaaaaaattagctcggcgtggtgacacatgcctgtaatcccagttacttgggaggctaaagcggaagaatcacttgaatctgggaggcagaggttgcagtgggcagattgtgccactgcactccagcctgggcgactaagcaagactccgtctcccaaaaaaaaaaaaagaagacaagtgttcctcaatttccccatctgaaagcaagaaacagatactattgtctacttcataataccagctattatgacacacagatactagtgtttacttcataagagtattgtaaggattcagtgagttaatatataaaaattattcacttatttttctgatttaaagtacaggtttaaatgtttataatatatttatactctaacaaattttcgtatggtaacatttctgctgaatacataaagaattaatcacacaattaattgtcccatctaaaatacaaacagaaaaataactcaatttgcaaaatactctaccttgcttcagacttgagacgtggctataatctatttatacaggcataccttgttttattgtgcttcgctttattgaacttcagttactgggttttgttttgctttttgttttttcacaaagtgaaggtttgtagcaaccctgggtcaagcaagtctatcagcatcattttttttaatagtatgtgttcactttgtgtctcttgtgtcacattttggtaattcttgcaatatttcaaactttttccattattattatatctgtaatggtgattcgcccacataaggtggcgaatttaaatgttgtgtgtgctctgactgctccaccaactcactggccattcccccatccctctccctctccttggagctccccattccctgagacatacaacaatactgaaattaggccaattaataactctacaatggcctttaagtattcaagtgaaaggaagagtccctcatctctgactttaaatcaaaagctagatgtgattaagcttagtgaggaaggcatgtcgaaaactgagacaggccaaaagctagacctcttgcaaccaaacaagtagcaaagttgtgaatgaaaaagaaaagttttagtgaacacatgtatgataagaaagtgaaaacagccttattcctgatatggagaaagtttgagtggtctgtacagaagatcaaaccagccacaacatccccttaagccaaagcctaatccagaggccttaatgctcttcaattctgtgaaggcagagagagttaaggaaactacagaagaaaagttagaagagaacagaggtaggttcatgaggtataaggaaagaggccatctccataacataaaagtgcaaggtgaagcagcaagtgctgatgtagaagctagagcaagtgatccgggagacctgggtaagatcattgatgaaggtcgctacactagataccagagtttcagtgcagatgaaacagccttctattgggagaagatgccatctagaactttcgtagttagaaaggagaagccaaagctggcttcaaagcttcaaaagacaagctaactctcttgtcaggggcaaatgcagctggtgacttttaagttgaagccaatgttcatttgccattctgaaagtcccaaagcccttaagaagtatgccctataaatagagcaacaaaccctggatgacaggacatctgatgacagcacatctgttgacaacatggcttactgaatatttaaagcccactgttgagacctactggtcagaaaaatagatttctttcaaaatactattgctcgctgacaatgtacttggtagcccaagagtgctgatggagatgtacaaggagattaatgttgttttcatgcctgctaacacaatacccattctgcagcccatgggtcaaggaataattttgactttcaagtcttatttaagaaatacacttcataaggctacagttcccatagatagtgattcatgtgatggatctgggcaaagtcaactgaaaaccttctggaaagaattcacccgtctagatggcatgagaagatttctgattcatgggagaaggtcaaaatatcaacattaccaagagttaagaagaagttgattacttgtggataactttgaggggttcaagatgtcagtgaaggaagtaactgcagatgtggtagaaacggcaagagaattagaattaaaagtggagtctgaagatgtgactgattgctgcaatctgctaataaacccgaactgatgaggagttgctccactgatgagtaaacaaagtgatttcttgagatcgactctactcctgaagaagatgtgaatactgttgacatgacagcaaaggatacagaatattacataaatttagttgatagagcagcagcagggtttgagagtactgactgtaattttgaaagaagttctactctgggtaaaatgctatcaaacagcactgcatgttacagagaaatcttgaaaggaagagtgaatcagtgtggcaaacttcattgctgactcattttaagaaattgccgtagccaccccaaccttcagcaaccaccaccctaatcagttagtagccactgacactgaggcaataccttccaccagcaaaaagattaagacttgctgaaggctcagatgattgttagcattttttagcaataaagtatttttaaatttaggtatgatcagtattttttatataatgttattacacacctaatagactacagggaaacaaaacaattcatgtgactcattttactgaaatattagctttattgcagtggtctggaactcaactcgcaatatcgccaaggtacacctggatattaagtcaccctgtgatttcttttttgaggaaaataaaactttcaaaaattaaatctggacatacctctaacattaattgtgtaaactcttcattactaaggaatgtaggtttccagtcctgtcgaatttcactagcatctgactgtgcagtgatttctgtaaacagattgacatattagtggcatactccaaccaccggaggagtacaaaagccctacaagttatcttgtctcttcccattctaattaaagatgacaaccgtaggcattaacatttattgggtagatatcaagaggtccaggttttggtatgatgaaatatttgagataacatggcaagttatctccttggatttggtctcttggtaataccagtctcttcggtttttctcttggtactctgatagttatgttgctgatgggcctgagattgcttcctatttgacacaatgaccaaagaagatttttgctccaagaattttgaagcaattctttttttccttttccttcccttgccattcaaatagcaatgtctagagcagcactagggaaattagctgaaaaaggccaaagaggtcactaggtttgctttcaacaaagaatgccttaggcctgcctactgctgggcaaaaagcttcttcccaacattaagtgctctatcttaattaatcaaagagactaaattaatattttatgcaaaaactttactacagtaatattcccacagtgatttttcttagtgtcctccttgtacaacagtagagagatggtgaaaaatttggagatccctgctgtgggacatatgtttgtcacaattattaccattttatttcactacatacttctaatagatttagttatgaaaaagctattcataaatgatgaaacctagtaacaaatgtttttctattttttaatgtagacatattaaaacaagcaggcagaataaaaatctatgtcatagactatattctacaaaatatactctaatttgtagtaagaagtataaactaaattctgattttatcatcagatagagaaatacagcatactgtccctcatcaaaagttagcatattagaaatgcctgtagtggaatatgaagagtaactaagaagtagagctactaaatgtgcggaatacagttgtgtttttcaaattcacatcaattatatacatttgggaaaaggatttaaatccacaaacaaatccaatcaagtttcattaaacataggcctattttaggatgatacatatataaaatccttttaccttaacagaaatactatttttgtgagaattatgtatctgattttgaaaaaaaaaattacctaatgccacaattcatcctctattgacggggaaatatatgcatttcatttcattcaacaaccatttattgaactcctagtatctttggactggtttcaatgagtgtgccatttaacaataggcactgaggttagtgagatactatctgtagaggtaaaatgtaataatagtggtggcaataaatattgacacatttacgaaagaatcaacagaatttggcaactgtgatatggtgctaaggaagctgaaaaaaaatcctaaaattttttcaggtttaagtcttaggtgactaaaaggatggtggtataaaaatgaaaaaaggcaagttaagagaaagaggtaacttgacaaaatgaaaataaattcaattttagatgcactgagtttgaggacatgcaaaagaaagatctagaagttatctggaaatacatggctaaaatgtttgcatctaaaaatagaaatctggtaggttaatagagacacaatagctgaagctatggaatgagataagcaagagaaagagtgtacagaaagcaagagaacaaggataagacttaggaatgtcacatttagagggtagaaagagaggaaagaagttagtttcagttagaaaaggggaggagaaagtacaatataagggaagccaagggaggagggataaaaatttccagtgctgtacagatgcagaagaagatgcggtataagaaaaagctattgctttattgagggataggaaggtaatgtcattagtgaaattaacaaaaacactttcaacgagtggtggagcataaaccagtcctgtaaggcattaccaactgagctaggcagaagtaaaacagaggcactaattactaactgtcctgagttttacagtttcatttgcatttgaaaaaggaaatttccttttacaggttttttttaaatctattattatctgttaccaaaatacttaatattctttaaattttctttccatgactcatttgtcaagatgattttcttctattaacaaatactttattttatagtgttgatttactagatatacattgaaaccttttaaaatgacacataagaactttatactatccagctttttcctttctttcaaatacacccataattttccaacacaaacatgcttcagtgacaatgaagtctccctgcctctctgcttttgcacatattccctttgtgtgacatgctgtcttccttaatctaaaagactcagttgaaaaatcaactattttaaaagtctccctgacatactctttcctgtgtttttgctgcaaacagtttacaagcactactcacatttgtaattatgtgcttacatgtttgtctgccctggcttgacttaacttcaaatccaggactgttaccctgcatcatgaggatttagcatgtagtaggcacggaataaatgtttgttgaatgaaagaatgaacatattaggaaaccttttaaaatgcaattgatttctctctcttaaaaaagccaaggaagcatccaatcttaagcatctctgccaagattctaactaatgctttgagagtctgttccattttacagagttaaaaatttacctttatgttttcgtaaaaaatcaatgcttttctgcagaacagtagatttgtccatctttctagcattaccaggaagcatggatcccagttctttaatgagaacattaaattgatctctacgtttcttttcagatttgtttctagatactctgatgaaatgaaaaatatgcattttttaaacaatccatttaattacacaagtagtttaatacaatgttaatttagacatgacacagcatgtacttctatcaacatagatggtaacaaatatcttccaggttaccaatatacagttaatttgggcaataatttttcagctcagtttattactaaagaaaattttacaaatcatacatttgacaaacatgtttttatgaaaatgccaataagaaaaactgcattcaaatcacaagttttattcaatctaatacttccagtgattgttaacttacatggttattataaatatatgtactaaatgaataaagacgctattctatgtgaagcagtaaccagtaaacaaacagctattgagaaaaacttgattatttataaaacaatcattttatgatacctgtaattatctgctttgaagtcagattttctaattcagtttctgtttaagcaaagcataatacttttccaaaaggtcagaagatatttaatttataaactacataccaatattctaagttcttccaccttgctaatatatctaaactcctaaagcacatagcttttggaaatcatttattcactatttatttaccattatatttatctattattcattcatttactattttatatctctaatcaaactaccttttcgctttgtccttgtcatcttcttccaccaacccatcaaaaatactactgtcatctctaaaagaaagcggatagagaaagtaagagcagactcactaagcaacagcaatactaaagtgacatgtaaatcaactcagttatgccctatgatttttgtaaagttaatgagttataacattcaaactactaacctatttcctagtaaacattcaaaaatcaaaattcagtaataattatatttttaagcttattacataaattgtaaaagtatttatacttagctatattatgaacacatcatgctaaacaagaatttaaccagtttaaatatcttgtttcaaacttttagtaacggtaaaaacgtatagaaagtcagtgtttgccattatataaaattatttttaactataacagcataatttaaattttttcttagatatttactttctaaaaccacaattactcgtaaacatcacaatgtaatgcattaacttatattaatacatttcattcatttactaattcatttgacaaatatgtattagcactcatgtgctctgttctggacatgtttagtaagcaatgaataagacatttagctgctttcctacagtttttccttctttttcctttttttctggagacagggtcttactctgctgcccagactggagtgcagttgcacaaacatggctcactgcagcctcaacctcctgggttcaagaagtcctcttgcctcagcctgctgagtagctgggaccacaggtacatgccaccatgactggctagtttttttatatttttgtagagatggggtcttgctatgttgaccaggctggtcttgaactcctgggctcaaatgaccttcctatctcagcctcctaaagtgttgggattacaggtgtgagctgccgtacccagcctcattttctagtagatagaaacaagtataaaaatgggagatgaggctaggcgcagtggctcacgcctgtaatcccagcattttgggaggccgaggcgggcggatcacgaggtccaggagatcgagaccatcctggctaacacagtgaaacccagtctctactaaagatacaaaaacttagccgggcgtggtgatgggcaactgtagtcccagctactcaggaggctgaggcaggagaatggcgtgaacccaggaggtggagcttgcagtgagccgagatcgtaccactgcactccagcctggccaacagagtgagactctgtctcaaaaaaaaaaaagagatgagttttaattttttttaaaggggtgatgttttagtaactgcagtctgagcggttagtgggggacacgtgagctaggatctaagtgacaagaaggggctggctatgggaagatgtaaggaaagaccattcctaaaaaataaaatcaagagcattggtggctaactcaaccctaggagcaatattaaagtttctgctgatttatgaagttttacataaattccctattcactcctttagccacacctttctatggcctataaaggcctatatgctataaaatggagtcactattgagatcacctgtaacactcatatcatggtggaggtgcatgtatgaacttggggattccatgtaggccctgaaatttataaaaaattgttatatgtatatgaattttccgagaacagagttcataacttccatgacattcagagataaggaacccatattaataatcactgctttatgtctgaaaatacaaatgtcatccctaggtgtcatactatctagaatgggaaaagcataatgccaaattcatattttatccatcaaaggcagtgaagaaatatcttttccaagaaaaagactatcattaattccgcctgtaactatggcacagttcaaagctattgacatggtgcaggcaggcttctttaaggaagtttcttgctcctcacatcttaagttctggtggagtatacatctttactatctagctcataaaaagggagaagagctgtccccagatgtcaaaagtcacttctgtgtacaagtctagctgcaaaactcttaaagaatcccaatggatggagcacaccgaacagtgcaataaacgcattaacaactttaatgtcagacaaaccaacacaagtaaaaattccagatcatatcttactagctatgtgactttaaacaagttatttaacctctctgacctacagttttctcatttgtaaaatcttgcagaattattgaggttaaataacatgtaaaaaagtattctgtacatttgctgtcagagtagatgctttaaaaatgttgttggattatatcaaatttaagatattattgactgttaagatcaccactattttatgtgcccttaagaaagaaaaaaagagtgctaccaattaaattatgataagagatgctaaaatgtaaaaaacaaagacaacttaaagtcttttcttttctacttttactttaggttcaggggtacctgtgtaggtttttcatgcgggtagactacgtgtcgctgaggtttggtgtaccaatgatctcaccacccaagtagtgagcacagtacccaatagttttttaaccctcactgcccccttccaccctcctccaaaaatttcaagtattaaaatcaaaggaatatggagatttacccttttcccaagagtatgatgtaaagattacaattttaactaatgaaatcctaattatagttacttcttatcagtcacaaatgctaagatgcttgaagggatgaagttagataagaagaaaaaggactccagaaggttccaaggaaacatttgcaactgtcagaatttccttcagagcagctatgaccaaatcactaaaaattacaagtcaggactcatttaaaacacacaagccatatgctgctgactttgcctctggaaaatactgatataccttacttatttttttatactatatttgtttaatacagaaactgaatgcaatagtaattatgtttaggcataaaattccttctatcaatttcatatagaccattattctaatagtgcattttaaaataattatatataacttaaaataagtcttcaaaaacatacctgtcaacaatcgagctcattttactacagcttacggtaaacaacataacatactacgttttcgtcttgtagtagacatttgtacttctccttaggtgaaaagaaaaataaatggtcattagttttctaaaaatgttacttccacaaacttatcttgagaaatactatatgttatcacagagacttcaaaacgttttgtttgtactgaagatcagaacattattttcaagcaaatacctatggctgaggtacatttgaggcttcttttcccctcctaaaaaacacctacaagaaaaaaagtaattcaggctcatattaactttctctttactatcaatcaaaataaaatggacattctcaatattcagtatatatttgactatataactacaaatagtctgtaataacaccatctattcagcaataaatatttgttgaaagcctattttctgctaaacagtacagcaggctttgggcacataacagtgaaagacacagtccctgtaggaaaaatttgcaattgagcaggaagatagatatctaaataattataataagaggtataatgaaggtatatactgtgtaatgctatcactgggcaaggaacaattatgtctacccgtgggaattagagaggggaaacgaggaaatattcttgatgacagtaagtctgtcagggagtcaaaattcttttttaatgcaaatatggtgcagggatgggcagcatcaccatcctctgagagcttgttttcaaaggcaaaatcttaatgaaccagaatctacattttcacaagggctccacgtgataatgtatgaccacttaagtttgagaagcaacaggctggaggacagaaacagataataggtgaaagaattttaagcgacaggaatggcaatttgtaaaggcacaggccttagtgagacaaaagaatatcgtatttgagaaactaagaggtttagcattttccttatgaaaaacctgggatgttacaatttaaagttataattactagaccataaagtttgagaatacaagtggtaaactggcaaaggcaagtcaagtacaggagagtcttactataaagagtctcatacccaaattgaaggaagtaaaacttactgctttaaagctggatcacaagcctaaaatttgtctctctatattctataggttgagtatccctaatctgaaaacctgaaatccaaaatactccaaaatctgaaagcttttgagcatcaacataatgttcaacattcaaaggaaatgctcaacggagcatttctaaaccagagaagattaaagatattacaagaacgtgagattctaaacattcagtcactgttttcaaatgcaccttcatgaaaggaaaggagaataaccctggcaacattgctgcattgcctgtatggttatggctgcagaagtagaactgtgaggggctcagaatatttttttttctttttgtttttgagatggggtcttactctgttgcccagggtggagtgctgtggcatgatcatagctcactgctgccttgaaatcctggcctcaagcaatcctgccacttcagcctcctgagtagctgggattacaggtgctcgctaccatacccagggctaagagttcttaaaagaaaatgagtgacagagtcaaagatagaaataataaaataaaaaggactaacaccaggatgaaaagttgtgattttaagtgtctgaggtagtatcagcagatggaacacagaactacagaattttagaggtagaagagaatttaaagaccacctaagtacatttctctggtccaacagacatatttatcttcatggtaagaagtgaggctgattctatcactagaagaggaagaacagtataaaagtaatagggcaaatttcagtgaattcaaaaagaattgttaagagtaaaaagttcaaaaggccagatctgagccttataaggcacccagtaagtatggcttaattatcaaaaggtagaaaataagacaaactaccaaaaaaagggcagggggtggtggcggggactaggcaacgccaagaattaagggttatactacaggaaaagccttgctgactactagaagggtgaatccaatatagtttagaagatgcaggctgatgctttattaggctgttttactattgttgttaacaatattcttccaaaaattatttgtcgtccagctaatagaacaacgtaagatctctctctctctctctttttttgagacagggtctccctctgtggcccaggctggagtgcagtggcacgatctcatctcattgcaacctccgcctcccaggttcaggtgattctcctgcctcagcctcctgagtagctgggattacaggcccagaccaccacaagccagctaatttatctatttttagtagagatggggtttcaccatattggtcaggctggtctcgaactcctcaactctggtgatccgcctgcctcagcctcccaaagtgctgggattacaggtgtgagccaccatgaccggtcagatataactcttaacagtctagcacaagatcttcatctttccagccaattgacatacacattttacttaagggaaaggagtaagtaaaataggctggacatgcaccctagagcaaatgttagaagatttccctaaacttttaaaaatggtgtcaaattaactttaacaagacaaactggtaaggtggaacagccaaaatactttgtttgcagactactgcaagtcccacgctttcaattcagaaagagactagctagagtcacacttgtccatgctgtggagtctaaggatacagatgccatgccacttccctacacaagctgaagtggaatgtcaaacatataatctaatatagaatacatttcattattttttaagttcgacattagaccacaaagatatgcaatgtcttcaaaaggatcagttgcagttactggaatccaaaattcaccagttttatttaaaaaaactaaaatagtataattggattgtttataacacaaaggataaatgcttgaggggatgacatcccattttacatggcataattattacatattgcatgcctttatcaaaacatctcatgtaccccataaataaatatatatactaggtacccacacaaattaaaattaaaattaaaaattccaaaaaacaaagttccccaactataaaggatcaagttacagctaggaatcaaatgctcctttacttaagcaacttgagatcagagtcatctggtgatatgacttcccagctcaacatgtatcacattactattttattcatacacatgcacatttccccaatttctcaatatcataattttggttaggtggttatatttggagttaacatcattatgactccgtaaatgccaattcacagctaagccatatagtatactataattacttttccttttgagcagtttttcctagagttaccattttgttgtttacctagttttgtttatacttactaccaacttaactacaaattcttccctgtctgtatctactatttcttcaaacacattacacattctaccaatttcaccttctcacagtagtatctctagaaatcttccaacctgtttctattgggactggaaactatctactaacctgaggacaagctgtcttcttgtgatcattattcatcatcatcctggtgattccctgggtctctagttaggtcatattccctgttacttgtatcctatgccttcatcttttttagtttacttctttatttttgttgagtaattcctccaataactgcctaagaaaggggacatgacaggtaaattttttaaggcttcgtaagtctaaaactgtcattagtctatccttaatcaacagtttagttggatactgaatacctggttgaaaatcacttttccttctgaatgctgaagactccactatcttctagcttccagtgtggtgtcaagaagtgcaaagccattctgattactgatcctttagatgtgacctgttatttatttcactctggaaactcccttgttttctaaaattgaacagtgatgtgccctgttttggctttttatatctgtactggtcactcaacaggcttttcctaactggtaactcatgtcctctaattctggagagttttctcgagttgttctctattctttgtttttcccctctgtttcctctctctccttctggagcacttatttgaacattggagatcctggacagttgtaattttcttattttttctctaccattttccatttctttggctctttgctctactttcaatagattttatttttcaacctttccaatgaatttttcatttctaatttcatttcttactgtttctcgttcatacttcatggatatagcatccctcttacctttatgtaaggtttgtgtttaattttcgcccacctaactgctctccatttcccctaacttggtgttttaccttttggtttggcctttgtcttgcacataagaggtttttcctcagctgtctactgatctctgaacatgagctcacatttaagggtaagcgctaaaaaaactgaagctctgtgtgatacagcttgctgactgttaactttactgtagggctatcaggttgaaatatttctttggggaattctcaatgtcagaatctttagatcttttaagatgattataattcagagaaaataattatgtatcttctcaactcttgcctgaagagtataaaaacctggtaccctgggttcttaacccttctatttttaacatgtcacccccattctcagccatgtttgtggctcctttattttatccttactagggaataaatctccagacttctgctaagataggaaaaaggtggctgccttggttccaaagttaagaaaaggatccatggaatataattaccccttaaacagatttgcaacaaatcatcctgttttagttccaccatcactcctatttccagaaatagttttcaattcatgaaaattatagaggttctacagtgccaagaagtttgtttcagctttcccacagcaggcttaggatcctgggatttgcaagaaagttactatgctcccttttgcagtcccaaattttgttgctactgtttcttctccattctctctgtcctgttatgtctttcgtaaaaatcttcttactttagcttcagtgaggtttcaagagaaaataaaatttaattgtattgtttgccatctctagcagtttcccatattctttcatcactcttaattaggctttcatccccaccactccactcaaattgctcactcttattagttatcccaaatctccatattgccaagtctaatggctgttttattctctatttgaccgttaagcaatatgtgatgtagacgaccacttctgcatttattaaataccttcttttcttgattccagtgacagaatattctcctgcttttgtactcatcttgctggctgctccttctcctctaattaatactggcatgtgccagggctgaatccttctaaatctgtatacacttcctagataaatcacacttctacatgccaatgactcccaaatccacacccctagaatagattgtcaaatgcagtcagatatccaactgctttttagacatttctacagattttaaaggtgtccaaaatgtcatatacttaaaacagaacacttaactttcttctgtaaatttgcttctctcccagttttttcccccaacctgatctccatatattctccccatcatttactgtattccagtcacattatgctctttatgttcctcaaacatttcattgtctttcttgttctcactatctataaagctcttctctcagatcttcacacagctggctccttttgccattccgatctcaattaaaattcccctttttcaattaggctatctctgactgcctaatgaaagcagtcaccagtctctaccacattatccttttttttgtacacgtaagacaaggtctcactctgtctcccaggctggaatgcagtgacacaatcacagctcactgtagcgtcaacctcctaggctcaagtcctcctgcctcagcctcccaagtagctgggatcacaggcatacgtcatcatgcccagctaatttctaaatttttggtggagatggggtctcactatgttgcccaggctggtatcaaacttctaggcttacacaatcctcccacctcagcctcccaaactgctaggattacaggcacaagccttacagtgcccagccttacactatccatttatccattttaattctctgcacagtacaaaccacaaatttctcacttgtgtattatttgtgtttctcacttgtgtattattcttcttctagaaggcggttctcatgacagcagggacagcttctgtcttgttcatcactgaatccccagtatctaaagtaattatcggaacatagctggtactacgtttggtggtaaattaacacacaaaaatttttttaaattaaactttccttaaattagtgtgtcaaaatagttgatgaattcttttatttttctggaaaaatatcattttacgatgcattctaagatgcacctttctttaccttttgtactccttggatcttttaaactgattcttcaggaaactataggttcaaggtactcttctatatgaccaaccataagtctcagaattctgtttaaacaagaaaaaatgttagatttattcaacttacatagaagtttatcattaaaagggttttaaaataatttttaaaaataaaatttagaactgtcacaaaaatgtatataaccaattttaaattctataaattgtttctaaaagaaaacaaaataacttaaaacatgaataaactaaaacaatcacttaattctggtacagaagttaaaagataaaagtattaaaaaactgtaactataaaaatgttaatgagtatacaacataaaaggataacattgtgacatcaataacaagggaagagtaagaaagttacatttttatatgcaattgaagttagattgttatacgcttaagacagactgttttaactataaggtgtttttatatataagccccatggtaatcacatgtgaggactgacacaagaaaatgagaggggagtcaaagcacaactacaaaaaataaagaaagaaagaaagaaacacagagaaaaacaggaggaaaggaaaagagggacaacagcactacaagaaagacagcaagcccttctctatcagtaatcactttaaacgtaaatggattaaactcctcaatcaaaatacatggagtggctgaatggatttaaaaaaaaaaagaaagatccaactgcatgttgtctccaagattcacctcagatttaagaacagaagctgaaagtgaaagaatggaaaaatatatcccatgcaaatggcagcctaaagagtataagtgaccatacttagataaaatagatgtaaagtcaaatacaagagacaaagaaggacattatatagtaataagagtcaattcattaggaaaatatagcaattataaatatatatatatatacacccaacatcagaggacccaaatatattaagcaaacatcaatagaactgaagggagaaacagcagatacaatagtagcaggagatgtcaataccccactttcaataatggacagataatccaagagaaatcaagaaggaaagcatagatttaaacagtgtatcagtacagtcatcctttgttatctgacatggactggttccaggaccccccaccaaatattaataccaaaatctgcagatgcttaagtcccttatataaaatgatgtagtatttgcctataacctatgtgcctcctcccctatactttaaatcatctctagattacttataatgcataatacaatgtaaatgtgatgtaaataggtgttatactatattggtttcttaaatttgtattatttgtaaatggttttattctctgaatatttttatccacagttggttgaatccacagacgtggaaccttcagatgcagaaggccaactgtatagaccaaatggacctaacagacatacacaaaacattccacccaacaacagcagaatacacattattctcaagtacacagagaacgttctctaggacagatcacctaatagggcacagaacaagttttaacaaatttaaggttgaattatactaaatatcttctctgatcacagtgaaatgtcagaaggaaaactagaaaattcataagcagatgaaatttaaacacactgttgaataaccaaagagtcaaggaagacatcaaaagagaaattagaaaacatcttgagacaaacgaaaacacaacataccaaaatgtatgggatgcagcaaaagtgttctgacagggaatcttatttcagtcaatgactgcattaaaaatgaagaaagattcctgcaggtgtgctaaaaaaaaaaaaaaaaaaaaaaaaggaaagatctcaaacaatgcaactttatacctcaaagaactagaaaaagaagaacaaagcccatagagagcagaaggaaggaaatatgattagagtagaaataaaacagtgaataggaaaaaaaaaaaatcaacaaaactaagagttgtttctttgaaaagactaacaaaattgacaaatctttagctacactaggaataagagaagactcaaaatcagaaataaaaggagaaattacaactgatgtcacagaaataaaaaagtatttttttgagacaactcaataaatatacaccaacaaattagataacctagaaaaaatggataaattcctagaaatatgccatctaccacgaaggctgaatcatgaatagaaaaatgtgaacagagttcacagcagatttattcataatggtctaaaactataaacaatccagatgttcattgacagtacaatggataaacaaaatgtggtattcatataatggaatgctatacaacaaagagaagactgcatgcaacagcacagatgactttacaagagagtacatagtttttttaagaatagacaaattaatcagtaagtcagaatgataaaataaaaaaagaaaatctgagcagacacatataacttgtaattatattgaatcaaaaacttcccaatgaagaaaagccaggaccatatacatgacttcactgaagaattctaccaaacactgaaagaattaataccaatccccctcaaatgcttccaacaaactgaaaagggaacattttcaaactctttatgaagccagcattatgctgatatcaaagccaaagacaccataagaaaaaaactatagaccaatattccttatgcatattgatgaaaaattctcaacaaaatactaccaatccaaacgcaacagtaaattaaaaggattataccacatgaccaggtggtatttatccctgggatttgagcaaggttcaacatatattaataaaaccaatccatgtgctacaccacatcaacaaaaccaaggataaaaatcgtatgagggatctcaattgatgcagaaaaagcatttaacaaaatccaacacctattcatgataaaaaaaaaaaacgccattcaacaaactaggaatagaaggaatttataaaccaagaaaaggaggaatttctctttcttaaaaaataaattggtttgaaaattatgccctttgactcagtaatttcactttgagaaataataaaataatcaaagatgcatctaaacttttatattcattgagatattattaaaaataataaagctaggccagtcacagtggctcatgcctgtaatcctagcactttgggaggctaaggtgggtagatcacttgaggtcatgagttcaaaaacagcctggctaatatggtgaaaccccatctctactacaaatataaaaattagctgggcatggtggcacacgcctgtaatcccagttactcgggagggtgaggcaggagaatcgcttgaacccaggaagcggaggttgcagtgagccgagatagcgccactgcactctgacctgggtgacagagcgagattctgtctctaaaaaaaataaaataaaataaaaacagtaaagctagaacaaatttaaatgtctaactgcattaacagtggcatgaaaatatatcagacataaacctgaatatagcaaaagtatcaactgtgattgctcctaggtagtttatggatggtgttttttgttctttctttagtactttctaaaatttctcccatgaacatgcattacttttataatcagaaagcttaagtgctgcattttttttctttttcttttaattgtccaatactagaggcctagctatacatgaggaggcaaataagataaaacacaacctgttatctattccagagaacaaaaacttaacagagactatttttctagccatttaaagaaaacaaagtttcatctagttaataattttaaaattattaattaaaaatggctaactcaggaatttgaattttaaaaattaaaactacagtttttccctaacctaataacctactgacccactgacctactttggaatttaggtttgttaattctgataccacaggtatttcgggaactgacggatctattaacattaattaaaagtagtgctgaaatttaattgaccggtataatacaaaacctaaggaacaaaccttaactacttttattaccacttatgaaaaattctaacttgcttctgcagattactgattttgtattataactgaaacagtaattatttctaagagaaaaactattttaacttgcaaagaaaggcccaaatatttaatactttttagattcgttgtttaatgtacgaggaaaaaatgaaattaaacagtggttctcaatttattcaatattgaatgtattagccacctctacaaccgatataagatattggcaaaataaaacacatatttggttttacagctatctctacaatcaatttaaatttgaaaactgacctgtaagaataagaaccacatcccaaaccagttttatgaaccagacctcttaaaaccagagaggattctggctcaagacaaacatcaactgacactataactctagcctgctgaatgtcaagatgtaagatattcactaaacctcattaaataaacaaaaactaaaaaattaatacagttctcttagtgggacaatactattccaacgattcaactaatatatatttttcaagtaatgtctgagctttgtattcatataacagactgatcttgcccacagagtataggagcaccttatccccttttcagagataagactaaggcctacatctgtcctcagccccaagtaagccccacataaaacctgaaggtggagggagagcacaagcctcagaatgaatttcacatgtaatcaggtaccataaacctgaagctatacgactctacacctggccttcatcctgacaccagcaggaagaaagagggagccctgtggtaggcagaataacagcctccgaagaatgtccattccctcttccctggaccttatgaagatgttatgtcacatggcaaaaaaggacactgcagatgtgattaaggataaggatcttgagatgtggagattatcctgcattatccaagtgggtccaaaataatcacgtgagttcttaagaggaaaggacctttcctagctgtggtttgatatatcagaaagaacggtcaaaaagatggcaagttaaaggcataagaatgatacaatggaccatggggactcggggagaagggaaggataggaggggggatgagggataaaagaccatacattgggaacagtgctcaggtgatgggtgcaccaaaatctcagaaatcaccactaaagaacttatccatgtaaccaaacaccccctgttccccaaaaacctactgaaatgataattcttttaaaaagatgcaaagttgctggctttgaaagtgaaagaaggtggccacaagccaaggaattcaggtagcctctacaagctggaaaaaacaaggaaacagattttctcctgaagcctccagagagaaatgcagcccgctgacaccttgggttcaggtcagtgagatttgtgttggccttctgagctgcagaactgtaaaacaataaatttgtattgtcttaagccattaagtttgtggttatttgtatggtagcaacagaaaactatacagaatccggtttctctcgataaacctggctctcaccaacacttccctttcagtatttacagcaacctgcataggagatcatcaaagagaatcccattatgccctccattctttttacatcagtcaacaagaaatgcccaagactcccaagtcatcccccatccctatatactttcatccctatatactctgtatgtccctacactgaccccttttctcttcctcccccaattcccgaaatcctttcgcagtgtcttctggaactcatggtacacatcgtcgttaaaatatcctatttcctcagtattgttgttgcacactcttcaccttacttgctcccagctgtaacctctctcccctctgggagttctgctctaactccagccctttcaaacaatggcttctctctcatgtgagataaaatatatttactctcccatatctcagatgaccaagccctgttggtggggtgaacttccttgtaactcactgtcatttctgaattattctctccctccctaaaaccttagctttgactctcatgccaccagactacatcagctattatcccctccttattgtagtcattcacaaaccccaggataagccccttcactccacgaagggtgtgaccctctccaatacctcttttgaatttcaatgtacacaaaatgatcccccaaaactggccagtgagttccttgatctcttctgcaacaattttgtgttccaccccacctcccactcattctgctagtgttaccccagaattcaccattactaatatccaaaagaccctccgtatcctcaattttaagcatctaagccctctctcacaaactgggatagcatgtgatccacctgatgcaaaaagacaaaaaacacaaactttttttaaaaaaacaaaaaaactgctgggcgcagtggctcacacctgtaatcccagcactttgggaggtcaaggtgggtggatcacctgaggtcaggagttcaagaccagcctggccaacatggtgaaaccccgtctctactaaaaatacaaaaattagccgggcgtggtggcaggcgcctgtaatcccaactacttgggaggctaaggcaggagaatcgcttgaacccgggaggtggaggttgcattgagccaagattgctccacagcactccatcctaggtgacagagcgagaggtcgtctcaaaaaaaaaagaaacaatcaaaaaacaaaaacaaaaaaactgacaatatagctctaacttatttatgttgggtctttaaaaagaaaaaaaaaactgtgccagctcataatctttgttggagcctcagtttctcttcctagtaaaggcacaagggagtaaagcaagtttatttgacatggtcgggaagactaaacatagtgacagtcaatgattggttatgttgttaattaccttctatgagaaatgcttcattctttttcatgtttctctaaactctagccttccttttgaccactgagtcctttatacacttatcatattgataagctattctgtggcaaaatgtaatgattgcttaccactttaatatagttcaagttgtgctgactataaaaactttttaaaattccaatttacagtatttactaacacaaacacatataatgcaaataatgaaaaacttgttcagggctctaaggcttctgaagattatttatcacattccaagacaccaattttcctttctagctttagtcttatttctccttcctcatttcccattctactttactgtacacagactccttattctccagctacactaaggaatcacgtcaccattcctagatagtagaaaataaagacctctacgtaaaacaaaggtttgtccaccagtacccaatatattatcaacataaatatcttaatacaataaactggaattgaccttcacagaaaatcatattgtcattcacatcaagattcaactaatcatgatataaactttatgttattagtgaaaaactgaagaggtactatgtgcttcctatggcctctataaaaattatcacaaagttaatggattaaaacaacacaaatttactatcttacagttctgttggtgagagcccaatataggtctcactgggctaaaatcaaggtgggctaaaaccgaggtgttggcagggctgaattccctcctgtaagctctagcagagaatgtttccttgccttttcaagctttagaggccacccgtattctttagctcatagctccctctactccatcttcaagccagcaggaggccaagtccttctcgggctgccatttcttctgcctctttcttcccttattacattaagcccacatagataatctaagataacctccatattttatggttaactgattagcaaccttaattattccttgccatgtaccctaacatagtggcaggttccaggaatcaggatatgaacctctctgaagggtcagtattctgcctaccacgtaccatggaccaaaaagtctctgtttggcaaagacaaaatcaaatattttttgaggggaaaggtgaaacatcaaaggataatttgatctattaatagataaaagactacagtactatgccagtagttcttaacttctgaactatcttaacctttcatatttcttaaagggaattggaaaataatgtgtatgacaattcaggctgcatgcgttcaactgtaactaaagtctaactttattgctatatggtagcaacaggctctagggatattcttctgaacggaaaaatctgtcaatgtccaaatgaatactagcacatatttccccttttggaaaactaattgttacaccataaacacatatgatgtaatttatatgcactaaacagattgtccaaaaaagatgaattaaaccccagactttgtagaagcctattttttaaaagggcaaatgtatatagatttctgagatggatctccagaaaaaaaaaaaagagatacagaattttagcaacctaaaagaagtacagaatttcattagtactataaatcctctagggacctcttaggaaatcggattattaagtagtactttgacaatgctaggtttagagctaattcatgagttgtttaataacatacaactaatatgtataaatataatgacaatgtttgacatattatgtactacatctatgaggtcaccagagccacttaaaacaccaccaaaaaatgcatcaattttcaaggccacaagtattcccctttgtgcaataatcatttcactgaaaagacagttgttttgacttattaaaactcgggtaaactgccagctgcttttgtgtagccaagtaggcccggcaaattcaaaatcatctgaaaagtatttcaaagaagtttagatgcatcctgaaccacagataattcagaaaaaaactaccataaagcatgtcttcttcactaaaataatcattatatctaagtttatatttaggaaaaaatgtaatccctttgaactagaagattttgcaatatataatttatacatatgttacccatttctgcttttctgtccctatttactttcaaagctttcaaatttaaaaaattgatctatctagttccttattattattattattattattttaacccactgactgtttgatccttaccctaaaatgacaaggtgtggaaaatggcaggccaagaccatatctcaatctgtggagtggcaggggagatggggctcaaactgcataggtctttgcatcacgtaagtaggagtaaatataggataaatgaggacgtgtaggtagtacaagaatccaccagccagaaggcctgtgaccaggtttcacagaatccaacatggacataacaagtatattatagaacagacatatactcttgatacagaagacacgagatctgatgggatttctactgattcatctttaagctcactgactcttctgtcatctccattgttactgagcccatgcagtacatctgtatttcatatattgtatttttcagctctgaaatttccatttgattatttcatatagtttttatttttcagagaactatttttacactcctttcagaagtgttcacttttacctcatgaacatgagtactttaaggcttttttctgataattccatcatctggatcatctcagagttgtcaactggcttatgttctttttcctttaaaaatggtcagattttactgtttctttgtatgtcaagtaattttggatcatatcctggacattctagatattaagttatgagattctaggttccattaacatcctctaaagcagcagtcctcaacctttttggcaccagcgactggtttcatgcaatacaatttttccatggacagcggggatggtttctggacaaaactgttccacttcagatcatcacacttgttagggatggtttctggacaaaactgttccacttcagatcatcacacttgttaagttagattctcataaggagcatacaacctagatcccttgcactcgcagttcactgcagggttcacgctcctatgagaatctaatgctgctactgatatgacaggaggcggagctcaggcgctaatgctcactagccagtcacctacctcctgctgtgcggcctggttcctaacaggccacagtaccaatcgttgtttcagttttcaaagcgttcacaatgctgcttaaatctatcctccgcatgcatctctcaggggcaactctgggatttgagcagtggtttacaccatagttcagctctctaggtctttgccatgtttctttcgctctgttccatgtacgtgtagctcatggatgcagtaggtaggacctttgtgtgttcatacatgcaattagggaatctccccccaaactaggtgtcttctctttgagacttccaaagcatgctccagcttccagagttctctttcccaattcctctggccagagagacggctttcttcttgggattttaagtacatataccactatggcaatgtaattttacaaatggagatggtctcagggcacagctgggagagaaaaaaaggggggaattttctttgtcctatgactagaaataaagggtttctcttggagtttttgctaactgctgcactcaacatgtacttctacaacccagcctaccatttggttaaagctggataacaaaaagaaaaaaaaaatggtaagctaagcactacacaagctattcaggttttgacttcccttctcagtttgcctattactgtttactttcgaaagtcttcagataattgtttttgtttctatctagagggtttttgttgttgtttttgttttgtttggggggagtggtgtgttttgagatagggcctcactctctcaccaaggctgcagtgcagtggtgtgaacacagctcactgcagcctcgacctcctgggctcaagcaattccctgcctcagcctcccaatgtagctgggattacaggtacacaccatcatgccctattgatttttaactttttaattttttgcagagacaagatctcattatgttgcccaggctggtctctaactcctgggctcaagcaatcctcctgccgtgacctcccaaattgctgggattaaaggcatgagccatagcatcggcctaaccggggttttaagttctaatcagagaggcttactccacttttgcctatccattatgttttatccatttcccaattaaatttcacctaatggctttagtagtcacgactaattgttatctagaatcattatttcattaggagtatgcactgtggtgagtttgtaagccgatcgttctccagtgtttctgtttgtttgtctgtttttgcgcttgtttttgagacagggtcttattctgtcacccaggctggagtgcagtggcacaatctcagctcactgcagcctcgatctcctgggttcaagtgatcctcctgcctcagcctcctcagcagccgagactacaggcatgcaccaccatgcctagggctaatttttgtgtttttagaagagacgaggtcttgctatgttgcccaggctgatctcaaactactgagctcaagcaatcctcccacctcagcctgccaaagtgtttggattacaggcatgggccaccacatctgacctccaatgttacttaatagctacaattcttctaaagatatgctttccctcttaactatttggtagtcctggaatataatctctacagaaaaagattaataaatggttgactttttcctttcacttaccaattattttcagaataataaattggtgtatatgagggttttttaaaacaattattatgaattcttgaattactacatttttgtgtatttcagtgtactataatcattacactttttagtatttatttatattaaaatttctgtctttttttttaagagacaggatctcactctgtcactcaggctagagtgtggtggcctaatcacagctcactgcaacctcaaactcctaggctcaagtggccctcccgcctcagcctcccaaggagctgggactacatgcatgagccaccatgcctggcttatacatatttttttaaatttgtcaagtgcagtagtgagaagagggtgaaagagtagaacaaggagttcaatctgtaacggactgtgaacaatcaaatgaaataacccattacctttagactagtcatagtacacttttttaaacctatttttatgggaaattacaaatatacacaaagttagaataataatataattaatcctatatatccttcacccagtttccataattatcaactcatggctaatcaatcttgtttcatctgttctgctccttcccttcctctccactctttcggattatttgaagcaaatcccaagtactgtatcattccatctgtaaacagtccagtatatttgtataaactacaagggcttttataaaacataactacaatatcattatcatatcttacgaagtcaacaaaagacatataagacctgtttttacacgtaaaataacaaaacgccctgagagaaattataaaagtctaaatgtaagaaggcatacaaccttgcaattgattggaagtctcaacactgaaaaacatccaatatctccaaattgatttataaattctacactaagctagacaaaatccaatcaggtttgtggcgggtagtgcggaggactgcttataagctgagtgcagaatttttattgaaattcaaaggatcacgaaagccaaggtaattctgaagaacaaattagaggatttaaactatcagatatcatgacttattataaagctacagtaattaaaagagtatggcaatggcatgacagaccaacagaatagagtccaaaaataaatccatgaataaacagtcccttgcattacaacaaaagtactactgcattacggtagggaaaggatgatcttctcaataaatactactggaacaactggacttccacacggaaaataaaatgaactatgaggcttacatatatcacacataaacctaaatgcaatagttgtaacagtcaagtttatagaagaaaacatagataacatcttcttggctttagggtaggcaaagatttcttaaatgaaacataaaaagcgttaaccataaaaaaatttgataaaatggacttcattaaaattaagaaattatcttaatcaaaatacactactagagtgaagaagcaagccaaagactaggaaagatatcttcaatacaactgaacaactgaaattatctatttctggggtaatcaagacaaccaactcaacagaaaaatcagcaaaagacataacagtcatatccccaaagaggatattcaaatggtcaacaggcatttgaaaatattctaagccttttaaatcatcagggaattacgaattaaaactacaatagacctttactacatatgctccataagagctaaaattaaaaacactaataatttcaagtgttggtgaggatgtagaacaatgagaactctttgtacactgctaatgggaatgtaaattaatttaactactttggaaaactaggataatctcctaaagctaaacagccagataccttaagacccagcaatttcactcttaggtgtctactcaacagaaatgtgtacacatgtggaccaaaagacacgctcaagaatgttcacagaagtattcttcataacagccaatactagaaacaccccaaatgttcatcacagtagaataaatactgacatatccatacaatgaagtatttcacagcaacaacagaaaagatgaaccactgctacatgcatcaacatggatgagtcataaacaagattttaaaaggctaggcacagaattcaaaaatagacaatactgaatgagtcacataatagttatctttgggagtgtgtaataactgttaaggggcatgaaggaggctcctgggttgacgaaaatgtcctatatcttattcttgatattagttaaatgggtgttgacttcataaaaattcatcaaaatgacactcaggatttatgcactttataatatgtgtgttataatttgatgaaagagtaaacaaaaaaaagttagtgatatcatgtcagtcccttgattttttaaatttaattttttttggttatttgactatgaaattaaaaagtctagtaaagctaagttctacatcagcctgcctctttgtgggtactaaaagtcatgttcacgttctttcttaacacaattactgaggaattgtcttggtatgtggatccttcccataacatgaggtcaacagaaagtctagcttgaagctagagttatccaatattcacaaactagaaaattgtaacactgcaggtacttcttcttagtgtaattataaacaatcaatttttctttattacattccagatcactagtttccacagtttctatttggcaaaaagaggtaaaaaaaaaaaaaaaaaaaaaaaaagccgggcacagtggctcacgcctgtaatcccagcactttgggaggccaaggcgggcggatcacgaggtcaggagatcgagaccatcctggctaacacagtgaaaccctgtctctactaaaaatacaaaaaaaattagctgggtgtggtggcaggcgcctatagtcccaactattcgggaccctgaggcaggagaatcacgtgaacccgagaggtggagcttgcagtgagccaagatcgcaccactgcactccagcctgggcgacacagcgagactccatcaaaaaaaaaaaaaaaaaaaaaaaacacaacttgaggcttcacatctaagcttagttttagctggaattgaaaacactcagcaaatcaaggcaatgtatcacaataaggttgtcataagaatgaaataaatattaaatgtaaagtgcttagaatataatgcctcaaagtaaatgctcaaaattgtattaataccgttctaagaaacacatgtaacagacccttattcttgaatttccttcaaaatataataaatatatggtagtaaaaccagacccacttttaaacaaagtatttttatggagctgagaacaaaatcaatttttaatgaatctgaactgaacatattaaagtacaggatcaataaaaacttagtaaattgtactcaagaattttttaagttctaaattatacttattggtatttaactatgaccctacgattaaaataactgagataatcaggaaaaatactgctaatataaagagctcatctttgcattgtattttttacatttgcaaagttgtatttcatttcattaccatattactataaaataattaaacctattttataaaacttaagtcataaacttattaaatccagcaaagaatcgcagaacaggccaggcgcagtggctcacactgtaatcccagcactttgggaagccaaggaaggcggatcatgaggtcaggagttcgagaccagcctggccaacatagtgaaaccctgtctttactaaaaatacaaaaattagccgggtatggtggcacacacctgtagtcccagctactcagaaggctgaggcagaggttgcagtaagctgagacaatgccagcctaggtgccagagcaagactctgtccccctcacccccccaccaaaaaaaaaaaatcacagaacaagaaatacttatacttgtgatcacataatgatacgccaccaaacaaaaaaattcttttcaataacagtaccatcatgtaaacaaagtatatgtaaaagcagtttgaaaaaaaaaggggactatattttttaagcagtcctattgcaatactctaagtgtatttttaatggaaataaatgttaatttgaaagtaacagtagccaggcaaggtggctcacacctgtaatcccagcgctttgggaggcggaggcaggcagatcgttagagctcaggagttcaagaccagcctgggcaacatggcaaaaccccttatctactaaaaatacaaaaattagctgggtgttgtggcacgtgcctatggtctcagctacttgggaagctgaggcaggaggatcaactaagccctggaagtccaggctgcaatgagctgtgactgcaccactgcactccaggctgggtgacagaacaagaccttgtctcaaaataaaaaataaaaaataaaattaactggatgtaatttccagttttatacatagctgctaaacatgtttcttaaactttatacttggaaatcattcaaacatgcagaaaagttaagaatagttcaaagagcttctacatatcctttatcctgatttgaccaactgtcaacaacaatcctgttgaccaactgtcaacattttgcattattgtccatatcatacataaacatattttttgaaccatttgaaagtaaaatgcacatatcatacctttttacctctaaatacttcaactatacctcctaacaacaaggatattctcttaaatatctacagtatagttaccaacttcaggaaacttaacagttatacagtatcttaatgtaatgcctattttctctctttttttgttttagttgagcaaaaactgccctccaagactttttccctcttccaatactgaatccaatccagggtcatgtactgcatttagctgtcatgtctacccagacttctttaagctgaaacacttttctttcagtaaatatcttttgttttgtttttttgagacagggcctaactatgttgcccaggctggtcttgaactcctaggttcaaatgatcttcctgcctcagcctcctgggtagctgggactaggggtgcataccaacacacccggcttctgctaaataccttttaaacaatcttatctttacatggtatcctgcaagataagattttaaaagtggaattcttaaaaaaaaccatatagggaagttccattaaaaaaagaggttcagtgtaagagctgcgaaaagttcagaagacttaaataaaaaaaatacataaatcttcctattcaagagtggctttttagcatatggtatttattttattttatattttattttttttaattttttttgagatggagtctcgctctgtccaggctggtgtaatctcggctcactgcaacctctgccttccgggttccagcaattctctgtctcagcctcccaagtagctgggattacaggctcccgccaccacacctggctaattttttgtatttttagtagagatggggttttaccacgctggccaggctggtctcaaactcctgaccacaggtgatccacccacctcggccttccaaagtgctgggattacaggcgtgagccaccacgcccggtctatagtatatacattttaaagctttataatgaggaggtttccaggtttctttgagatcagcaattcttagattagaggtttatattctctctattaaatagcaatatacaatcaatttatacaaataaatttggccaatgatttgattggtatctgcagaaaatggacctaggctgggcacggtggctcatgcttgtaatcacagcactttgggaggctgaggcagaaggaccacttaagtccaggagttctagagcagcctaagcagcatagtgaaacctcatctctacaaaaaataaacaaagttagctgggcatggtggtatgcacctatagtctcagctactcaggaggctaaggtgcgacgatcgcttgagcctgggagatgcagtgagctgagatcatgccactgcactctggcgtgggtgacagagcaagaccgtgtctcaaaaagaaaaaaaggtaggggggagccaggcatggtggctcacacctgtaatcccaacactttggaaggctgaggttgggggaacacctgaggtcaggagttcaagaccagcctgtccaacatggcaaaaccccatctctactaaaaatacaaaaatttgccaggcatggtggcgcatgcttgtagtcccagctactcagaaggttgaggcacgagaatcacttgaacccaggaggtggaggttgaagccaagagagcaccactgcactccagcctgggtgacagagcaagattctgtctctaaaataaataaataaaataactttttaaaaaaggatctacagaaaattactattttcatcaaaattctctcctccagttaacaaaaacacccagtctcaataagcaaacctttaaagaatggggaatgattttgatcatgcatagacataacagttattggaactggcacataccttgttctttcactggacacttactgtgtgccaaatatgtgccaggcctatgctaactgtggagttgagaaatccagtggtgagctaaaaaggcacagaacccactcttaggaaactggtaatttagcaaaccaccaagactcctgttttcagacagtaaaggtattagttttccctaatttggaaatgaagcaattagattcagagtggtaaatgtgccccgagtcacataactaagtgttctcaagggacaaagaaggtaaacacaaaaattatggtcttctatctcctaatatagtacttaacctgcctgtgtctgactacaaaagagttacttaaccatatcctttaggcctatccattgactccaaagggacagtgtactttcatctccaatgaactacttttgtttcattgagtcagtcatcaactaatcttttaagtacttaagatgttaggtatgtaaggtattatagtaacattaaaacttggttaaaaacagagcagcatactaattttctttctacatattcccacatattcattttagaataaaaataatagaagaatccatttcccctgatttactattttaaaatgacacaggtcaatataattagaatatgtgtaatactttccactaaagaaaaaagtataattaagtcactgagaattggcatggactcctatctctctctaatttccccccaattcatctcttaaaccatagcactcaaatctataaatactccttcagccatgtagagcaaggatcagctaaacttattctgtaaagggccacacgggtaaattttttttttttttttgagacggagtcttgctctgttgcccaagctggagtgcagtggcatgatctcggctcactgcaagcgccgactcccgggttcacgccattcttctgcctcagcctcctgagtagctgggactacaggcgcctgccaccacgcctggctaattgtttgtatttttagtagagacggagtttcaccgtgttagccaggatggtctcgatatcctgacctcataatctgcctgcctcggcctcccaaagtgctggggtctctgctgtaactacagacatatgtcgtggggatacattttgagaaatgcacaggcaatctgtcattgtgtcaacatcacagactatttctatacctagatggtatagcctactatacacctagacgatctggaatagcctattgctcctaggctacaaacctgcacagcatgcaatggtactgaatactcaaggcaactgtaacacaatataagtatttgagtatctaaacatatcttaacatagaaaaggtaatgggttgtgccatgatgacatgatggccatgatgttaccaggcaatagcaatttttcagctccattataatctcatgggaccactgtcgtatatttggtccatcactgaccatgtaatgcatgactgtacttaactgctgctatagcctaaaagcagtcatacacaaaacctaaaaaataagaatggctaatgttctaataaagctttactcataaacactaaaaattaaatttcatataactttcacgtgtcacaagttagtcttcgagattttttttcaaccatttacaaatgcaaacaccactcttagctcatgagtcataccaaagcaggcaccaggctgaataaatttggtggtgtgcagaccccagtgaaggcctgcttgtaaagaggagctgcagtctggctcttcttttacctcagtcagctgacactttatctctatagctaaggcctggcaggaaataattcttactcgactttcagtcatttgcaaatcatcttccttaaactcaggaaaaggtaagttatgactcttacttttgagcactagttttgagaaatttcaggaattgctaaaatactttacatctggatttcaattatttttcccaataaataaccttcttactcctcataagaatgaaaattctaaagataaataaaagctgccaaggaaagtagcagatcattacccaagtatttttataattccttgtcctatgcttccaccggtacactgcaaattccacccaaccatgattaagggaaaagaaacaaagatagcatacctttgagctcaaaatgatgattgaaggtatctagtgagacttgccaagttctaaagattcatttaagaggactgtagaattatccaaaggcatcttacaatgtgatagaatcagcttctgagctccagcagctttgcaggaacaagtaaaaattctgcaaagaaacagtacttactgaaataatgctaaccaatttaagtaacattattatcactagtatttttgtttcatcgacgtatagaacatttattgcgagcctcctctacgtgccaagaattgggaatgtgtcaataaatagatcagatctcatcaacccctctgggaactcaaccgtaaatgggacaaaaagtttgaaaaatcacgatggtgtgaagggaaagcataacagagatacaaaccagtttgctggaaattggttagaaaagttctcctgggacgggtgcggtggctcatgcctgtgatcccagcactttgggaggccgaggcaggcagatcacttgaagccaggagttcaagatcagcctggccaacatggtgaaacctcgtccctactaaaaatacaaaaattagccaggcatggtggcatgcacctataatcccagctactagggaggctgaggcaggagaatagctttaactcgggagatggaggttccagtgagccgagattgcgccactgcactccagcctgggcgacagaacaagactctgtctttttaaaaaaaaaaaaaaaaaaaaaaaaggtttccctaaaggaagagaatttaatgcaagaatgtgtatgatctagccaaataaagcaagagggaagaggtgagaaagaaaattttttgtccaaagggaacagtgtgttcaaatggctaggtgtaggtgaaaatatgacatttgtgtggaagtaaaagaagtccaatgtagatgttcagaatgaaacaggaaatgagaaagggcatttcctgagacaagatgggcaaagaaagaaagcaaaaggtgaagcaatttgccctgaatcacacagggctaaaggcagagcccattttaaacccttaccacttgactgcaatatactagccattctgaaattctaagcaggaaactaaaagttcctagagaggaatttcaggggacctttgcaagagcccaaggaatgactgccctgggccaatagctgaccttgccatggatggataaaagaatcaactgatcatcaagcgtccattgtgcagaatgagaaaaaagtctcatcacaattctcaactaataattaacaattactaagcactttactatgtgtaaagccctgttttaagcacttgacatatatttattcaatcctcacaacatcactatcaagcaagtgctttcattatcctatctatctaattttaatgacacagtccaatcatggctattaattttcttgtactgacaacaagaaatgtcaacaatacttcttgacacaatattgaaagcactttagtgactcttctttcagaaaagtactgctcaaatatcaacaaaaaaagactttagaacattaatttggttcctttagcttttctaatttaataccactgtttcaggtccacataaaaaactgagggtaaagtacagagatttcccattgactccattaatgcacagccttccccatattcaacattccccaccagagtggtacatttactacaactgacaaacctacactgacacatccttatcacccaaaattttaggcttcactcttagtgctgtacattttatgaatttggacaaacataatggcatgcatccactatcatatcacaccgaatagtttcatcggcctaaaagccctctgtgctctgcatatgcatccctcccctcactaacccctacaccacattcatttttttattacctccataattttgccttttccagaatgtcatgaagttggaatcatacaatatgtagtagccatttcagactggctcctttcacttagtaaatacacatttaagatttctccatgtcttttcacggcttgataatttctttttggcactgaatgatatattccattgtctgaatataccacagtttatccgctcacataatgaaagacattttggttgcttccaagttttggcaattattgaaaaggatgctataaacttccatataaagatttttgtatggatagaaactgtcaattctttggttgctagatcatatggtaagactatgtttagtttcgtaagaacctgccaaactgcctttcaatgaggctgtaccattttgcattctaaccagcaatgaatgagagttcctgttgttccacatcctcaccagcactggatgtagttagtattttggattttcaccattcaaatatgtatgtagtagtatctcattttaatttgcatttccatgatgacagatgatatagtgcatcttttcacatgcttcttgaggtttgtatatcttctttggtaaggttatctgtcagtgtacctggcccattttttaactggtttgttggttctcttactgttaagttttaagagtccattgtgtactttggataaaagtcctttatcaaatatgtcttttgcaaatatcttcaagtctgtggtttgtctttttattcttttgataagtacctctcacagagcagacatttttaattaaatttaattttttctaacacggaatacgtctttgatgttgaggataaaaactcgctgccaaacccagtcatctagatattctcttacgttatcttctaggagttttatacttttacaatttacatttaggtctctgatccattttgagttaatttttatgaagggtataaggtctgtcgagattcatttttttgcacatagacagttgctccggtaccatttgttgaaaactatcttttctccattgtattgtctttgttcctctgtgaaccattagttgactatgcaatcatgaattgcattaacaatgtttcaggacagaccgtatatatgacagtggtcccataaaattataatatggagctgaaaaattcctattgtctagtgactttatagctgttgtagccattcataacattgtaatgcaattgctttttaaatacatttagtgtagtctaagtgtacagtgtatataaagtctacagtagtgtaccctaatgtcctaagccttcacattcaatcatcactcactcactgactcaccctacgcaacttccagcccaacaagctccatggtaagtactctatataaagtataccatcatcttttaaactgtatgtttacattccttttctacattcagatacacaaactcttactgttatattaaaattacctatagtattcactacagttaacatgctgtacagtctagtaacagtaggctacaccatacagcctaggtgcagagcaggctatacatctaagtttgtgtaaatatactctatgttatttgaacaatgacaaaatcatccaacaatgcatttctcatctcagaatgtatccctgtcattaagtgacacatgactgtactgatgtggatctattcctggtctctctattctgttccactgatctattaaaatatttgtctatgctttcaccaataccacactgcttgatgactgtagttgtaaagtaagtcttgaagtcaggcaatgttggatctccaattttgttcttttctttcaattttaagttgcctattctgggtcttttgcctctccatataaacttattggaatcagtttgttaatatctacaacaaactgcaattttgactagaattatattcagtctacaaataaaattgtgaagaactgacaccttgttaatatagtcttcctatccatgaacatgttatttagttattgtttatcagagttttgaagttttctttgtacatattttatatatattttattagatttatacctaagtatttattttgggagatattaatgtaatggtattgtgtttttaattttagaattccacttgttcactgctggtatataggaatataatctacttttgcatattaaccttgtatcctgctaccttgtgcttattggttccagtttgtcaattcttttggatcttctacatagacaatcatatcatcttgcaaacaaaatgagttttatttcttctttcccaatcagtatacatttcttttcatttttttatcttactgcattagctagaacttccagtatgatgtgaaaaggagtggtaaaacgggacatccttatcctgttcctgatcttactgggaatcttaagttctagattctcaccattacataaaacgttagctatagttttattctcacattcataaaatacttttaatcttccattcatatcccaataccaacacctaattcagtgacgctctttactgcatttaggctgttatgtccccttacctcttttgaaaaaattattatttaccactctgaagcacaattcacatactataacactcacccatttaaaacctacaattcagtattttttagtgtatttacagagttgtgcaactatcactacaatctaattttagaacatttttatcccccccccactttgctgagctgtagatttttttaatagatgttctttctcaagttgaagaagtttctctctattccaagttttacagttacagagtttttttttaaatcatgaatgggtgttgggttctgtcaaatgttttttaaacatctattgatatgatcatatgatttggttttctttagccagttaatgtaatggattaatttcttacatgccttggataaatcccacttgatcacagcatatagttcattttataaatgttgaatttgatttgctaatattttgttggggatttttgcatttatgttcataagagatattggtctacagttttcttttcttgcaatatctttgtctggttttaggattagagtaatactggcctcacagaataagttagaaagtattccctctgcttctgtcttgcaaaagagaatgttaacattggtgtaatttcttccttaaatgtttggtagaattagaactcaccaatgaacccatctggacctggtgatttctatcttaaaagattataaataattgttgactcaatttaatagatataggcctattcagattgtctacttcttgtatgacttttggcagattgcgtccttcaaggaattggtccatttcatctaggttatcaaattcgtgggcacagagttgttcataatattcctttatatttttaatataaatggaaatctgttatgatttctactttcatgtcttctattagtaatattagcgtatcctttttccttagttagcctagctggaagcacatcaattttattaatctcttcaaagaaccagcttttggttttgttgattttctctatgatttcttattttccatttcactggctgttttgtttgttttgagatggagtcttgctctgtcacccaggctggagtgcagtggcacaatctcggctcactgcagcctccgcctcccgggttcaagcgattctcctgcctcagcctcccaattagctgggactacaggcgcctgacaccatgcctggttaattttttgaattttttgtatttttagtagagacggggtttcaccgtgttagccaggatggtctcaatctcctgacctcgtgatccacccacctctgcctcccaaagtgctgggattacaggcgcgagccaccacgcccagcctctgctctaatttttattgtttcctttcttctgcttactttgtatttaatttgctctactttttgtagtttcctaaggcagaaactttggttttagatctttactcttttctatgtattccacgctataaatttccctctaggcattccatttgttgcatcccgcatattttgttaagttgttttcattttcatttagttcaaaacatttttagatttctcttgatacatcagtgtagtgtggcaaaaaaagatgaaaataaaaatttttttaatagatttcttgagaatctttgacccatgtgttgtttaatcttcaagtatttggggattttccagctgttactgatttctactttaattatattgtggtctgagaacagatactgtctgatttctattcttttaaatttgttaaggtgttttatggcccaaaatgttgtctcttgtggtgagtgttccatgtaggcttgagaagaatgtgtattgtgctgttgttggatgaagtagtctatagatgtcaattatatcaagttgtttgacagcactgttgaattcatctatgtttttactggttttctgcccgctacatctgtccatttctgataatggggtattaaagtctccattataagagcagattaatctgtttctccttgcagttctgtttttgcctcacatacttacatgctccactgttagctgcacagatgtttaggactactatatcttcttggagaactgacccatttatcattatttatgcaatgcccctctttattccggataacttccttgctctgagagctgctctgtctgaaattaatatagctattcatgctttctttcggttagtgttagcatattgtatttttctccatccattttcttttaatctatgtatctatatttaaagtgggtttttttggtagacaacataaagttaagccttgatttttcatccactctggcactgtcttttaattggtgtgctgagatcactaacatttaaagtgatcattgatacagttagattactagctaccatatttgtgattgctttctgttctttattcctattttagtcttccagtctttttctgcctgttgtagttttacatgattctattttcctctcctttcttggtatacttttttgcttttttgttttactttttttagtagttgccctggagttcacaatacacatttacaactaatctaagtctactttcaaataacactaaaccactttatgggtagtacaagtaccacgtaataatcctaatacctccctcctatcctttgtatcattcctgtcattcatttcacttttacataagcgcatacatacatacgtgtatatataagcatacataattgaatacactgttgataacattattttggacaaaccatcagttaaaaagataatgatttttccttaagcctgttaatgtggtggatcacactgatttttgaatatttaacctgccatgtatccctagaataaactccatgtgattactatagtgtaagattcttttggccgggcacggtggctcacacctgtaatcccagcactttgggaggccgaggtgggcggatcatgaggtcaggagatcgagaccatcctggctaatacagtgaaaccctgtctctactaaaaatacaaaaaattagccgggtgtggtggcacgggcctgtagtcccagctactcaggaggctgaggcaggagaatcacttgaacccgggaggcagaggttgcagtgagccgagatcacgccactgcactccagcccgggcaacagagccagactctgtctcaaaacacagaagattatttttatattttgctgaattctatttgctaatattttgttaaggatttttgtgtctctataaagaatattggtttttaatttgttgtttctgttctgcctttgtctggttgcagtatcaggataatacttgaaatgttcccttctcttctgttttttagaagagactatgtagattagactctgcagtgaaaccaactgggcctagagatatctttttggggagtttcagaattacaaaatcaatttgcttaatggttatgggatagtagtagtagaatgttggctttttcattactctcatacattgctggtgggagtataaattgatataaactttatagagaacattatgtcaatacccttaacaaaattacaaatgtttttaccctttggtacagaaatataggggttataaccagcattttaaaaatgaaacatggtggggggtggggagtcggatcgcaggacacctagttatggtaaagggtatttcctgaaactgttgtttcagatatgtgtgtatgagtgtactaggtcataacataaaatatatttcttactatgagttgtggtcatagaagtttgggagctattgtttcagctttaaaaggataacctgaggcaaaaattataagctgacacttagggaagggagggtataatgtcaggatatgaagagaaagttaaataaggcagataaggagacaaagcaaacgtgaaatatgacattaccaagctatgcagagccatgagaaaactggcctatttggggtaaatgcagaggagagaggacggggagaatttatctgaccagtgctaaagagacataagagatctggcaaagattttcccacagggtattaatccctaaacaaaaatgccaaatatttattgttttcctcatgacactatctttgcttaaaaggttgactgtagacattcattgtgctcagacttcaaagaactatatcagtgctatggtctaaatgtttgtgcccctccaaaattcttatgttgaaacttaatccccaatgtgacagtattaagacatggggcctttggatggtgattaggtcatgagggctccaccctcatcaatgagatcagtgcccttataaaaggcctgagggagcttgttcccctccctttccatcatgtgaggacacagcaacaaggcaccagaatgggccttcaccagatactgcatctactagcaccttgattttggacttcccagtctctagaactgaaaacaataaatttctgttgcttataaattactcagactaagatactttgttacagcagccaaatggactaagacaaccgacaagctataagaggcagttccaatgcccctggatgacactgaatcccagatcatcaatgagtaccctcatgtcaatacattttcctcaagctaaccttatattctgccccccacccaatccaacacctttcaaaacattctcatacctgtttccttggtttctccagatgcttattattcaagtcctgcaattttattttattttacttttacttgatagggtttcgctctgttgcccaggctggagtgcaatggagcaatcataattgactaccgcctcaaactcctgggctcaagtgatcctcccgcctcagcctctggagcagctagaactacaggcacaaaccactatacccagccaatttttaaaaaaagttttttgtaaagacaaggtctcactatgttgcccaggctggtctcaaactcctagcctcaagtggtcctcctgccttggcttcccacagcactgggattgtaggtgcaagccactgagcctgcagtcctgcaattctttttgtatataggatagttctttccagagcagggcttgtaattctcttcttgggatgtgctaagaccctgactatagttattaaccagaggataatgagtcatagtagaggcagatcttaagaataaatgtcattggaccaggcgtggtagctcatgcctgtaatcccagcactttgggaggccaaggtgggcagatcacctgagttgaggcattcgagaccagcctgaccaacatggtgaaaatacaaaaatacaaaaattagccgggcgtggtggtgcacttctgtaatcccagctactcaggaagctgaggcaggagaaccaattgaacccggaaagcggagaccgcagtgagccgagattggccactgcacttcagcctgggtaacagagcaaaaatctgcctcaaaaaaataaaaaataaaaataaaaataaataaacatcattgaacatttatggggtcactgcacagtcttcaagcaatgatgacaggaggggtggcagggggtctttcctctgccaaagggaaatgggatgcttctccttgccaggaagcttcagcatgaattgtaggattaaaaattctgaagtacagggatccactctttccctattagggccctgacttagacacacaacacctgcaaaggttgcatatttagtcttctctgcagttgtatcaccttaataatccgattcaaggccaacattttagcatagtctccctgaagtcaacaggataagattctgttatcctataaaactgtcatagaagccctctgggttccacagtatgccttaaattggcaattagttgtgctaaatctaaccacttttttaaggccaccaacaaaaacaacctcataccacaatccttaaaattatcactgcccccacaccgatcaagtgaagtatctgttttctcccaaaaccttgacttctatgagcctcactcccattaattacagatgaaagctttagaattacaatgccaactgtatccaagggtcatcaacacctcatttactaacagcaatagtttcccctaatatgcagatgaactggtgaaaattcaactccaaaaatggcattatgaggatctgcttttgtagtatgaactactcctagaaaacaacacctgaggcaaaacagactgttgacacaggtatcccacagcttcaaatttatattaattttacaatatacatttaaaataaataaatccacagtagacatacagggtttttctccctcccaaatctttttaatactaaggttcagttctaaggaaacaaagtgaggtaatgttaaactcatacaagctacaaattttagaggtattttaaatactctttctcccttactccttcacaattttcccaattctgtgactggaattaatcttcataaattcctcctcccatcccctgcctccagcaccagccctcttgaatccatcccttgctttatatcagaagactctaacattcatatttgatcatgtcactcaaattccttgagatataaaaattgctccctataacaactcctttgtgaactccagatttagtccccaaggttcagccttatctctttcaagtctctcatgatttaaccttttccatttacttgctattccctacatacatcaaattttgtcacacctccaagtctatgctcacggttttttcagtctacaatatttttacagatattcttacaaaagtgcaattttaacgttggtaaaatggtttctttctcaaatgtactagaaaaaaattcaattttaaatggaactacagtaatttgtgtcccttaattaatctgtcacataaattcaaatttctattttttttgtgtttttttgagatggagtttcactcttgttgccaggctggagtgcaatggcatgatctcagctcactgcaacccacacctcctgggttcaagcgattctcctgcctcagcctcccaagtagctgggattacaggcatgcgccatcacgcctggctaattttttgtatttagcagagacggggtttcaccgtgttagtcacaccggtcttgaactcctgacctaaggtgatccacctgccttggcctcccaaagtgctgggactgcaggcgtgcgtcaacacacctggctcaaattactatgttttatagagctcaccttatagattttagatgtgtgctgctactctcaaaattctgattcttgctatggttataccataccacggtggtaacaccccatgaattattggccttcacaaatatgcaaaggaaagaaatgggcctcagactcagacatacttgagcaaattattcactttgcttgaatttcagtttcctcacctctgaattctctctaaatacatctatggatgctatgcaatttttactaatatcttatattgatttgtgtccatatggtatgcatatatgagtgtgtatgtaactagacaaactgatcttagtatttatgtggaagagcaaaaggctaagaatagctacaataatttgaagaagaaaatggagagagcagtcctacaaataatcaagccttataatatgggtctttcaaaacagagatagagagatcacaaatagagtcatatgtatattaaaaaggcagcattataaacaaagagggaaagaatggactatccattaatggtagagacaacaggtacccaaatagggcaaaaagttataccggatttctttcttaccacacgtaaacataaattccaagtgcttcagacccaaatatgaaggcaaaacatatcaatttttagaagaaaacacacaataccttcatatctatagaggagaaaataactttcttaaactatcataaaccttaaaggaaaacaagccaagcacaaactttaaagaaaaaaaataatatatttggcttcattctaattcaaatctgaagtctaatttaatttaaatttttaatttttctaattaccaaaatatcccataaacaaatgaaaagacaaaccacggactgagaaaatataccacagaagattagtatccaaagttcgtaacaagatactacatatcagtaagaaaaaaagataaacaaaagatgccaaccagtaataaactgtttttttttaaaaaaaaaagaagcataaagaacgaataaacataagaaaacatgctaaactttatgaacagaataagtagttggaaaaataggtaacttaaacaggtatcctaccccttaaggaacagtaagattaacagccatatattcttaacctagattcatcaactgttaacaatttgccacatctatactctttccaccatatatatgtatgtatttgtaaatgcacactttccctctctcatatatatgtatgcatctccatatacaacatacaaacatgcacatgtacacacacaaatacacacactcatttacttctgaaccatataaaatgactaactctaagcttgaaagcaaggaagctatcaaaacctaatatggtcatataaaaaagatttagaagcaaatctgaaggggctcctactggccagagacaggccaggttgaataaaaagaaattgtgaggcacagtaacatataatgtgtattgtttagcataagacaaacgaacaggctgggcgcagtggctcatgcctgtaatcccagcactttgggagatggaggcgggcggatcgcgaggtcaggagatcgagaccatcctggctaacacggtgaaaccccgtctctactaaaaattaaaaaaaaaaaattagctaggcatggtggtgggcacctgtagtcccagctacttgggaggctgaggcaggagaatggcatgaatctgggaggcggagcttgcagtgagcgagatggcaccactgtactccagcctgggagacagacccagactctgtcaaaaacaaacaaacaaacaaaaccagacaaacggacaaatgtagaactctcacttgtgaccaaagagtagctagagtatcaagtcaaccctcagggtacagaacagtcatcactatttacaccttcttggtccaatggaccctttatattttcaagtcatcttatgaattatttatacgagaataaagggataataaaaaaaattgacactgaaaaattaaacatatcacaaccaaatttttattccattttttgaggctttgaaagtgtatctacatgacatgggtaatgtcctctgaatgcaactggctgatcatccatgcacgaatctggaacataatcatcctgtactgcttccaggtttcatatacatctctaatacctctccagatacatctccacatacatttcaaatatatttctaatacttctccagatttctaatacatacctctaatttcatatcagcttatcaatatttctactcttcttgcaatttcatcataaaaaaaattgaagaagtttttgaaacctttgatggcttataattttattgaagagtggataccatctttttttgctccaaaactgtaaaacattcttgtttttaagcatcaattaaaatgagcaatccaacaacttttttctttttaaataatctatttccttccagtcacctttgttacatgtctttagcattacaaattgttatccagtaaattttggcatgcagacaccataaaagacgtaagaacacatcattttagcaaaacaggatggtgtaaggctcatcagaaaatattcatacccggccgggcatagcagctgatgtttgtaatcccagtactttgggaggctgaggcgggcggatcacttgaggccaggagtttgaagaccagcctggccaacacagcaaaacccgtctctactaaaaatacacacacacacaaaaaaaattagctgagcatggtggcaccagcctgtaatcccagctactcaggaggctgaggcagaattgcttgagcctgggaggctgagattgcagtgagcggagatcacaccactgcactccagcctgggcaacagagtgagactctgtctcaaaaaaacaaaaacaaaaacaaaaaaaaagaaaaaagaaaatattaatacctattaaatgactgactagacaagaataactatatttatatttttacactcagaaatataattcttcatgcattgatttctgagtttgagaaaattcacctattatatgaataagtgcagcctgagattttgcttaattcatttgacctagttttacttttttattttaaattatacctactacttacatttgtggttcacataaaatttctattggacaatgatggtccagtgattcacatgaaatttctattgaataaagcctgaggtgcatttatttttctttttgcatttatgtgctggtttgtcaaagagatgtgaaacatctttctgtaatttttcctctttgccataatgagcagaaatgaaaatttctaaattctcaactgtttctaatgaaagctgaaagcggcctacaatgatgatatctccagacttataacttccagaaagatgatgtaatactttgggaaatgcaaaaatcttaaaaaaaaaaatacaatagtgacaatttatttccatattctatcactctcctaggtgattccatcatttttccattttcatattatcttttaggagggacagaaataattgatgagtaatttgttatgaatgaaatgaaacaaatcttagtaatgaaacaagtcttagaatgatgaaatcacaatccttaaagctacaggaatataaccaatgaaagatagaatgagttttattcagtttttaaaaagaaaattttggctgtgcacagtggttcatgtctgtaatcacagccctttgaaaggacaacatgggaggatcacttgaggttgggagttcgagaccagcttaggccacataccctgttctttagaaaaaatttttaaaaagaaaagcagccagacatggtggcacacgcctacagttctagctactcagaagtctgaggcaagaagatcacgtgagcccaggaattggtaattatgataagctatgatcacaccactgcactccagcctgggtaacagagcaagaccttgtctctaaaaaaataaaataaaataaatgaataataaacattttttttttgagacagagtttcactcttgttgcccaggctggagtgcaatggcacaatcttggctcactgcaacctccgcctctcgagtagctgattacaggtgtccaccaccatgcccagctaattttttgtatttttagtagacacggggtttcaccatgttggccaggctggtctcgaactcttggcctaaagtgatccacccgcctcggcctcccaaagtgctggaattacaagcatgagccaccacacctggccaaataaaaaaattttttaaagtatatgttacctttctactttcaaaggcctttaagaaaaaatgagtcaagaaattattagtccttccatagttagaactgctcaaaaaaaaaaaaaaaaattccagtgtgtactgatggtatgccaagggttaatacgaaaatgtttaactataggttgagtatccctaatacaaaaatccagaatctgaaatgctccaaaatatgaaactttttgagcaatgacatgacactcaaaggagcatttcagatttcagattttcgggatactcaactgaaaagtatactataaatattccacaatctgaaaaaatacgaaatccgaaacgcttctaatcccaagcatttcagataagagatattcaacctgtaacaggaaatttacaaagcattttccttgactggcctgtcaaactgtatttcaaggtaggcaaagggaccaaagtactgaaagctactcctttaaagaaaaatttcaactaagaagaacaaaagaaatgacataaataggcaaaaatcatcaatcctaaaaaccccatcaggagaaaaagtaatggtaaatttcacaatggatcatattgtcaccaactgaattcactgatcaatcttaacatctttaacactgggacaaccacatatcatgatataacatgtagtaatagtactacttacagaatattcttgttaagagtcaaactagaatctatgaacctttagatcatacattctcaacagtagcaatgtcacattcaagaaggcaaagaaatcttaaacagtaaattaagacagtttctcatcctccaaatcatactactgtgtctgcccccaggtctggggaaaaggtgcagtgtagacagtaaggaaaaaaaaagctctaggccgggcacggtggctcacgcctgtaatcccagcactttgggaggtcgaggtggtcagttcacgaggtcaggagatccagaccatcctggctaacacggtgaaaccctgtctctactaaaaatacaaaaattagccgggcaaagtggcaggcacctgtagtcccagctactcgggaggctgaggcaagagaatggcatgaacccgggaggcggagcttgcagtgagccgagatcacaccactgcactccagcccgggtgacagagtgagactccgtctcaaaaaaaaaaaaaaaagctctaaaaactccgtaatgaggcaacaattaaaaaaaaaaaggttagaaacactgcttcacatccaatttccagttacatgaatacaagaaagtaataagtaaaatgacatcaaaaggaataagaaaatgcagaatgtgaaacgttataaagaaaaattgacccagttacttcaacatggagggtaaaaagactttactgcggtaatcatatttagaaatatactttaaaatattaacagataaataatatgtggaatatacttcaaaatagtattagaagagggtaaggagattaagatatagatgaaacgagagttgttgagtaaataaatcactaaaagtaggtgatgggtacataggagttcattttactattctatatactgttgtatatgtttaaaacatcctgtaaaaacaaaagcatgtttggggcacattttgctttcttaggatattagagagaacaaaactatacaacacatagcttgcccatatattttctatcaaaggtgatctacaaactgatgtcattcctctcccaaataataccttttttaaaaaaagattcaatcattatataggcatgactgaaaatgagaaaataaaataaaaattttaaaagactaaaaaaacataactgggaggtatgtacctgattcaaatcctgatacaaataaagcaacaaaaaggcatttttgaaaaagctgaatatgaactaggtgttttatgatattaaggaagtatcgttaattttgttaggtgtggtaatgataccgagattatgaaagaaaatatcagctgggtgtggtggctcatacctgtaatcccagcactttgggaggcctaagtgagaggatcagttgaggccaggaaatggagaacagccttggcaacatagcgagatctcatctctaccataaaatttaaaaaattagctgggcatagtggcacatgcctattatctcagtacttttggaagaccactttagcctaggagttcaaggctgcagtgagctataattgggctactgcacttcagcctgagcaacacagcaagaccctgtctctcaaaaaaaaaaaaaaatcctatgttttaaaataaatatattgaggccaagggcagtggctaacgcctgtaatcccagcactttgggaggctgaggtgggtggtcaggagttcaagaccagcctgaccaatagagtgaaactccatctctactaaaaatacaaaattagccaggcctggtggtgcatgcctgtaatcccagctacttgggaggctgaggcaggagaatcacttgaacccaggaggcagaggttgcagtgagccgagatcatgccattgctctccagcctgggaaacaagagcagaactccacctcaaaaaaaaaaaaattaattaattaaatatattgaagtatttaagggtgaagtgactatttccttcatccccccctcactgccttattttaaagaaacctggggagtgaatgagatgatgatggtgataaacactcatgtttgccgcccctccatgcagaaagtctgtgcagatgagcacataaaaacaaacaaaaaagaataaatctataagacaatgaaaagaacagagagaaagtgtttacaatagatttctggagaacagaaagcagacccaagtgtgttaagtttaaacagaactaagcgaagcacagcccaaaatctacacatgaaaggactacagtggaggtctaagtcaatctttcagagattctacgctcccctcaatgactaagcaagggccagtgtcacctgtaggtacaaaaagtgaaatactctttttttcctaaagacagttaacaaactgaacagaaagaaactgggtcttctggtgtcaatgtcagtatctgtagagcccatttctatatggcaattggaaagctccgaagcctaaaaacaggttccctgatcttttgccctaaacctaacttgccagcaaacaagagatgctccaactatgtacaaagagttgccagtcttctcattccaagatggcaattagaaaacaagtccatgactacaatccaggaaaccaacagcagtacctaatataatcaagatggtcctttagcaagaaccatgaactaacaataaggatccccagatatacaagaagaaacaccacctagaaaaagaccaagataaagatattatctatttttttagtttttaaaagagacagtcttactttgttgcccaggcaggagtgcagtgacacaatcatagctcactacagcctcgaactcctgagctcaagtgatcttcctgcctcagcctcccaagtagctaggactatagacatgcatgaccatgctcaactaatattttaattttcttgtagagatggggtctcattatgttgcctaggctagtctcaaactcctagcttcaagcaatcctcccaccttagcctcccaaagtactgttattaaaggcatgagccactatgtcccacccagaccaagacaaataaatagatcaaactgacttcaaaaaaatcatagtttattcaggacatagaagaaatctcaaaatagaacaaagtattctcaaaggactactgaagataccgcattcaattaaacaaaaataggtatatttaacaaataataatacaagagtccactatgccaagaactgttacaaatgcttaataaatatgaactcctttactcacaaggtaggtattattatcctcattttgtagactagaaactgaggacaaagagattaatcatttgcccattgtcatggttttgaagttgtggagctgtgatctaaacccacacagtcaggaagtctggttccattgtcaatgcttttagctactatcctgtgttgtctcttgaaatgataccagcagaaaataagcaaaagctactcattaacaatttataaacattcgcaggtcagaaacatacaattgaaaacatctgtcaaaatacagaataaaaaagacagaaaacttgagaaaagagataaagaaatgaggatcaatcaagaaagccaatattctgctagtaagtatcccaaaatgggcaaacatagactaagaaatattaccaaggaaataataaaagaacattttccataactgaagggagacacttgcatttcaactgaaaggacctactgagtccagcaaagaataacaaaaacaattcatatctaaacacataattataaaattccataactacgaaggacaaagataagatactaaagcttatctttgtgagcgagggaaaggatcatttagaaaataacaagacagaatagcatcagacatcttaccgtcttgatgctcaacagaattgagcaaaaacctctaagttgtaagagagaattaatttgaatttaaatttctacacccagccaaactatcaagcaattatgacccaggccaaagctattttcaaacatgcaagaattcacaatatttacattgtaagtactctgtatactggagttaatttaaaatacattcaaagcaggatgcagtggctcatgcatataatcccagcactttgggaggccgaggagggtggatcacttgagataaggtgtttaagaccaacctggctaacatggtgaaaccctgtctctattaaaaatacaaaaattagcaaggcatggtggcaaacgcctgtaatcccatctactgcggaggttgaagcagaagaatcagctgaacccaggaggtggaggttgcagtgagccgagattgtgcccctgcactccagcctgggaaaaagagcaagactccatcgcaaaaaaaaaaaaaaaaagagtaaatacattccagctaaaaaaggaagaatgctataaaagaggaagatgtcgcatctaagaaacagtaaatctaaccagaaatgcagacacggaatagctcagaatgacatatacacagcagcttccaacctgtcaagactgaagcaggaagtaggagggctctaagagtgatatctccaggaaaaggcattccacctaacagttaatagatattatgatccaagcaggaaaaacatctgagaatatgataaaggtatatatttctctaaagaaaaaaagacaattacaaactgtgggaggaaaagatgaacaaaaagtcatctagaatataaagcaatctagcggcatgatttcgaaaaaatgatgaagtacaagaagaaataagtaaatattttatttcttgagttccactagcattatgactttagacccatagaaaaaaaaaatagccccagcactataattaagtaaagtgtaagtgagctaaatcctcatctttcttagcagtgagtcaatagatataatttgaagttagtaaatcaagaaataaaagcagatctcaacaacaacaacaaaagcctaggaggctttactggagaattctatcaatcatttaaaagaattaaccaggccaggcgtggtggctcatatctgtaatcccagcattttgggaggccgagaagggtggatcacaaggtcaagagatcgagaccatcctggccaacatggtgaaaccccgtctctacgaaaactacatcaattagctgggcgtggtggtatgcgcctatagtcccagctactctggaagctgaggcaggagaatcgcttgaacccaggaggcagaggttgtagtgagtcgagatcacgccactgtattccagcctggcgacagagcaagacttcgtctcaaaaaaaaaaaaaaaaaaaaaaaaaaaaggaattaacccaatcctcctcaaactcttccaaagaactaaaatgggagagaacatttccaaactcattctaaaaagccgccattaccctgatataaaaaccagacaaagataccacaagaaaagaaaaccacggtaataaccataatgaatagtgattttttaaatgttaaaaaaaacaaaaacaaaaacaaaaaaaaccccagcaaaccaaattcaacagcacattaaaaggattatataccatgaccaagtgggatttataccagaaattcaaggatggttcacaatacaaaaatcaattagggtaatataccacattaataaaatgaagcacaaaaaccacatgattccaattgacgaacaaatgcatttgacaaaattcaacacccttccatgataaaaacactcaataaatgaagaatagaaggaaactacctcgacataataaacaccatatatgaatatcccacagctaacatcctattcaatggtaaaagactgaacacttctcctaggattaggagcaagtcgaggatgcccactctcatcacttctattcaacacagtaccagaagtcctagatagagcaattaggcaagaagaataaatagaaggcactcaaataagaaagaaaattatctctgtatacagatgacatgatttatatgcagaaagccctaaagaagaatccacaaaaaaactgttagtactaatacatgatttcagcaaagtttcaggatccgaaatcaacacacaaaaatcagttgcatttctatacaccaaaaatgaccaactggaaaggaaaatttaaaaaaaaaaatcccaatttactatagtatcaaaagaggaaaggcaaaccatggtggctcaaacctgtaatcctagcactttgggaggccaaggtgggagaactgcttgaagccaggaatttgagaccttatctctctataaaaataccaaaaaattagccgagcgtggaagcatatacttttagtcccagcttcttgggaggctgaggtaggaggatcatttgagcccaggagttcaaggtcacagtgagccatgattgtgccactgcactccagcctaggtgacagagaccctatctctttaaacaaagaaaaggggtcgggtcgggggggtagtgtggataaaaatactaggaataaacttaaccaaggagataaaagacttgtactctgaaaactacaaaacatcgctaaaagaaatcaaagagagaatacaaataaatggaaaaacattccgtgtttttaaactgaaagagttaatactgttaaaatgtccatactacctaaagcaatctatagattcaatgtaatccctgtcaaattctcaatgacattttttttgcagaaatagaaacaaaaccatcctaaaattcatacagaatctcaagggacccccaagtagccaaaccagtcttgaaaaaccaccaaaaatttggaggcctcatactttcttatttcaaaacacactacaaagcaacagtaatcaagacagtgtggtactgacataaatacagagctacagaccaatggaacagaacagaaataaacgctcgcacatgccaccaaatgacttgcgacaagggtgccaagactacccaatggagaaaaaacagtctctacaacaaacagtgttgggaaaactgaatatccacatgccaaagaatgaagccaaaatatgatattactaatttattttatgatgacctaaaagttttgatttccgaatattttttcaacactttttaattaagtattttagatacatattagaatatttttctgcctagaaagtaattcaaaccatatcactgactaaagatttttgggattgtttgtaaatccgtgaaaaagtgcttaaggccaggcatggtggctcgtgcctgtaatctcagcactttgggaggccaaggcaggtggatcacctgaggtcaagagtttgagaccagcttggccaacatggtgaaatcccatctctactaatagcacaaaaattagccaggcatggtggcacacgcctgtaatcccagctactcgggaggctgaggcaggagaacagcttgaacctgggaggcagaggttgcagtaatccaagatcatgccactacactccagcctgggcaacagagtgagactccatctcaaaaaaataaaacaaaaacaaagtgcttgtttaagatgcaggagagtggacacttgtttactaaattcaagacacactacaaaacttttgcttttcagtaaactctcgatgttttcctttttgcctgtgtcttaaaacattaatgtataaagaacccaatagtaataaaatgttttgtacatttgtttgccatttaatctagcttgtactaccctatgattaacagcactgaagtaattaataattacagttgtaatatgcagcgagtcaagtggagcatcagtgcaacaataccaaacttgaaacgagtgcttattctactctcaactatcaccaagccaatcctcctcaaactcttccaaagaactaaatgtgagagaacatttccaaactcattctaaaaggccagcattaccctgatatcaaaatcagacaaagataccacaaaaaaagaaagctacagcaataaacctaatgaatactgatttttttacccttaaaaaaatactagcaaaccaaattcaacagcacacagtctatgtgctgttgtactgcagaatctaatactcctgggtatttttgttatagcagccaaaactaagatatccattctatcctcacatgctaatagactctaatcccctacaccttgatttggttttctctacaatacaaatatccatctagcatatatttaactcactagtttctcatctggtttcctcagttagaacataagctccctgaaggcagggctttgttccccagcagacagaatagtagctggcacagaacagaatgctcaataaatacttgctgaatgaacaagatgaagaccaccattaaaggtatactaaaagacttcaaagcactactgagaaaaatgaaaggcctaaatgaatggagaggtatactgtgttcaaggatcaaaggactcaatgttgctatcagttttctttaaattaatctatagagtaaatacaaccctaaacaaaatctcagcagccttttctgtataaagtgagaatttttttttttttttttttgagacagtcttgctctgtcatccaagctgagtccagcagcacagtcaatggctcactgcaacctcaacctcctgggctcaagcaatcctcccatctcagcctcctgagtaggtgggatcacaagtgcatgccaccatgtctggctaatttttttctatttttttggagagccaaaggcctcgctatattgccactacactccaacctggtcaatacagaaagacctctttatcagtataaaaaaaaatttttttgcttcttgattatggtgattacaagaatgtttaggtttgtcaaaactcaagctgcatacttaaattgggcagattttaacatatatacattataccccaataaaaatcaattttaaaaaatatacatcaaaaactgaaacccaacaacaaaatacctaaagaacactacataaaacagctcataaatattgagtattctgcatacctttaaaaaatgacaggcgccagctagagtggctcatgcctgtaatcctaataatttggaaggtcaaagcaggaggatcacttgagcccaggagttcaagacaagcctgggcaacaaagtcacatcctatctctgcaaaaataaatgacaataataataataataggaaattgtctgcacttaggtaaaatgaactagtttgaagcaggccaatattcttgctaagaacaacttaaaaagctaaataaattataaaaatcatatttttaaagttagtgaggagctgtggaagcatgggaaagaaggtctaaaattccagtgatgggagaatctttttttttttttttttttgagatggagtcttgttgctctgtcacccaggctggagtgcagtggcacaatcttggctcactgcaacctccacctcagagatggggagaatattttaaaggtatttagatgaccagtatctgtcttttccctgggagtatttcctaattattgcttgggttagaggctgaaaattgaggcctgacctgtgtaaaatattgttgctgaggaacacagaagccaggacagcttttggtgttcacacagggctggaataacaacactaggagactaattctcctaaaaagtttcacgcaaggacctcaagcttaaaggtggtatctcccctcagcatacttgctgaattttaaaaccgtgcagggtaaaaggctacaaagtcaactaaaaaactttgaaaagcaaagtgaaatttcctacctttggcattgctaaagggacaagaccaataggctttgaaatgaatgccttagaagacaacatctgaaaaaacaaggaaaaataaggatagcaaactattaaaatagcaacccagcctccacataatttaagatgatgggctcctgatatgggttggatgcttgtcccctccaaatctcatgatgaaatgtaaatgtaattcccaatgttggaagttgggcccagtaggaggcaactggatcatgggggcagatccctcatgaatggtttagtaccatctcctcggtaataagtgagttcacacaagatctggttgttgaaaagtctgggacctgccccaccttgctctcttgctcccactcttgccttgtcatgcacctgctctcccttcactttcagccatgactagaaacttactaagcctcactataagcagatgccggcaccatgcttcctatacactttggagaaccgtaagccaattaagcttcttttctttataaattacccagtctcacgtattcttttatagtaatgcaaacagactaatacagctccctagcctatctgcatagaaaatgaacttccccttcccccacccctctcccaacccggcaaaatgtaccattacctggtaatgcttacttaagttttttactacacaatgcctggcattcaataaaaaattatgagacataaacaaaacaatcaacagacttgacctaactgacatttgtaaaacactccacctaacaacaaaacacacattcttttcaactgcacatgaagaacacttacaatgatagaatatattctaggccataaaataaatccgaataaatttaaaattatctcattacaatggaattaaattaaaaataacaatgatctctggaaaatcctcaaatatttgaaaactatataacacacttataaataaactatagacccagtaagacatcaggaaagaaattataaagtactctgaatggaatgaaaatggaaacatatcaaaaactggaaacggccaggagtggaggctcacatctgtatcccagcactccaggaggccaaggaaagaggattgcttgaactgagttcaagaccaacatgggcaacacagtgacatccttgtcttcagaaaaaattgtaataaactctggccaggtgtggtggcttacacctgtaatcctagcactttgggaggctgaggcaagtggattgcctgagctcaggagttgacgaccagcctgggcaacatagtgaaaccctatctctacaaaaaatacaaaaattagccaggcatgatggcacgcgcctgtaatcccagcacttaatagactctggtgcgaggatctcttgagcctgagacgtcgacactgtggtgaccccgtgattgggccactgcactaaagcctaggcaacggagtgagacccagtctcaaaaaaataaaaataaaaataaaaaattagccaggcatggtggcacatgcctgcagtcccagctactcaggaggctgaggtgggaggatcacttgagcctgagaggtcaaggctgcaatgggccatgatcacgatactgtactgcctgagcagtagtgagaccttgtctcaaaaaacaaataaataaattataaacaattaaagggaagtttatagcatgcttacattagaaaagaaaaaaggtcacaaatcaatgacctcagcttctatcttaagaaaccagaaaaagaaaacaaattaaacccaaaagtaagctgaggaaaggaaataaagaccagggcggaaataagaaaaccacaggcagtcaattaaactaaaagttaactttttaagaacctcaataaaattaataaacttctagccagactaatcagggaaaaggggagcagagacaaattactagtattcggaatgatactaaatctctacaggttatacagatattagactcattacactttctacagatattaaaagaacaataatagagtattataagcaactttttgcaataaatgcaacaagttaaatgaaatgggtaagttccttcgaaaacttatcaggcatgtgaagagacggaacaatacaaccatatgaccaataaccaacagaaaaacaaacaagataaacagaccaatagatgatgccgatattggaaaagacaagcatttaaataactataattagtatgttcaagagaactggagtctattacaagtctataaaacaacatcaaaggaatactctagaactcaaaaccacaatgtaaaattaagaacacaaaagattattttgacaaaaagagaagatagttttggcatactggaaggcaggtcgatagaaaatatccaaacagagaaaaaaatttttttcaacatgtggaacatgataattaagtttaatatatgtgtaattaggatccaaaaagaaaaaaggggcagaatatatgaaaaggtggtaacagaactttccaaaactaaaaggcatccagctagattcaaaaaactctataaacataaagcaacaaagaaaaccacatctgaacacatcaaagtgctttaaaagtaacacagagagtcttaaaattagccaaggaaaaataaaagacacattatcctcagcaagaatatagctaatacattgccttcaataagactggtagctgacttcaacaaaaagaaaggaagacagaaagcaaccaaacattcttaatgtgttgaaagaaaataactaccaacttagaacttaatagccagtgaaaacacacttcaggccagccacagtggctcatgcctgtaatcctagcactttgggaggccaaggtgggcagatcacttgaggccatgagtttggagacctgcgtggccaacatggcaaaatcctatctctactaaaaatacaaaaaatttagctgggtatggtagcacatgcctgtaatcccagctactcaggaggctgtggcatgagaatcatttgaacccaggaggcagaagctgcagtgagctcagatcacgccactgcactccagcctaagcaacagaacgagactgtctcaaaaaaacaacaacaacaacaacaaaaaaaacaccaaaaaccacttcaaaaaaggtgaaactgccgtgcatggtggctcacacctatacccagcactttgggaggccaaggtggggggatctcttaagcccaggagttcaagaacagccggggcaacatgacaagaccccgcctatacaaaaaatttaaaaattagctgggcatggtggcatgtgcctgtggttccagctactgaggaggctgaggtgaaggattgcctgagcccaaaaggttgaggctacagtgagccatgttcacaccactacactccagcctgggtgccagagtgagaccttgtctcaaaaaaaaaaaaaaaaaaaaaaaaaaaaggtgaaattgagatattttcagagaaacaaaaatagaaaaaatcactgatactaggtaggccagtatcaaaatgcatgatatagggaagtgacagtattattatcctaaaaattgaaaacaacttcaatgtccaacagaagattgataagtaaattattacacagagatgagaatgttacatacctactaaaaataatcacatagcagaaaaatactgacatgaaaatatgttgatgattcactgttaactgaacagcttgcactgcagtggactacattaggagcccataacatcatataagtatacatatacttatgtaatggctcaacaaaatgcaggaagcagatagataatcaagaagattaacaacagcactttcggtggtatgatctccaatgatattaattttttttttttttttttgagactgagtcttgatctgtcgcacaggctggagtgcaatggcgtgatctctgctcactgcaacctctgcctcctgggttcaagcaattctcctgccttagcctcccaagtagctgggattacaggcacccgccaccatgcccggctaatttttgtacttttagtagagacagggtttcaccatgttggccaggctggtctcaaactcctgacctcaagtgatccacccacctcagcctccgaaagtgctgggattacaggtgtgagccactgtgccctgcctaaaatgtaatctatgctttcttactgtttcccacattagggatgtgctattttttaattgggggcaagagaggaggggagaggaggggaggggaggggaggggggaatggagaaaggcaactctttacattaaaccatattttaatacaaatgataagttcttagctaggcatatggtctaacctttattggtatatcccccatgtgtgctttttaatttttttttgataccaaaacctgccaacatgaatcaacctgtactttcattttccactatttggaccttgagagcttgctcgaaggttctagcaggggagcgcagctgctcgtatacccttgacccaagaccagtcctcctctatttgggatggttgtcctcttcaaccaagcacgcagcttcagcttcaggagggacgcacgtggagtggagagggaggaaggggacacctgccgagccagccagatgagctgaatcaaccctggggatcaatggggtaacatgtcacagccagatagccctcacattcaattttccactatttgggatgagaattaaaaatgttaagtacctgaatgtgacctctttgaaaaagaaacttaatcgtcgtcattattaatgtaaaaaatgaaaatgtttctgaaaaatgaaaagcaaattatatccgaaacagcatactttaaaagacaaagtaattcataaaatttcatttttcacaagtgatttctgtagacttctaagacttaaaattaacagaattacatctctgtgaaatatccaactaaagtaataactcagagttgaggctataagagtaagtttaaataattcaacatttgcataatcaaaaaaatggaaaaaaacaggaatctcggtatccacctgtttcacagaagttacacctaatagggcttttaataaatggttgtaaagcaacctgtaaatataaatgccattatgtaattatagtcaattagtaacaattatattgctctgacacttgagtgttctataaataattcatacaactccatctagaatttttgatccagaaaaggagaaaatgcaacagccattggtgtaatgcctacaaggaacttaaaaaatattttactttatgcatctgtaaaaaactataaggaaacagataaacatcaaaaggtttagctacagtgcagaactttgacttttcccccacaatattgttttattaaaatagtcacagtaaataaatgctttatttgacacagcactagaagtaaaaatgtgtggaagaggtgacataatatatatgcttcaagattgagataagaggaaacaattttcttttaatattaacactggctgacatatttgatggtagacaacagttaactgataggatttaatttcctaatttttctagcaatcctgaaatgattaaagaggctgtattataattatcaaataaaacatcaaatggttctttccagcgggaaagcttaaaaaaaactactgaaatagctatcagtctcacagatgcctgctaaaagaacataacaactccttacgttatcaagagctaagatctaagtttcctttcttaactaattaaaaggttaagatacgtattctccctcaaaatcccatgcctctccccccaccaaaaaaaaaaaaaacagccagaaataggctcatccttacaaatgttgtatgtaattttcttataaaatctatcattttccaccttgtgttataatgtctatgcttttcagttgggcatggtggctcatgcctgtaatcccagcactttgggaggccgaggtgggcggatcacctgaggtcagcagtttgagaccagcccggccaacatggagaaacaccgttgtctactaaaaatacaaaaattagccgggtgtggtggcagatacctgtaatcccagctactcttggagggctaaggcaggagaatcgcttgaaccaaggaggcggaggttgcagtgagctgagatcacgccactgcactccagcccgggtgacagagagagactctgtctcaaataataataataataataataataataataataatattattattattattattattaatgtctatgctgttttaaccatactagatttcaaaaccactgaaggcagggtcaattatactgcatctttctaggtatctcccatagtaaatagtcttgatcaatactctgaactttttgcaaactccatcagctaaaaagaattaaggtttggtaattctttgtaacctggtttaaaacaaaccctctggaactattagagaaccagagggatggatggaggagagggtagtgcatattagttgtttgttgtcagttaagcaaaagccaaaccaaagagcctcttctctccttttcccttcaaaagctaaattttatccaagtcagtatcagtgtcccttagttaaggacagtctgcttaggttcacttcagaggagctcaagaggctggtgtaatctacgaggctttcgtaggagtctgcaagcaagtacagaaggaaaaaaaatcaaagtttaacccatacactatcgatcaagtcaaaagccaaagaaaaccctaaaacttggactctaaagagtcctataaaattcatggaatccaagcaccttttgggtttgttttgtttaaaacagggtgtcactctgtcaccaaggctgaactcctgggttcaagtgatccctccacctcagcctcccaattagctgaaactacggtgtgcaccaccccatctggctaattttttttaaaaaaattttgtagcaaagaggtctcactatgttgcccaggctggtcctgaaatcctgggctcaagccattctcccacctcggccgctcgaagtttacagtgaattaaatctataccagataaaactcacatcagtatgacctcccttcaaactctgcaaatgcctccataacaattggcccctcactagtgaaaagatgagtatgacctatggtctatatcagatgttaagctttctgacaggctccaagtcatgtccctgtcctgtaggtaataacagagcccatactggaggcaaaatggcaaagcagatgatcattcaagatgattccgttttcaaggctgaaaagaacatatttgcaaatgcacagaaaaagatctacaagatcatacagtggtgttaacagtgttacccttcagtcaagggtatacgagtagctgtgctccctagattcctctggggaggaatgtgagctagaagtggatgtaaaggggttgtcacttattatatatacactgtattaactttttatgagcatcaatttacttctgtaattttaaaaataagagtcccagctactcgggaggctgaggcaggagaatctcttgaacctgggagccggaggttgcagtgagccaagatcgtgccactgcactccggcctggtgacagagcaagactccgtctccaaaaaaaaaaaaaattgaaatgtaattccatttttaaaaaagattgaacggacccacatggaattcaaatgaaaaataagtgacactttgcagaagtctattagaaaaacctacatatcaaacagaaataatataagtatcctatcctacaaaataaaaaggaatactggtaatattacaaaaatgcccacagcaactgcaatccattactcactattcactactttcattacacaatattagtcaccagggggagtttgagggtcccctcccaaaattatatctcatctaacagctgcctgtgcagtcttaacctcattaaacaggttttcaacaatccagtcctaaaaaaatgttcattttgtacactttcatgagaaacaaccagacacacacacacacacacacacacacacacacaccccaatttacctttcactggggttcatgtttgatttcctcaaaagaaagaaaagtttcccaacctgaaaagcaaactaacctagacaatcaagtttactagcactttaagggaatgttcacatcctcctcataattgtttgtcatgaaactttggggttaagtaaaattttacccatctatgactcctgaaaaaaagaggagggggaaacacaaactacactctgaaagcagcataatccagccataatgccaaatgtaaacagtcatatattttagcaaggcaagatataactaaacatctttaaaagataaatgcctgtgacctctgcaatcttaaaaattaaagtgtaaatagtcataaaaggtatcccaaacttcctttttagttgattttcctaaaaaatatgaaaagcaatcatattgaaaatgactcaaatcaccataaattaggcaacaaaaatcacacaaattatttgggggaggaggatttttgtttaatccagtttatgagtccataatacacacaaaaatttgaaaacatgaagacatacacataatacatctcatttcccaccattccctcagactatttctccctctcctctattgttagttttctaaatcctcccataatttctttatataaagagcaaacataaacttgtattattacacctcgcccttaagatgtaacacactattcacaaagtaccgctacaccttgcttttttcacttcatagcaaatttttgcaatctttgcatgttagtacgtagaaagcttccttattcttttttcataactgattacgcctagctttagaacattttcagtctgctttcttcaggctaactttttttttttttactttttttattattatactttaagttctagggtacatgtgcacaacgtgcaggtttgtcacatatgtataaatgtgccacgctggtgtgctgcacccattaactcgtcgtttacattaggtatttctcctaatgctacaggctaacctttcaagacattctgttcagccaaccacttatcacaggaattaatttccttcccccaagctttgaaaaccaatcagatttgaggtgtcccaagggataagtttcagagaaagcaattcattatctaaattacatccttttaagaatgtttattttcaaacaggtagaggggaatattgcacaattttctctaatcgcttaaagctacaaatcagaacgcaatcttcaaagtgaaattacctttgatttggggggatcagcgttatagtcaaatcaacgactgtaaaagtttacttcttgtgcttttcttccactgtaaaaatttttttattttttaaagaaggctaaaaagccttaaagtctaatagcacggcattctaatagcaggaaaccacaatctgatttgatctttcatctgccaggtcagagactaggcttttatcttgcagaattaggctcacctaccatcaacaagaggacctctacaaagctacaaacactttcaaagaatataaactctgcggcgctgcgtgtaggaaattacactccaggggccagagcgccagagccaactccagaaaacccagcttcactggcggaaagaaatctacaaacgccagcggcggtgacggggaacgggaagcgcgggtggacggaagaagagaaaccgagcgcctcgccgccaaccctcgaacccgcgcgcggtcgctggagtcagacgctaatagccgcgcgctgcctaggaacggaaccccggaaccaccaccactaacggaaccagcccgcggccggcaacggcggccgttcggactgcggactgcggcacgcgggccgggcgccgggagggcgggggttccccggaggagctggccgccccggcgccccattgggcgctgctccaaacgtgcccgagtggtgacaggaataaagtgggtcacaaggcctagcgggtccccagcgaaagctctctcggcacccggtccccgtctttccccgcctcccagctgctggaatcggccgcagctccgggcgccctcaagccgcccggccccgccgtgcaccccactcccgcccctgccccgcaggtaaccccagctgccccagagggcctctcaggcagggcgggcctcggcccgaagtcccgggaaaagacacactagaacgacacgccaaacttgggcttcagctcccgccttccccacccttggccgccgccccccggccccacacacgccgccccccgctccctccccttccccgcgccctcaccgtgtggcttgcggcggctccggcttcttccctcccccacccaggtctcccgctgcggtgactcggaaccactaccccgcctgtgtccaggaggcgccgcggctcccacctccagcagcacctggggctgtgagtggcgccccccacccacccccccaaaaattcgccgctcctgtggccagctcctcctccccctcccttcccttcccctcctccaccagcccaggagcgcgcatgcgccgccaaggaagccaaccggcactcggcaggccctgggcccaccgggcgggcgcctctcaccgggagcgctcgcggcggcggcggccagatttccttcgcgctctcgctctccggggtttccttttttaaaccggcagccgcaagccgagtccgtgattgcgccccctcccggcgcatgcgtcgtcagc

SEQ ID NO: 1593 - DNA, 118033 bp, Homo sapiens
tcattgatagtgatcttaaaatatttaatagtctttctttaaaatccaaaatgtgattcttacaagttatgtgccacatgaagcaggtgttattttttgagaaatgcaggtgataactgaaaaacatagcactgaggtattttttatttttaaaattgaaggaaacaaagtctggatctaattatttttacatttacaaaaactgctactgcttggctcttttgctataagtttaggttctgaatacatgacaagagtatgggaaagagcagaataatagtacacgcagttttaaaagctatgcacatcataacctggaataatgattacacagcaagaggcctgagtggaggtaggctaacaacacattttgactttctcctcaaaggatagctttgaaaaacaagtgtaaccaattgttacaccaaattaaaatggcaatattaaatcggtaacaaaacgatccacattttatacaatattgtatttccaaacatacataggtcatgaaaatcagagaacctaatatagcaccgttgaaaccattcattatccttcatgtgtgtatgcaattcagaatttcggcagaagacaacaaatggaaaatgcctttcgtttctataaatcattttggatttcaattaaatctttgccttagtaaagggtattcttatctcaagatcaattagccgtttttagctccaccgttttggaagtaaaaatgatgagctacatctactttttaatttaaaaccaagaaccaagcagtaaggacagcaatgtcaagaatatcacattgagaaccacacagaacattataaagaatttggtgcatgttttaacaactaccaactgatgttaacaatgaaaaatttacaaaggtaaaactttttttttttttttgcactgactggtttcaatacagcactgaatttaactcatctttgggcttcaatctttacatagagtgaatatgaaaatgccatactgaggccttccccaacttaaaccatagtaaagatttcaaaatcattccagtatggtctgaatggtaactgttctggctgacacatctttttttttttttttttttttaaaaagacatttcctggccaatttttttgcttgaagatgattgtctggttatacaagacatcaatctgaaggtaacaacttattttaacttaactactggcataaccattgccagcagtgaacttgcactagtccaagccaactcaaaaacacacattataaacatttgaatgtcatttttaaaagcgatgtcacagtttgtttcctaagaaatttaaaagcttttatttgaaaacgtatcttcagtttaaccctcagagttaagaaatattttttagatcattaaattcaattgtggttgacgtgctttaactaccgttctctaagttgtgtgctatacctagcctgtgggactccatagcttctctgagtcctaaagtggaggattctgttccaatgcttgtgagcaagaaggatcctcaaatgtctaggtttccaatattccaacactgctttactgggcagtgctgtgtatggaagttttgttttgttttcaaaggaccaagtaacttgacaccatattaaagacagcaaacattttttgtagaagtttacagcctgtatacattattccgccaaatttaagaactttaaatggattttaatatggatatgataatgacagccattaaaagatgctatttcttttactaacatttccccaaatgggcaaaatagaggcatcatgtgccattggttctgtcatactggcctttgactgtgttggggaagtaatcacacaaaaagtgcccataaaacaaagaaggcagcaagtgaaactagaaaaaggttggaactgtatgaatcagatttgaaaggagttatttctaaaattctttcttagatgacttgaggagggaagtgcaggggcatctggagttggcccctccactgccgtcctgaagtaaagtagattcagactgtccgtaaagattatcatgagagttggtgactgcaccccaaatcagagccagttccctaagaagaatatggtgcaaaacaaaacaaaccacacattaaatacatgacaccgaaatcactttgatgagaaaacagaacacacaggtattttaaaatataaataaatacatttagccatttttattcaagaaccccagagaactgctttaaaagcaattgcttctttgaacccctttctaaattctttcataaatacttactagtttgattgtcacttaatgcagcacctcagtgtttgctggtggtggtgatggaatttcacttagttgtctctccataaactatatcctattccactaaataatgtttccctgaggaaacccaggcagcttacaaaatactgttataaacactcacaacaaaacctgcagagtattttatttaagaaaaacaaggaatgtagtgttatgacatagggggaaaaaactatgcaaaacagtcacatggaaagaaagtattttaatttttaaaatccaagtttgcttaatttcttgtgaactgttcaacactgttttaaatatcctgaataactgtgccaacaaaattcatccccagtgtttccacaggagacattaaaattaaagaccaaattatactatttttttcctttaaccaaagtattctttttctcagtcctttttgtgcaaaaatattacaagagcaattcaaatggaaatgctgaaatgacatgccaacatttcagggcacatttaaaacactcagaataattcttgaaattattatattctaaaatgttactagcaatcacttttagattagttctgtacatctactcacacggatgcaattttcctagacctctgaaaaataaacaggctcattggtctcttttggtgtccacacaataggcaagataggtttacaatagtgtttaaatcaaactaggcatctacaatctcttgactccaccacattcaaaacaaaaatcaaagttcatttggctatcttgaaatcactcccataaaccaactacggttcactggacctaaacatttctcagaaatgtgtcattttatataatttcacctaagtaagtgatgatttggggatcctttagaaatggttaacgcctaagaataaactttatcaaaatgagtaattgcaataaagtgcttgttacatttcaaaatgatgcttttagactgtggtatgttgttttaaaagtgtgtgctattccttccgtaaaggatccccaggcatgagagttgggtcttctcacctgtctcataaagcagcagcactatcttttggtaggctgacaataggcacattacccatgcggatgaggctatactagtgctatggcaaaaggggaagtaaattagaaaagtgggaggcatgtagagggttcctattatagttatatacaaatatattaaatatactataaaaatagtcgattctattcctttgcaattacttcagaagctccttttagaagaaagctcacccaatccaaacttaaaaggttctctttctccaaacacttaaaatggcaagtgcctttgtgctgtttcttctctaccattcaaaaattccaatcagcttgtcctggctagaaagactcactcagcaacattaatatccagtgtttacccccttccaacagggactcctgtgggactaagggccacaggtaattggaaaggttatagacttgaatgcgttttacacaaatattcatcaacaaactttcaattaccaaagaaacagaaagaaaaaagcagaaatactaaagtaaaatgctatttgcattccacttttaaaaagtttgcctcaatgtagtggaaacatctgaaaacatgttgagtaatatccagtttaaaagaattttcacttgtctgcgtagagtactattttaaggatccctttctaaggcttcctgaacaagggttcttctcccttcaacagtgctcttgatggagctggactgcttcagtgctcctagcgtcaagcagactgctttaaggcaatgaccaacaactacagcacttctgaagaccaaacattttcactattttgcactgaatgttctataacaaactattccaaatcactggcatcttgttattactattccattcctaagccagatataaatgacaaaggagagcacagcactgtcaagttacccccggaatttgggatgctcgaaggctagaccgtagtatttactcacatgctacctgcatctcccatacttttctccaatattttccattcaaaaaatgaagtactttttaagtgtctcggttctggtttgacaccactctaaggagcaactttattaacccttctagttctcacttgcatttgttaaacaatactgactctcccaaaactatgataactgcaagtccaaagcacggtaactgcagagtagctagcatttttcctgaaactcagtagtttcttacctaaaaagtaccacccagaataagtgtttttaagaaagtgagaataaagcagagggaagacttttttttttttttttttaaagctggaaggtgtttctatttggtatctttaaatgctatagatttgggattttaactaacagctttggctatagaaatgaagaacagacactgctgaatcttcatttgaatgctcaagtttcatggggcagggtggggggcgggatagctttgcaacccaaatttaagagaatcaggaggaaaacaaagcagcaaagaggcagctggtgcttactacctcttccactactacgcttcagactgacagaaaagcagctagctgctcctttaaattagcaatggttaattctaagcaggaaaagatgagctgcgaagaacagtaagaatcataaaggaaaattttaattttttcccccgactatttgtggagatgggaaataattgaaggggctggagtaggacaatgtgagtaaacagtttagacgtttacctggggcttgtcttatgctttgttgctgtcaacctaagtagtactcacagttcaccatcttttaagtgtggtatgtagaggacaggcctcaatataatagttcttcatatcttttgttagctaaatccgtatcactaggtattgccaataaataaatgaggcacaactcagatatatatggaatggcataaggtcaagaaaggcaatttgaaaggggagaagaacaatgctattgccatattccacaacatcccccttgtctgtgtacatatgctcaggtacatacatattctgacaactattcttgatattcatgggaatgtgggaaatctctactggatggtcatttagctagaagagctccttgatatgttaattactgattgatatctagtcacacttcttttgtagaagggtaagtaccaattttctttggttgttttctttttcaacattaatgttcaaagtaattgtagccaggtagaattttctgcagaaagacaaagtatatgccttaaggataacagcaaagcagaggacagagaagtcttaagaactggcttagcattcccctgacctctttacctagcaattctgcattaggttaatcttcattattcagaaccttttctgttttaacaacctcaactctgttacacattttcttttgaggtcaattttgatttattacacttgtcctctcctccctttcctcagtaataacattttttatattctaataatgtattttctactaatcctcttttgttctatcactgtaaatttcattagtaccataaaatctgtaaaatgttttttaaatgtatgtaacttgtattggaatttattacttttagaatatgatattgccaaaggaaatcttagttcacgtttagaaggcatgtgagttacaatattctaatgttgtagtgaaggcatagccaaatccctaccccttcttttttctttgtaggaatatcaagatcatattgagcaaatatttctggtaaattcttaaatgactaaagaaaaatgctgatttaggaaacaattttaggatcacattaataactatgatagtgttaggttatcatcttttatttctaaattatttgtacctccagtccaagagactgatagcagtcttcagaggaacttattaggagactaataatgacactgacacccacatgctgttaaaaaggtactaaggtttcaaaactgctacggaaaccggacaatgacttcaagatggtgagttatcacctgaattaaaatcaaggcactatggggttttttcccctcaaataaccctgaatcatttctgactaaaagaagcattgaaattgtgaaggataataaaaaagatttcaacaaatcccaaaagttaaaattcccatgattgagaatgttaaaaagtgcctaagatgttttgtgtgcaaattttacctctataactgaaacattcttgaaattactttcaggcttgttgaaaaccatttacgcaaatatttccaactatgaactataacaaaatatgcaatcaaaactcccagccacctaaaataaagcagtgcaaatcctattttcaaacataattgaaaaataatgaaatgagggatatttctgaataacttgaaaatcctgttgtatcaataatttaacctgaaaaaaaaaatccattcccagcagcacatcatacctcactgaacaaactgtgacatcacagccaaagtatgaacaaaaaaacttgtgccccggaaaagtgaacagaacactactgtgttgtaaacaaaaggaaaaacaggatggatcagtttgcacatggtgtcagaatttcaggaaaggtgctcacacctgtaaggaagagataacgctttcatgcagcatacaaaatgttttgctttctctccttttatctagacatatacatatttttacatcatctgtacatagagaatttgaacccacacaacattctgaaagtaattactgttccatcattatctgaaaagggagaggggttgggggagggggtcgctaccaagtctactggactgtcttcatggcatcactgtaagcaaacccctgacatggcagtggtatgtcctctgtaacacttgataagaggcacagaaccactaaaagttactaacatcattagtgcctttctgattccctggaggtcatttcatagctgagcttcttaatatttggcaatatattctttttccatcaaaaaatatccaggcacctaaaacactgtcagaactggctatgcccctatgatcacctcctgctggctggtatttaatgtacatctgtagcactaggcagcattttctctgccaactaattccaggaactagaacactcaatactgcatctcatgaaactgctggaactttccctcctttcctcaggtcatctgagtaactcttaatgggccatccccttcctcccttgatgtcaagagaggaagcacgtgtgctactgtggttgaaccttggaagggtcgggcaagctgtcagtcctgtgccggctgagttgctgctgttgctgagactgatgttgctggtgatgtgactgagggaaggtgctctgttgtagaggaaatgcagcagagagaatgagttgagttgagggattcccatggagcaacctagaagtctaaaaaacaaatggattatgcagcattgctttactccctttatggcacccacataatagttactcacactctcccctgtccatagggacaaaatccttaaaattctacataatgcatatcactttcactctctggtttaaaaattctaatttggaaaatgcttatgaggccttccctctttctgaaagtatgagagagtttcattttttaaaggaatctgagctacagattttatggtatagaaagcaatctatatcttgagccaaatcacacacgttctttcactttatgtcctaaagacccatattttaaattacaaaatttgagcatagttatgactatatgaaaaacaaatactctgaggccagacagacaatgccttctgcacacaggttcgctcagctggttagagcggcacagttaagtggccaggagcgtggtgggccctgaggtagactgaatggttcaaacttgggctgccctacttaccacatgtgtgacttggtcaagctgtttacttctctgggcctcagtttctttctttagaaaataggaataacagtgcctaccacattgggttcttaataaagattaaatattaatattatttaaaagcatcataaatatgaaggcaaagttgcagccttaggtccgataagcagcagtgtggtataaagacagacaaacaaaacaaaatgaaaaaaggcacaggatttgcagacagaagccctgcatttgagttttgctctgccatttacataagtaagctgtgtgactctgggcaagactcaaatagatgagcctctgttcctttcaccaaatttgtacttctgacatgctgttcattaatgtaaaactctcagatacaaaaaaatgttaacagaaagaaagtgaatttttacaatgaaagtcctttccccattactgacagtacaacttgatgcagggttcttaatttcaaaatggagctgtggtgggcaatttttgcaaatgtatatgaaagaaacatgcacaaacacacacacaaaagagcaaatccctgacaaaccttaaagactactacactttgtcaaggatcttcagagttttctttctctctttgttattaggaaaagctgtgtaaggcaaagacttgatacttatgagccttataagattacaacaggagcatgttttaaaactaggtattacataatttagaaaagccaaattgtgtatttattacctacatacaagtgtatttatgaggggtattgcctatcttatttctttgtgggtcctatgtctttgggatgccttttttttttttttttttttgagaatgtttattcttttaagggcctttgttccttgacatacttagaagactgagatgttaaggcaggtcctctcctttttttagcttatgcttaattctcattggatacattttccctacataataatttagaacttgttttaaattgttgttatttctttatttgtaatagtagctaccccagttatgtctgcagcataggcttaaggtctaaaagactgtatgactctcagatatttaggcaactagcctgttttagttttctacatcacaaagacaaggattatatttggaccaggacacaaagggtgacaaattaagactatatttatgcctgaatatagagtacaataatcacatcacatgttatataacccagaaattgatgataagtgcccagcctagatgaagtggtctctagtacacatacagactagcctacattcaaaattgctccagctaggccagaaggggaaaaggtagatttctagtgaggatcctgaggtccagataagggttttgtacatttctctgctgaggatcttgcctagtgactttcttctgtatcctatagataaggagagcctgtctgattcactaaatgatatctgtgtctatattttggctaatccaagtgtctattacatttgtcaatatagcggtcacaaataacagctagccatgtgccttgtcttatattcagtgatttacaagcactattaatccatgaggtatcaattattatgacctccactttacacgtgacgtttaccaagagtaagcaacctgccaaaggtcacgcagtacgtggtgcagcagtgactcaaccccaaggcagctagactttacagcccaagttcttagctatacatatacttagctcatagatatactacacctccatggtatttctcctctgatattaatttacaactgaaaaattataataagattgaattcaacaaaataatttaaggtaacacctatactagtaaaaagaaatccctgctctgtacagagcagagtttatggttggctagaaaaaggaggaaagaggtgcttgcttaagttccagaaactctagccagagactaagaaaacaggtgggcaggaagtaggccactcactctgtccagcagttctgataactgggtatgcccaatggcacgtctaaagtcttccaacgactgagcaagggaagaaaaaaaatcgccaaccagaacaagctttctatctttgtagagatttaaactgtacaataagcttttgtgaatttttcacatcactcacaaatctgttcacttaatgcttaatttcattacatgaaagtaaatgagtttgaagcagcttccccatggggagaattacctgtaaaaattgttgcggtggctgggtcagctgagcctgagatggttgctgaactgaagtgagctgctgctcctgggagctctgctgctgctgctgctgcgttactgacaatgtctgtgactgttgctgttgtgtagcaaaagtaggatatgcagtcaccacctggcccataagcatagtactaggtaccatgactgccccacaagctacaggagcagtcactaatttggtcacaagttgttgaccttgagaaaatctgttagaagaaagaaggaaaaaaattggagtccaaagtacaaggtatacatcataaaacgcagtggagtaaatacttacctaagataatacccaatgacattgccagtttgtttttcaaggtctgtatattcctactttgtttcattttaaaagattccctttggtgtaacagtaaaacaaaaaattcatacagcaagatcaatgtgtaacaaaaatacaaaacgtctttggatatccacattcaaaagaataaagttagatccttacctcacatcacagacaaagattaacttgaaatggaccaaagaccaaaacataagagctaatgctataaaactcttagaagaaaacataggggaaaagcttcatgacattggatttagcaatagttagcagctggaattagcaataatttcttggatatgataccaaaagtacaggcaacaaaagaacagataaacagataaactggactgtatcaaattaaaaatcttgtgaatcaaagggcactatcaacagagtaaaaaggtaactgtcccatcccacagatgggagaaaatatctgcatatcatccttctgataagggattagtaaccagaatgtctaagagctccttcaactcaacaacaatcaacccaattaaaaaaatgggcaaaggtcaaacttgaacaaacacttctccaaagaagatacacaaatggctaataagcacatgaaaaggtgctccacatcactaatcattagggaaatacaaatcaaaaccacaacaagaggctactttatacccatcaggatggctattataaaaaacaaacaacaatagaaaatgaccagtgttggcaagcaagtagagaaaccttgtgcagtgctggtgggaatgtaaaaatggtgcagccactatggaaaacagtatgcagttcctcaaaaaattcactataggattactatatgaaggaattccacttctgcttatataaccccccaaaatgaaagcagggactcaaagagatatttgtacacccataatcataagcagcattattcacaggagccaaaaagtggaagtaacccaagactccattgacagacggaatgaataagcaaaacatagtagagtagaatattacttagccttaaaaaggaaagaaattctgacaattgctgtaacatggatgaaccctgagaacattatcctaagtaaaataagccattcacaaaaggacaaatactgtatgattccatttatatgaggtacttagactagtccaatttacagggacagaaagtagaatggtggttggggagagaagaatggggacttgtataatgggtatggagtttctgtttgggaagatgaaaaaagttctggaaatggttaggggagatggtaacaatcgtactcagtgacaatgaactgtatattttaaaacggttaacatggtaacttttatgtcatttgtatttttccacaataaaaattttttttaatctataaaaaaaaacctttttctttttataaaattactaggtactaggggtgtcagatatatgtggcacatgattcatctgctacactggcacacagttcatgaataaacaaagctattataatgtattttttaaactctaggtttatagaagaaatttacacaaaattgtagcttacaaatttaattcaaaaccaaatgacattctaacagtgaataaaaactcctctcaatttataaattcatcaacgcagcatagcgtcctctgtgctagaattcattaatttttccctctttccctgcttccttttgctttttgaaatgaaagaacaataaccccaaaaaaatgatgcttctttgtggaacaatattatttccatttgccttttctgtgagatgaagtttataacattggtcattacagtgagatatgacactaacatagatgtggcatgacataactgtatttacaaactgtttatgtaacaatattacacttagtacagatcttgacaataaaatactctattttatacactacacaaccaaatactttaatgcaaaacaaaaaagaattaaaattgtccatattaagaaagtccaaagaaataagtaatatttacaaagtacacttagtcacagaagtactaagtgctgatttctccataatcttaaattaatacctgaattagcccatggctcactggtaaatgtgataagaatattttctttaatctgctttcgtgtaactcacacttctgcagctttgtatactctgggctccctctgcccagaatgcctccctagactccatgccacacccacatccaaagccaagctcaagtcttgaagagtcagggcaagtatctctgccttggtgaagctttcctgaccacacctttattcacctgcttgcctcaacccatgaaactgcttacaaaaacaaaacaaaacaaaacacaacacaacaaaaaactgctcacttcctcctttctaaagacctctgaagtattcatcaccccaaacaataccgatttatctttctattgcttttactagtttggtctttcccttggggaaggaacgatgccatactcatctaggtaggccttcaaatgtttgctaagatgtggtttctgtccccctcaaaagatagatgttcagggaaactcaacttaaaaccacaattaaatatcaccttacccagccagactggccattactaaaaagtcaaaaaacaataatgttggcacagatgtggtgaaaacacttacacactgctggtgggaacgtgagatttctcaaagaactaaaagtagatctaccatttgatccagcaatcccactactgggtatctacccaaaggaaaagaagtcactgtatcaaaaagacacctgcatacatatggctatcgcagtacagttcacaattccaaagatatggaatcaacctaagtgcccatcaaccaatgagtggagaaagaaaatgtggtatgtatacaccatggcctactactcagccataaaaaaagaaaaaataatgcattttgcagcaacttggatggagctggaggccattattctaagtgaagtaactcaggaatggaaaaccaaacaccatatattctcacttgtaagtgggagctaagctatgggtacagcaaaggcatacagagtgatataatagactttggaggaggatggtgggggtgagggataaaaaactacatattggatagaatgtgcactactcaggtgatcagtgcactaaaataagttatagatggttgtttttccagagcagtccacaaaaccttcctgtaatatatgcttaagcactcaagcactgaaatgaagacaccaaggtctgtgttcagagttcccttcctcatcaccttaactagctatagatcccttggctaattactgaaaactcacttttttcttatctgggaaataaaaggaggccctcacatacattttcttttaataaatgactatttgagataatatattttgagcatttaacaaacttaaaaaaggtaagctaccctaaccactgttactacatggaaattctctagcatctatattgaaaagacaaaagcttcacagtgacacagagcctgtcataaaccttttctaacagtgtgctgcagaatttgtattctataatattttgtagcatatttttggacaagaaaaaaaatttgttgttaccctttaattatgaagtctttaaacaatgaatacattcagtgtttttatttcaaatttaagaacattggctgcagtgagcatctcattaaaatcacattaaaaaatttgattaagaaatcaaattattgttttctaatcaatcggtttacaattttaaaaataacaaatgaaatatgacaactaccttatctgcctgtcctgagtgaatgtagttactgcagcactctgggtgctgttttgtggcatactagatggaatctggaccatgcttccggctgcaggctgagaaatcaccatagtgttatacagtggggctgtaagagtgctctgtgtctgactgggtagagatgtttgctgactgtgcccactcagtacattttgttgactctgttaaaaataaagagattttatagacagattaactgaaaataattatttgggaagtatgctagaattcatcattctaacaatatgacaatatgacagagaaagaagtggcaggatatattactctgggggaaatataaccacaaaggaatgactcgtggtaactgagaatgaattagtcttgaatatcttgctggaaggcaagctatgactttagaaaggagtgtgattgtaatagagatgatataaaatatactcaaagaatttctgttaaatgcccaaagtgaatgactaattagtgggcatttttctatttttcatttaaatccttgggatttacagtcacagatctacagtaattaccaacattttctggaatattcaataaaccattatgccccctcccccaacagtctattctgcacatatgggaacaggcttcctggtcagcctcttgagcaagtcataccttttaaacacagaaatagtctaagttacaagaacttggtataactactagactacatctttaaacagattgtgacatattttaaagctcagccaggcgcagtggctcacacctgtaatcccagcactttgggaggctgaggtgggcgatcacctgaggtcaggagtttgagatcagccaggccaacatggtgaaaccccatctctactaaaaatatgaaaatcagcctggcatggtggtgggtgcctataatcccagctactcgggaggttggggcaggagaatcgcttcaacccaggaggcggaggttgcagtaatctaaggtcacgccattgcactccagcctgggcaacaggagcaaaactccgtctcaaaaaaaaaaaaagaaaaaaaaaagctgaaaatatttgatactaacatgatttgcacaaaatattttaataatcactctcaatactatactttctaaatactattaaattttgaaatgatattttatcattagagctttatttctgcttcagcaatagtgtgccttccaaccactgatcactccatagcccgctgtgctcagtaacattacctgagttgatgtactctgtaaagtctgttgttgtatcatgtgctgagttgtgccaatgtgtccagtattcattccactttgaatctggttagtaggaacaacttggccttgcatatttataggtgcaagttgctggatattagatgaatttccagaagaaagttgaacggaaccaaaattcaacccaggatttgattgttgcaaaaacatctttaaaaataaagattatgttaaaatgagctttgtagattgaaaagaagaatgagcattaaaaagaaggcaaaatcaagctacaaagtatgtttaaaaagcaagtaacaaggctaagtcactttgaagaattagcaataaataagtagtgaataaaatatgaaactttatattcaatctttcagttatcttgtttccaattgttagaaaaagtgtaactagtgttagtctgtggattgacagctctgtatcacttatcatttataatttataacatcacacagaagtagttttcactccaagtttccctttaccaaagtcatagtctcctagagtggtcctgctggttggtcatataagactaatttgaatcatacatactggtatcttaataaaaatattactgatgattgatttataaattctgtacccaagatgtacctaaaactttatgtaaaatataatttttatattatggattcaaacttactaaaatttggactggtaaaaaaagatgactggagaaacaaggatgttgacagaaataccctcagaaacaaattatctttagagactgtaagtataatcatactgagtaggtaaccagtgaatatttattgaactgaattgataaaacgtatctcttgcatctcacttttaattaagaaaagttaattttcctagaaatccaaaatgtgaatgggatgctttgtttgtattcaaatataacaattacctgcagcccctgaccatggaccatctgaagttgttcttgaatttttcttagttcttcttgttgccgatgaatatttgcttctatcatgcgtgtccgttgttccaattggtctttcagatgttgcatggctcctaattgagctgaaaactgaaactgaagtaccatgtacggaaaaagtgtaatatattttagaattacttactccttataattgcacaacatgaaaagtaagcagtataacatgagtgaaggatgataacatccttcactagttatgtcccttagtttctaatccacccatctttgctctgctttgtaatattggacctggaccttcaaaatatttctcctttgccagcaggcacaaagttatccacatcagtaggtggtgctggagggacactgccaagaaagtgctcaactcctggttctggtgcttcttgctcttatgtcagggtgccaacgggaagcttttaatattttctcaaccacgtttaacatatgatatggtctggttattgttaatttctgaaatcaaagttgtgtgccctgaaatgtaatttagtatcccaaatacaaactattgaagatagagttaaaaagctttggatgggaaggacatttctcacttttacatacacctgccccggcaggtggctttccagcaagtctcaatgacatcctagtgggcagcttccctgcaagctttaccagtaccccagctgatggcttccagctctctacctctaatctgtggcatgtcagtgaacttctctattatccagttgctatagccacatttgccccaagaagatctgcatcttagcctggcatgggggaagaggaggttaggagcttgtggggagtcttctaagtatgttccttccttgggtactctccatctaccttacagctagtggttgctctctgcatctgctatttctatattcttttttttttttttttttttttttttgagacaggatctcactctgtcacccaggctggaaagcagtggtgcgatcatggctctctacagccttaactttctgggttcaagagctcctcccatctcagcctccccagtggctgggactacaggcatgcaccaccacacctggctaacataaaaatgtattttcttgtaaaaatagggtcttgctatgttgcccatgctggtcttgaactcattggctcaagaagtcctcctacttcggccttccaaagtgctaagaatacaggcatgagccaccacacccagctttattcctatattctttaggttctctttacttcttttaggagttaatccgtgttaccagttaataattttttatattattcctgttcaaatttctggtatgcttctggcttctgactggatacttgactgattacacatacaccctggatttacaagacctgagctcatattgtggctaccacttactggaaaaaaatttaacttcttttttttttttttttttttgagacagagtcacccaagctggaatgcagtggtgtgatcacagcttattgcagcctcaaccacccaggctcaagcaatcctcccacttcagcctctcaagtggctgggactacaggcatatgccaccatgcccggctaatgttttttttaagagatggggtctcactatgttgcctagtctgttgtagaactcctgagctcaggcaatcctcccacaagccaccatgcccagccttatttaacttcttagcttcatttttaccccttaacaaaggaaaaagtagtctgcacctggagttaatttgtatcaatttctgtcatccctagaatgccctctatgtgtacatgagtagaattacccaaagttgcaaaaatctgacagataaccaataatattttcacttttatcttcaatggaaactatcctcagataagtatagaacatgggcttttaaagactaggcaagtatgaatgaataaacgcatacatgaatgaaaataaaattatattttcaatcttatttctctgttttacttgagtcatgagcagctcctattttcttctgcttataatttacccacatttggtgattcatctcttaagtctatacaggctctttaattattcccatgaattttcagtatatgatacagtataagagcagaaagagtttcactttattggaaggaaatctgtcttaaagtagcctcttacagtgaactgtatgtaaaagtgagaaatgtcctccccatccaaagctttttaactctatcttcaatagtttgtatttgggatactaaattacatttcagggcacacaactttgatttcagaaattaacaataaccagaccatatcatatgttaaacgtggttgagaaaatattaaaaatttagtacctcaactccctcaagtttttttttttgtttttttttaaatattagtcaaaatgttataattatggccgggcatggtggctcacagctgtaatcccaggactttgggaggccgaggtgggcagaatgcttgagtccaggagtttgagaccagcctgggcaacatggcaaaaccctgtctctactaaaaatataaaaactagccgggtgtggtggcatgtgcctgtagtcccagctactcgggagactgaggcgggatcgcctgagctcaggaagcagaggttgcagtaagccgagattgcgccactgcactccagcctgggtgacagggtgaggcgtcgtctcaaaaaaaaattaaaaagttacatttatgtcatacaaatgttattttattataactaaagttatttgtacctttggacaagcattatattgatagcaatatagcacttaaaggatttctatcaagtacaaaagaaaatagtaacaaacacagaaggtaggataacaggaagtaaaaccacagacctaagaggcaaagcatttggctttattggtgaacaaaatgtgagacatgaatgcttactaacatttttgacatagtaggtatcctttatttcatgaaaatatccccataacatgttaagaaatgctttagaatcctgagattaaaaaactaataatatagaaagtatgtatctcctatcatatatgtatgacttaaattaaataaccatataagatggagctatttttaaaaatattgttttcacctattattaatgatcattccttgaaatcaagacctgctaagttaaggtatatttaatgccaaacaaaacagaaaagttgaagaaaaatactacttctccatagtatttttaatgtgtttgaggcactgaatgagtacagagtcataaattacaagttgggaagttaggctctaaagtaacagcatcactcttggaattactcccccttttttttggctactttccacattcaggcctccttctggacttaggccaagaaacaattctcctagaaagttttccttcacttcctcaggttgcattaaggattcacacaatctgcttacatatcaacttacatactttcagcacaggcaatatagcatggtattgtaggcatctgtcattccctctagatgtaatggttttttagttcatatatttgtactgtcggcatctgcaatgcctgttacacacaaagaactcaataaatatcaaaagaatgagtatacaaataaagttactcaattcttccaatattcataggaggaacaaaatgaacagctacatttcatccttaatatctttatgtctacagtgttcctcaatgagggagtgttatggcatattaggcaggacaattctttgttgtgcaagactcttatgcatcctgaaagatatttagtattcctggaccatgctcactaagggccagtgataccccacaatcattacaacaatcaaaaatgtccccagatatcctaaatgaccccagttaagattcactgcatctgtaactataattatatatgtgcgcgcgcgcacgcgcgcgtgtgtgtgtgtgtgtgtgtgtgtgtgtgtgtgtgtgtgtgtgctcctacctcagcctcccaagtagctgtggctacaggtgcttgccagcaagcctggatttttaaaaaaattacattagcttaaaagcaatttatcatattcaaatacgcaactgaaacaaaaaccaaaaagtacctgggacatgccttgtggaattggtaaatttgtagcttgagacatcactggctgtgttaatgatgaaccaacagactgggaatttatggactagagcaaaataaaaaataacactgaagtgattctcattcccatacatgagtacttccagcagaaatatcaatatgatattcgtattaataaacttaccatttgcctcatacttttgttagctgaatacagctatgtcttctcatctatattggaaaggcctgttccctatttatcttttattttccaaggaacttcctacagtaccttgaacaagctctcaataaaagttggccagacttaagacaattggtatttgaacttagacataaaacagctatcaattttgagctttccacaattaaaaaaaaaaaaactaacattttacttgaaaaataattagaaggaccaatacatatgacaaccacttcatacaagaaaaggaagtcttaagtaagtgtcacatatcagtaactattttgatctttacaaagaggggtgacaaatagatgaatttctgaagatttagatcatttttcccctcttaataaatctttattcagaagaatatccactaaagagcttacctgactactaaatgatgaccttctttgcaccatcttctcatgagctggtaaatgctgcctgggtggagtgctcgtatccgtcgggatcttggttggtgttgctgaagtcaacaaaatcagaagagcattagtactttataaaatatagtttttaaagattaatctcaaaatgtatttcagttaataaaaatggcttttgaattatttttccaaaccattcaatgaaagtgaagtccatgacagatgattcaatgtagttacttctatctttttatgagcacaaagaaaatagttgaaataggaaaattttaaatacaaaaagtcactaatttaatgacaattatacaagtcttcaaaaagagaagacaataaaaaactttcaaaaagcaaacctaagaacacttactggccctacagtaaaaaaacacaataaatagttgcctttctttttgagggatgattaaaaacatcaccatcaccattaccacctacacattttaataggctacttgaagaacttaattctttgctgaaagtgggcaatgtccctttaactcactggaaaggttactacatttcagaaatgtaaaaacttataattttaaagaagcgtttgatgagaaatgctgatataagtaactaaaagtttagttagttactttaaaggaagtctgctttgaagcaagggtactcacaggaagggtctgagacggccgtgtgagatgattttcttgaactccgagaagaggcagaaggggttgggctgtgatcaaacctttccaatgcttccttgagactgactgtgtttatacgattatctgacccagaatcttggctctatggagacagagtaaaataaatgttttcttgtggttcagttcagagatctcaaattcacaatactgttaacaacaacaaaaaaatcagtttttgtctataacaaggcaaaagtacctgtatgtacatacacatgtaaagaaatgaaaatttatgtgttatagccagaaagttttggcttcattttctatttaaagaaagagaagaagaatgaagttggaatctcttacaccatatacaaaaattaactcaagaccaggtgtggtggcttacacctgtaatcccagcactttgggaagctgaagcaggcagatcacctgaggtcaggagtttgagaccagcctggccaacagggtgaaaccccgtctctaccaaaaatacaaaatttagccaggcatgatggcagatgccttgtgatcccagctactccggcggctgaggcaggagaattccctgaactgaggaggcggaggatgtagtgagccgagatcctgccactgcattccagcctgggcaaaagagcgagactccatctcaaaaaaaaaaaaacattaactcaaaatgaatcacagacctaaattttaacagctaaaactacataactcttacaagaaaacataggggagaaagccaggtgaatgcctgcggtgccaactacccaggaagctgagaagagaattgcttaagcccaggagctagagtttcatagtttcatacagcgacactaatctttcccttcaccaatgtttctttctccatcagctcattctcatcagtatacaaacatgctgttatttctctcaacttaaaaaaaaaaaaggcaaaaaattcctttaagcccactttcccttcctaccactgccccatttctcttctctttgtagcaaaacccctccctattcactgtccctaattcccccatcctggaaaactgtcttttaaaccaactctaatcatgctttcacccacactgctactccacaaaatctgttcttattgatcaccaatgaattaaatgttaaagttaatgctcagttctcaacactcatctaaaatttaacttatttcagctgaatctgatacagctgatcattcactcctcactgatactcttgtcttctaagtaacttcctggttttattcctaacttactagctattacccccctgttgttgattcttccttgtctccatcacctcttaatattggagtgctccaagacacacccatccctttggtgatcccatcaaaattcatgattttgaaaccatccacacattgaagtttctcaaaaatatctcagaaggacctcgtccctaaaccccagggggatcatgatgctggcagtaaatatggtgggaaagtagacatagctggtgtgtattttggaaacagggctaatttaggatttactaggattgaatctttgcataagggaaaaagaaggataattaatctctgtattacttcagttttcataatggtcccctaatcaaggaaccctagattttaagaacttttctcagaaaataatgtcttctaccaaaacatactatgtcctcttcttctaaacatacaaaacctctttggaaaagttctttcacgtgggatccatgaaagcagggaagttgtttgcattattcagtgctgtattcttagcatctagatccatgccgggtagaaggtactttataacatttgttgaatgactgaatgacatctaccatattgtcccctggaatgctgcctatttaactcaagttttatatagatttttgactcttttcattctacttattttctgcaggtccaaaaatactgtggtaggcaatttctgacatggctcacaattcctgcctcctgatattcatgcccttgcataatcctcccatcttgagtgtgggctggatctactgatttccttatataatgcatagaatagacaaaagtggtgaggtatcaatcctgtgattaggttacaaaagactgtgacttccatcttgcaggtagtttctctccctggctcatcttgcatgcttgctctgatggaaaaggtcacctggaaaggaactgaggatagccttcagccagcaagaaaccaaggccctcagtccaactgcccatgaggaactgaagtgtgccagcaaccactaagtgaggtggaaacagatgccacctcagttgaactttgagatgactgtggctcccaccaacaccttgattacagcctcatgaaagaatctgaagtagagggtccagctaaactgtgcctggactcttgactcaccaaactaggagataacaagtgtgttgttttatatcactaaattttggagtaagttgttacacagctatagataactaatatactatacttctgacctgatataacaaaaaagaaaccagagttccaattctgactataatttcccagccagtgtctttagggaagatttttttttcccctcttgaaaccccaatttcagtattttcaaagtggggatattacctacccgataaaaatatctgatgtgtaaattatatttcataattcatataaataacctagccagagactagtacatcactgggaataaatggtagttttgagatcagacacatctctcatccaattttctttttagaggcaggtgagactctaaaatattaaattaaaaataagtagtaaagtataatcacatccccgttataagtgaggaaataaagtatttttgaaaaatagttttcctattaattattgagtttcatcttttattggggagaaattaaaaataattttttttaattataagaaacatactttgtcagcagctgtctcaggaagagactcttcaatgccaagttctcgtcgtctttcagccctaacttctgcataactacaaatggaaaaaataatcaaattttagtgtctggtcattcgtttaaaatactgcacagctgtaactattcagtgttgttacgtgtctcatctgttcatctagactatttgctatgtgctacacaaacctaaaatatacctataatgtcttaatttaacttgcatttttctaggtatcttaaagtttcatacactgctgtaaacgatccataaccacacaatacttaaattaagaaaaataaataaaggaagtgtatgcttatctacctacagttttccttttacatgactgacattactacataaatgacagtaacaacttctgctgtaaagcacaaaatttatatcaagacttatatatctatatcattcctatatttatatataatgcctataagtaaatttaataatatattgaaaggatctatcagcaattgagaaaagagcactttgtagctctttaacaacttacgcataaaagttacaatgccaaaatcatcataggatgttacagtaattcagaaattctctaaaagaattattaccttactacagtgtgagtacaaacaataaactctggccttgaattccactgatggtaagtgatataataatgagtctgaagccaaatccactgttgccccttagtcaggaacctataataacatgatttgcctttcccatattgcattactaaaaggaaaatagagaaatattttttctttaattcatattatataaagattgttttttaaccaaaagctatcatttacatttaagtttacacatactattatttttctggccttttgataacatatatgtcaatatgaaaatgttattctttagagctagtttaaggtcccaagcaattatcagatctacagtgcccaattcacagctagtcactgctgatcttacaatctttccatacacaattaatacttaagaattcacactgctgacttcctcctgcctagatatacagagggtaataacaataaataatcacccctgagttttttctcctaactactctggcaggcacagaatctttgaagcatttaattttaaaccttaactaaccaaaatcaaagtaactgagtctgaagtaactgagtgcagtaactgccaaaacatgtgctgtggattttaagttctgaagcgttttaacagatattaaacaaaaaaatgggttttgggccaggtgtggtggctcacgcctgtaatctcagtactttaggaagcagaggtgggaggatcacttgaggtcaggagtttgagaccaccctggctcacatagtgaaaccccatctctactgaaaatacaaaaattagccaggcatggtggtacgtgcctgtaatcccagctactcacgaggctgaggcaagagaatcacttgaacccgggaggtggaggctgcagtgagctgagacacgccactgcactccagcctgggtgacaaagcaggactccatcccaaaaaaaaaaaaaaaaaaaaaaaaagggtttgtagttaaattaatttgggaaactttttgttaaataggtgtcttcagttttctcaaaacctagagtatgctaatgcatgtgcagattctctgagggattatgaagtgtttccccatcttccttgactataaagtctttttttatggaccaacattcggtggaacaaaccttagaaaatgctagtcaagaatctctcaatctgtccccccaccccccaaccccgccgccaccgcctctcactctctaaggaggaaatcaaggtctacaaacaaacttgctgtccaaagttacccagctagttaatagaggtatcagctctttagacaacatcatggtgcttaatgcccacatcttttgtgctgaaatgactttactctgaaaattttccatagagttaatgctattatacaacctgcttcattttcatacagtgaggtttataacagcagcataaaacgtcatgaaaaggtctaaaatatctagttaagctttagtgaacactcaagatggtaagcatctgggaggaggatcagagaagcaaataaaacatatcattaaggcaaacctcatcattaaaacaaacttctaaaataaatacatgtgataaaaagagtaggcctaggctccaatcctgtctctgccaccaatgagctatgaaattatgggtgaattacttagccttactgtgttctcagcttactcatgaagataataatagcatctaccttttagaactgtgatggagaataatgaagataatagatgtaaagtgtttagaacagtgcctggcacaaaggatgataatgctcctgctctaacaacaataataagcagataacaccaagcacttactatgagctttctaagacagattttccagacatgtacctagctcctgaaaagattcacatgcctcaaaatcaaaatttaggaaacaatactccaaaagtttgaagtattacaattttcaaaggaatctacttctcttactccagatatagagctcacgtgcttcagaacaaggtgtattagatgcaatattataaaattctacttattataaaaataggaacaagtttaaacttgatctatgattcctactacattggttatatacataaagcaaaatcttttagcatatttcaaaaatatgaaaatgattataaatctgtgtcttactacctatcatttcaggacaggacttctgcttataaaacagttattatcaccagaaatgttaaaatctacttacagtgctcatgacattttgccaaattttctaggtcatccacatgatagtaatcatagcctgatgttcccagaacttcaaatggcaaataccctattatgggtggtgccctaaattacacagaaaacaatcattattataagtttttccataataagaaatatttcaactagaaataaactttggggggggggctttatttttcaaaaaatgggaacaggtttcaaagtcctaatttaaaaaaaagtttgcccttgatccattaatttcaagaattatataacatgactattaccttttcatggaatttaaaaatggaattacctgtgatctagaaacagaaacttccattctaaactatgtctagatgtaaactcttcattgggttcttcaacagtgcacatttcctacaaataaataattaaaatttataaatactttgtgtccttaagaatattaaatattgctacatataaaaataagtcatggccaggtgcagtggctcacacctgtaatcccagcactttgggaggctgaggtgggcaaatcacttaggtcaggagtttgagaccagcctggccaacatggtgaaacccgatttctactaaaaatacaaaaaatagcagggcacggtggcgggcacctgtaatcccagctattcggcaggctgaggcagcaggatcacttgaacccaggaggtggaggttaaataaatacataaataaatagtcattactagataaacttttcctaaacaagttagttgtttctatgtatgtatatatttacctatttctttgtttgacacagggtctcactctgtcactcagcctgaagtacagtggtgtgatctcagttcactgcagcctcaacatcctaggctcaagcgatcctcctgcctcagcttcccaagtagctgggactatagggatgcaccaccacgcccggctaatttttgtatttttatttgtagaggtggggggtctatgttgtctaggctggtcttcaactcctgggctcaagcaacctgcccaccacagcctcccaaagtgctgggattctaggcataagccaaaatgcaggcccttctaaacaagttaatatattttaattttccagtactaaagaatgtggtaataaataacctttagatgcaagcttttgggtgggtacttctcactctacacattttccattcacacatgcctataaacgcttattcaaaattcagacctctctcctgaattacagttccatatttccaaatatctgaatgtcctcatacatctcaaattcaatatgtcctaaaataaactaactgctttactcctcacacccaatcacacaattttccgtattattctatacatgtgtagtggccagtgtctagaaatctgatagttaaaaaaacatactctttcatttttacctttcatcatctaagtggccattactaaatcttttccatttcatctaagtattttaaaaatcaattctatctcatccatcttgagtgcattggtttagacccctgccatcactgatttgctacagtgttcaccagtctccctgtccttcaactcatcttctcttctagggccacaattaccttaccaatactcaaatattatatgacttccctgctaaaaaaccttcagtggttccttgtgctaaactctcttcagcatggagaaataaacaagaaagaaacaaattttatttctggtttctgattacttttctagccttacctcccactatctcttccccctccacacactaaccctagactctagtcatactaaacaatgtattccatcctgcctctgtgtccctgaatgacctgcagcactctgtaatagttgagagcttgggctttgagaaaaaaacaattattaattaatagaatcaagtcccagtttcatcactaatagctgagactttgggcaagtcacttaacttccctaagcctgtttccttataatgtaaaatgagggatcgtaatggcatctaacttatagggttgtcataagaattaatgagataatgcatataaaatacacagcatgtagtaagcactcaaatgttaacaactattatttcataagatcaaaacaaaccaagcaagactggcttaagatcttctattaattcagtactttgtcctatactatgatgtccccccaaatttatttgagacagagtcagactctgtctcaaaataaaatgcaaacacagttcactgcagcctcgacctcctgggctcaaatgatcctcctgcctcagcctcctgagtaactgagaccacaggtgtgtaacaccatgcctggctaattttttgtattttttgtagagatggggtcttgtcacgttgcccaggctggtctcaaactactgggctcaggcaatcctctcgccttgctctcccaaagtgctgggattacaggcatgagtcacctcgcctggccccgccgaaattttaaatcttagcctggctgcctctttccagtcagtttctagtggttaactctttcactttcccacttccctacttgtcatctgtttgttgggtccaggaaataaaaataaaatacctaattttacatttgaaaaggtaagttatatgtggcaaagagccacttgtacatttcaaataaaaatttaaaagttaccttctaaaaataaagattccaaaaacctagatttttggactttcccttttaatagagataatgaacaacacacaaaaggatcctaaaatcttccacaaaagtagggcaatattgatatataataatcactggttaactgcaaaggatatatactaaaaaattagttatacaatttaatgagtgtcttgataactcatcgtttcaaaaatattatcatgcatatttaatgactcatagccattccacctcaatgtctgcaggaagtttcaggcagctctcagcatatgaactgaaatcccctttgggaaataaaattaaaaacataccttgatgaactgaggtgtagctaacctgacagtagctacaaaacaaactctatcttcataagatggcctatgtgtgcgttgtatagttccttcaaaaccattgtgtgctgaagaggatactaaaacaatagggaaatatgtatcatcagttatgccagcaaaacctaattgtcactgatattcaaacatctatgtctttaagagcacagaaaaataacaagttaaaacacattgtgagagaagcattttaactcaccactgtttaaagatttgaaatttcctataaattttacatattcataggtagatggctcctttgggtctattgttcctcgcagcatgtgacaacagaattctaactgattttttgctgaaataaaagagattttaaaaatcacatatttctgatataaaacaatgattgatataccacataaagtaagatcataaaagttgtgtaagtttacaaccattattttccccaacagaagtcgtcaatgacatttagttcataaaagtagagcaccttcaggagaggatctcactttgtctttaatagaaaaaatagattttctggtgcaaacaacttaatgtttccctatttttagctactcatccttttcattctttactcactttcaaaggaaagttttgcttcacattctaaagctaatccttccatctctaccatttatagtctttcctattttctctaggacccgggccacatcactgttccttattcctttagcatctacacctttgggtccttactttcttcttttttttgagacagggtcttgatttgtcacccaggctggagtgcagtggcatgatcactgctcactgtggcattgaactcctgggctcaagtgagccccctgcctcagcctcccaagtacgcaagactacaggtgtgagccaccatgcctggctaatttttaattttttatagaaatggggtctcactatgttgcccaggctggttgcaagcttctaggctcaagcaatcctcctgcctcaaagtggagggattataggcgagagccactgcacctggccaagggtccttactatctacttttaaatttgctcacgtcttccatctgaaataaaggagtttcactaattatttggtattatagatctccttccttttcattatgggctccatcttccatatattcatttcccttaacttcacacactgtgacttacacctctacagcaattattcttctcaagattactaacatttgtatcgttaacttcaatgatttttcatttccacttcttaaaagtcatcctttgtcattcccacagcataaacttaccttcccaccttactgactattcctatctcttctgctaatccattttcatactaggggttttcacaaaggttcttctgatcctaaatctctctctccaactctagcattttacgtgagacaaagttacctatcatttgctttcaggacattcgaacttgattgtcccattagtaacttaaattcaaaatacttgaaagtgaatttatctttctttcaagctcccttcgtctatgtatgcttatttcccaagttagaaaccgttaacaatttggtctcttctcttcccatcacaagtcccaaacctaatctgtcatgaagacctgctacttatttcaccaaggaagcctgccaatttagtgcagttgcaaattaccttgcatctaggtaaccgaaatatgtattcattatgcctccacattctgccactctgattcagtcttgtctattactcttagacttgtaattactttcatggtattatttccgcactcaaggactagtaacacctttctttgctcactacttcaagcttatattcttcggttattatcatcatagatggctttatcatctaacctaatcagtaaaaatctatctatcttcaaccttccccactgatgattcttagtcacttggtcacctgagcctaccacatcaagtcctattgagtttacacacttaacagtcatatactttcctctcctttttttttttttgagacaaagtctcattctgtcacccagcctggactacagtgacatgatctcagctcactgcaacctctgcctcctgggctcaagtgatcctccagctcagcctcgagtagcaggaactacagacatgtgccaccacaccccagccaacttttctatttctctttattgtatagacggtgtttcaccatgttgcccatgctggtcttgaactcctgggctcaagcgatctgcctgccttggcctcccaaagtgctgagattataggcgtgaacaactgtgctcagcccatccttacttttattgctaggattatatggttttcctttttgtctcccagtctggtccttttcaaaattttctacctgagtgattttttttaatctcccaaaccagatgacgaaagtggcagcaacttttataagcaaggtactgctgctctttctaggccagagatgctggtgaaagatgctttcattgcaatgaagacctggacctccatgaggcaaaacagctgttacaggaaaagtagtcatagctactgtaccaggcaggatggccagcttgatcatcagaatggtctgatccataagatctctggttgtgtttaactgaaccctaggaatgaaactgaggagtaactccataaagctatcacttgatttgtatagtaggaaatctgcaggtcaggtgagcacagcctgagttgagccactatgatgagaaatccagggctcttattcagctctcagactcagggtctctttatgaagcagaagccaggtaagcctggggtaggcaacccactgctgcaagtcttcttcctagccttctccaaatgaactttccactatttacctgattttgtttttcctttttttgcagataacaaaactacccaaatctccttcactggctctctactctgtaaaaaataaaactcaaattccttagcccctttataattctgtccttattctttctctagacacaaattttaccacctgtacaacctcaacttcattatggccaaaatgacctaccaaattttctaagcaattttctctgtgttttaacttgtgtttattcttttggcatgaaactttcttttttctggggcaagaactcttttgtatatcacttgtttaactaggagatcagcaagccatttaattaagacttttcttaagtattcttgccattttcatttctgttcttggaagcagaagcctaagctctttctgccaaaggcttttatttagttctccagtcgattttattcttagtagggtcttcaaagcaaacgccttctcctttgtcttcctattgctatctccaaagggttccacctttctttcttttttttgagacagagtctcgctctatcgcccaggctggaatgcagtggtgtgatcttgactcattgcaaactcagcctccggggttcaagcaattatcctaccttagtctcccaagtagctgggactacaggcatgcaccaccatgctcagctaatttttggtagagatggggtttcgccatgttggccaggctggtctcaaactcgtagcctcaagtggtctgcccacctcagcctcccaaagtgctgggattacaggcatgagctaccgggcctggctggcttccacctttctaatttttctctccttgttctacgtatttacctcaagcaatccattccatccatggcttcaaatactaattgtaggtatctattatatacagcctaaatctttctaagtaccagactagagtggcctaatggtcaatgtcatatgaacttggttttaaaacaaggcttgaaatgaattctccaactctagtttttctcaactctcgctgaaaggccatccactcttaccaaagttatagatacacacagatttgtgtgagtgtgtgtgtgtgtgtatctcaatttttagacagtatgctatagaatttgaggattcaaatacaaagaatctttaagataatgtcagtattagcagatgagacacatttaaaaataatgaaaaaggtgattaaacaaggtatctaatagctaatggtgaaatgtactgctgtaacaattctggattttatacagggtaatatatgaagaaaatgaggtactccggtcaaataaatttgtcaatggacctagtagaaatgtctgattctaccataatatgttgtgtatcttgatggtgataactattttcactattgttgatatttttatgatacagcacaagtacctagcaaattagatacatctaacaaatgactgtttaattgtttaataaagtagataatttatctttatatttaataattttaaaagaaacatagaaattttttccagtttgagtgtccaattggttaacaatggtgaaaattagaatgtttaattttcccttattaaatacagtaaagttttatttataaattaataactatatattgccaggtctcacttttgcataaaatacagctttatggcataatgggagtccaggatttattataacaaataagatgggatttcaatatacactgaaatagattacagatttttaatatggtcacaatttcattttatatatattttaatattgaaaaaggacctaatagggcatatggagtaatgctgtatttaaagaagtctgtatttttcataaacttgcaaaaggatagtgctactgaatacaacatttgacttttttgcttaacagctactacttacattttaaatattctggggttaatgaatcactttccagcagatgagtagagagtattttataaacctctgaatgttccccttctgggataaaattaaatatactttgatccacaagatcagactgaaaagaaaattgttaaaagtaaaataacttcaatgattcaagagacaattgctttaaaagtacataatcgctattaaacacagcagttaactttcaattatctgtgaaaaccaacaaatgtcaagttatagaccaaatctcaaaaaataagattgagatcatactaacgtcatccaatccatgaccaatatgaccttgaaagcctgataaattatttgcaaagctgtgtttcaccaaaatgttctgaacatttcaaaatacaacgggaccaagagagttaataagaaaaatctctggcgacaagtcatagccttaccatatactcaaacctatggtaaacaatggtggtatatcctactataaaggactatgcacaagctaaataaagaggagattttgttttggtgtgatttcaattgtccaatgtgtcctttatttcatcttttcctggcatttatcctgcatcccattgtacaaaagccttgtgtttagttatcccccctcaaaaggacaactaatatgttaagcattagaattcttgttaatacacagctttaatcgtgattaatcaatagcaatttgacaaacatcaggttggctacaatgtgccacggctgtggaatcaaagatgaataagatagtttctatacttaagtaccactgataacaaaacttccatgactttacatttgccactacgcattctacctggtttcctgcgtttcaaactgctctgtggaatcctagggatgctgagacagtatctcaaggcctgtaaaggtaggactagagggtggggaagtaaaaaggagctgagaagcagggcccagggtcctgcccctgcattaaactaaagcagttatactttttgtttttattttatgcatctgtgaagattttgtttgaagagctccactgcttaaaaacaaaaaacatacaacaacaaacagaggcagtaagaatggtgagaggggagaaaggggtgttgtattaggttggtgccatacttttaataacaaaaaccgcaatcacttttgcaccaacctaatactattcttcatataggccacacattcccatcatttcttctgtcttttctccagccctccaagcccactccatgaagtgagatgaccttcccccctctctacatatctgtatctttcccctttcaaagaccagttcaaattacttctttcaagaaagcattcccttaacaccataatccacattaaaaataaaattcttttattatttattacttgtattattcatttcccatttagcagaattcagccaaccatggatcaaaactattcaggaaaaacaaaaaacagatggttgtgtctgtactgaatacgtgcatttttctaatcgttccctaaacactatagtataacacatatttacattgtattagttattataaataatctagaaatgatttaatgtatgtaaatgggaagatgtgtgtaagttacatgtaaatacaacaccattttatctatgcggcttgatgatccatggattttggtatctgcagcgggtcctggaaccaaccaattcccccatggataccaaaggatgactatattttaatgtctatgtcctgttgccctatagctgaataaaaggggcctatctcttacacctttatctttctcacttccaatcagggcacattaacaccgtgccttgtgtttaacagttattagtaaaataaatgattttagactaaggaggtatttgataatggcttaagggataaccacaccaaaaatatatctgtatttcagtaaaggatttttctggaagtctgaaaagcctctacaactaaaggagtgaactaaaaattcagggatggctgggtgcagtggtcatgcctgtaatcccagcactttgggaggctgaggcaggtggactgtctgaggtcatcagttcaagaccagcctggctaacatggagaaaccttgtctctacgaaaaacacaaaaattagctgggcatggtggtgtgcacctataatcacagctactcaggaggctgaggcaggagaatcgcttgaatccaggaggcagaggctgcagtgagctgatatcctaccactacactcaagcctgggtgacagaataagactctgtctcaaaaaataataacaataaataggcctgaataacacaaatgctagaaagttgccttctactgacaaaataaagaatcaaaatatagtatatgatattgatgcaaaaaataatctgatatggtttggctgtgtccccacccaaatctcatcttgttgttcccataatccccatgtgtcatgggaggggctgagtgggaggtgattgaatcatgggggaagttacctccatgctgatgttctcgtgatagtgagtgagttttcccaagttctgatggttttgtaaggggcttttccccttttggctcagcacttctgcttcctgctgccatgtgaagagggacgtgtttgcttccccttccgccatgactgtaagtttcctgaggcctccccagccatgccaaactgtgagtcaattaaacctctttcctttataaactacccagtcttggggagtcctttatagcagtgtgacaacagactaatacatcatcttaatagaaaaacatgccaccaacttgaaatattaataggaactaaaattttcatttttgagaatgattatagttttctactattatttgttactaacaatttcttctactactatttggtaaattatgatgtgacctatcttatccttgttttttcatctataacttcataggatgtttcatattcatagagaaaagaaaatgaatgcctgtatcaagagtagtatgatcacaagcaatgcctgccccaacaattctgcctctcctgccactttaataggtgtcaaactttccattaaccactacacttaaaatctctaaatgaggctgaccatactttatgtgaccatacatacactcagttctcaaacacaatcaaacgtaagaaaagaaaatggtaactacttggatctttttatctcccttactcgtttcatgaaaaggaaatataagttctgctgatttacttatatgacataaatcagtagcctttgttttttctacattaggtcaacgttaccatttagtgattggatgacacaaacaattttttaaaatctagaagatgttaataacagaggaaactgggtatagtgcacatgggaattctctgtactaccttgtccatttttctgtacatctaaaaatggttctaaaattaaaaatattttttaaaatgtccagaagaaaatgggaaggtgacagggtttttattgagggaagtgttaatcaaacacttcaattccaatgagatctatcacatgttgtctatttcaaagggcaattaaactcactaaagattagaaagggatttttttaaaacagtcaaatcaagtagcacactcattttcatacattcaacaaataatcactgagtgacgctccaaggaactagctagctcctctggatgcagagataaagttcctgcctttaagaagctacaactaccataactatccaaataaacagaaaattataattctctgtatcatgacagtagtacatacaaggtaacagtagaacagagatgaagggcatcgaattttgaatggaattcaagcaagtgccaagaagcaggctttgagaaagtgtgaacacattgcaaatgatgctctatgactagattatatagtttctgtaaacatgacaaaacctaatacagttatatatggtttaaaagcatacaattatacttattttaaattacttagacattatcttaatcctataatgggattctttccctgggttttcttgctatgaaaacaaatttttttaagttgtccagaaaactcagttaatcagtctgtccttttttctgcctatgctagtttacttatgcattgctaatatctcatgttttactctcaaacatgtttttaaatgttgggcttatcctactatttgagcttactagaaaataaagccccagaagagcagtaaagtcaaagttattttctgtatgaaccaaagaaattagcaaattatgtactgcatggctttcaactttaaaaaatgcccccttgagagcctggacttttaagtgctaaaatccattgattctctttataaggtatgaagtatcagagtaatcagagggagagaaataccacttttcagtatctcttgaaagagacacttacaagcagaattactttaccctgttatagagataagctatttttttaatttttttgtagagacaggatgcttcactgtgctgcccaggctggtcttgaattcctggcctcaagcaatcctcccaccacagcctctgaaagcattagcattaaaggtgtgagccactgcacccagagagaggcattataagagtagtttataagtaactttagaatatttataccatgagctccatcttcaataacatcattacatattaaaaactgaaaactccccccaaaagcctatcagctgtggcacagcacctagcatggtgtctggcacagagcagatattaataaatacacattagaaaaaaagtaagcacataaaccaggtattcaccatcctaatgaaacaaaatatacttttctaattctctatccttctggtcatatagataatgaattaaaatatggccaatatgacattatcagttcaaagtcacatagcataaaaagttctgtatctactatttttagagtgttttttataagtaattctattgagaaaaatatttacaagttgccctaattgcaacaagtatctcagcagaaatttagttattctcaagacattctcagtgatttaacattttcaacaggctgattaaaatggaaacgctaaaaagttagcattagaataaagaagacaggaagaagaggggtcagataaagtggtaagaccttgcactgcataacaatgttttggtcaacattggactgcatatatgaccaccggtggccctaagattacagtggagctgaaacattcctactgtctagtgatgtcatatctgttgtaatgtcatagatcaatgcattagtcatcctttgcacttgtgcttgtggtgatgcttgtgtaaacaaacctactgtgccaccaatcatataaaagtttagcacataaaattatatacagtacacatgtacatgataataaacaatcatcttactagtttatgtatttactatacttttaatgatttagagtattctctatttacatttttttttttttgagatggagtttcgctcttgttgcccaggctggagtgcaatggctcgatctcggctcaccgcaacctctgcctcccaggttcaggcgattctacaggcatgtgccaccacgcccggctaattttgtatttttagtagacacagggtctctccatgttggtcaggctggtctcaaactctcaacctcaggtgatctgcatgcctcggcctcccaaaagtgcagggattacaggcattagccaccacacccagacttatatatatatttttaagttaactctaaaacagcctcaggctggtcctttaggaggtatttcaaaagggcactgttattacaggagatgactccatgcctattgtttctcctgaagaccctccaatgggacaagatgtggaggtggaggacagtgatgttgatgatcctgaccccgcgtaggcctaggctaatgtgtgtatgtttgtgtcttagttttacaaatgtttaaaaagttaaaaaaagttttttaaatagaaaaaagcttttgaaataaagacataaagaaaggaaatatttttgtacagctatatgatatatttgtgtttctgaggcagggtcttgctctgtcacccaggctggagtgcagtggcaccatcacggcccactgtagccttggcctcctaggctcaatgcaatcctcctactagagcctccggattaactgggaccacaggtgcataccacgacacttggctaatttttatgtttttttaaagacagggtttcaccatgttgcccaggctggtctcaaatgcctgagctcaagcaatctgccagccttggcttcccaaagtattaagctaagtgttactacaagagtaaaaaagttaaaaaaaaattttaagtttacacagtaaaaaagttataataagctaaggctaattattattgaagaaaacatttttatataaagtagcctaagtgtacagtgtttataaagtctataaaggtgtacagtactgtcttagtccttcacattcacttatcactcactcactgactcacccaaagcaacttccagtcctgcaagtttcattcatggtgagtgccctatacaggtataccattttttacctttgagactgtactttttattgtaccttttctatgtttaggtatttttaaacatataaatactgtgttacaactgcctatagtagtattcagtacagcggcatgctgtacagattgtagtctaagagcaacaggctatatataccatatagcctaagtgcgtagtaggttacacatcgaggtttttataagtatactctatgatgttcacacagtgacaaaagtgcctcagaacatattcccattatttagtgatgcataactatagttgaatattaagttactacagattagttatgactgagctgagaaaacacatgctgaaacaaagacatacttagagctctgattcctacccctttaacgactgttgtacactgctctcaaagtccacttcccagtgctttagaatatttaaaataggcattttaatacgaagtagattgtaggatctttatacttactggtaaatgttcaagtaatgaagttacactctcagacacatatattatgcttccatctgtcatgattgctaaaaaaaaaccatcaagagcctgaaattaaacataatgatatgttaaatgaaaagaaaaaagtattttgcaggacagaaataaaaatttgagataaatgacaaaggatttaatatggaaatatccaaagttctgtcaaaatataatactagctttccccctttacaataccttggtatgtatctttgttcatttttaaatgcttctggagaaaaaaagtctctctctggccatctattggacaactggtctctaaaagatagagacaatgttctaccttcatcactaggtatattacatgatccaatcatgtatatacagtattatggcttatttgaagatgctaatgtctccaaagcatacaagacatcaacaatgttttgtaggcacacaaaggaatactttgttattatcatggatatgttaacacagaggtgtacatctgaagtttaaggagatatatgaagaataaaataaaagggagtagcaggaaattaaggtgaaaaattaggctgagttcatatcataaaaggctttgaatataaggttaagacataagaattttattccgtatacaatggtaagccaacagaagattttagggcagggggctgtgcttcaataagagtagtgtggaagcagggtgtaaaatggatttagagggaaaagaaaattcagttaggaaaatcatagtggcttttggactaattaaggaagttaatgggaatctgaatgaaatcagtagtattaggaataaagaaaagtacttcgagcaagcattgagaaatgtgaagttcgatttcagaagagaagtcagagcagggagtacaagacttaataaaaatgcaattttgtattttatacactacaatgtattttcatttgagaatcctaggcacagaagtgacagctgaagaaatgagatctacaaaagacaaatcctggaagaattatctacatataagggatgaggaagagaaaaaggccagagaaaatgacagagaagcctgcgtgcagtggcttacgcctgtgatggtagcaatttgggaagccaaggcgggaagatcacttgaacccaggagtttgagaccagcctgagcaacatggcgaaaccttgtctctgaaaaaaaattaaaaaattagccaggtgtggtggcacatgcctatggtcccagctgcttgggaggctgaggcgagatcacttgagcccaggaagttgaggctgcaatgagccacgaccatgtcactgcactccagcctgagcaacagagtgagaccctgtctcaaaatagtaataaaaattgaaattacaaaaaagaaaatgatagagaagacagaatacactgtcgtcaaggaatcaatggaagaaagaatgacaaagtgaagaggagaggaatggtttggtataaaatgagataaagaataagaaaatgagaaatgaattttggtgattttcaaaaagttatgttaacaggaaggcaagtcggactacaatgagtttaaaaatgagtacaaaatcagaaggctattacaagtcactcattcatgaactttagaagggaagaaaaaggcaaacagttctaagggggtgaagtatcaagagaaggcatttgaaaaaagagcaagtatatttgtagtctaagggaaaggaagatccagtggagaagaagtagaagatacacagcacaaaagatactataaaagggattcttctattaaaatggtcaatacactaaattctaatttcttgtttacttaaatggctctcgaaaaggatagtgacctctgataggaaccatgtatatcttattaatccttgtatctgcagcactagtgtagcgcaagtaaaaatacttgcagtatataatttatagagctgggagttagagtaacctttcctaactctatgtaattgacgaatatatagaaaatggtcccctcccccttgtccccccccttcttttgggaaagagatctggatatcacaaagaacttattttaagtagatgcctatcttctagaatggctcaaacaaacccagtctttgctaatatagaagtagaaatcttgtcattcgagcaaactcatgaattatttttttaaatcctttagtacaataatgccagtattattatttcataatagggtcaaaagtagacaactgttcgccaggcttacacctgtaatcccagcactttgggaggccaaggttggtggatcacctgaggctgagtttgagaccagcctgaccaacatggtgaaagctcgtctctactaaaaataaaaaaaattagctcggcgtggtgacacatgcctgtaatcccagttacttgggaggctaaagcggaagaatcacttgaatctgggaggcagaggttgcagtgggcagattgtgccactgcactccagcctgggcgactaagcaagactccgtctcccaaaaaaaaaaaaagaagacaagtgttcctcaatttccccatctgaaagcaagaaacagatactattgtctacttcataataccagctattatgacacacagatactagtgtttacttcataagagtattgtaaggattcagtgagttaatatataaaaattattcacttatttttctgatttaaagtacaggtttaaatgtttataatatatttatactctaacaaattttcgtatggtaacatttctgctgaatacataaagaattaatcacacaattaattgtcccatctaaaatacaaacagaaaaataactcaatttgcaaaatactctaccttgcttcagacttgagacgtggctataatctatttatacaggcataccttgttttattgtgcttcgctttattgaacttcagttactgggttttgttttgctttttgttttttcacaaagtgaaggtttgtagcaaccctgggtcaagcaagtctatcagcatcattttttttaatagtatgtgttcactttgtgtctcttgtgtcacattttggtaattcttgcaatatttcaaactttttccattattattatatctgtaatggtgattcgcccacataaggtggcgaatttaaatgttgtgtgtgctctgactgctccaccaactcactggccattcccccatccctctccctctccttggagctccccattccctgagacatacaacaatactgaaattaggccaattaataactctacaatggcctttaagtattcaagtgaaaggaagagtccctcatctctgactttaaatcaaaagctagatgtgattaagcttagtgaggaaggcatgtcgaaaactgagacaggccaaaagctagacctcttgcaaccaaacaagtagcaaagttgtgaatgaaaaagaaaagttttagtgaacacatgtatgataagaaagtgaaaacagccttattcctgatatggagaaagtttgagtggtctgtacagaagatcaaaccagccacaacatccccttaagccaaagcctaatccagaggccttaatgctcttcaattctgtgaaggcagagagagttaaggaaactacagaagaaaagttagaagagaacagaggtaggttcatgaggtataaggaaagaggccatctccataacataaaagtgcaaggtgaagcagcaagtgctgatgtagaagctagagcaagtgatccgggagacctgggtaagatcattgatgaaggtcgctacactagataccagagtttcagtgcagatgaaacagccttctattgggagaagatgccatctagaactttcgtagttagaaaggagaagccaaagctggcttcaaagcttcaaaagacaagctaactctcttgtcaggggcaaatgcagctggtgacttttaagttgaagccaatgttcatttgccattctgaaagtcccaaagcccttaagaagtatgccctataaatagagcaacaaaccctggatgacaggacatctgatgacagcacatctgttgacaacatggcttactgaatatttaaagcccactgttgagacctactggtcagaaaaatagatttctttcaaaatactattgctcgctgacaatgtacttggtagcccaagagtgctgatggagatgtacaaggagattaatgttgttttcatgcctgctaacacaatacccattctgcagcccatgggtcaaggaataattttgactttcaagtcttatttaagaaatacacttcataaggctacagttcccatagatagtgattcatgtgatggatctgggcaaagtcaactgaaaaccttctggaaagaattcacccgtctagatggcatgagaagatttctgattcatgggagaaggtcaaaatatcaacattaccaagagttaagaagaagttgattacttgtggataactttgaggggttcaagatgtcagtgaaggaagtaactgcagatgtggtagaaacggcaagagaattagaattaaaagtggagtctgaagatgtgactgattgctgcaatctgctaataaacccgaactgatgaggagttgctccactgatgagtaaacaaagtgatttcttgagatcgactctactcctgaagaagatgtgaatactgttgacatgacagcaaaggatacagaatattacataaatttagttgatagagcagcagcagggtttgagagtactgactgtaattttgaaagaagttctactctgggtaaaatgctatcaaacagcactgcatgttacagagaaatcttgaaaggaagagtgaatcagtgtggcaaacttcattgctgactcattttaagaaattgccgtagccaccccaaccttcagcaaccaccaccctaatcagttagtagccactgacactgaggcaataccttccaccagcaaaaagattaagacttgctgaaggctcagatgattgttagcattttttagcaataaagtatttttaaatttaggtatgatcagtattttttatataatgttattacacacctaatagactacagggaaacaaaacaattcatgtgactcattttactgaaatattagctttattgcagtggtctggaactcaactcgcaatatcgccaaggtacacctggatattaagtcaccctgtgatttcttttttgaggaaaataaaactttcaaaaattaaatctggacatacctctaacattaattgtgtaaactcttcattactaaggaatgtaggtttccagtcctgtcgaatttcactagcatctgactgtgcagtgatttctgtaaacagattgacatattagtggcatactccaaccaccggaggagtacaaaagccctacaagttatcttgtctcttcccattctaattaaagatgacaaccgtaggcattaacatttattgggtagatatcaagaggtccaggttttggtatgatgaaatatttgagataacatggcaagttatctccttggatttggtctcttggtaataccagtctcttcggtttttctcttggtactctgatagttatgttgctgatgggcctgagattgcttcctatttgacacaatgaccaaagaagatttttgctccaagaattttgaagcaattctttttttccttttccttcccttgccattcaaatagcaatgtctagagcagcactagggaaattagctgaaaaaggccaaagaggtcactaggtttgctttcaacaaagaatgccttaggcctgcctactgctgggcaaaaagcttcttcccaacattaagtgctctatcttaattaatcaaagagactaaattaatattttatgcaaaaactttactacagtaatattcccacagtgatttttcttagtgtcctccttgtacaacagtagagagatggtgaaaaatttggagatccctgctgtgggacatatgtttgtcacaattattaccattttatttcactacatacttctaatagatttagttatgaaaaagctattcataaatgatgaaacctagtaacaaatgtttttctattttttaatgtagacatattaaaacaagcaggcagaataaaaatctatgtcatagactatattctacaaaatatactctaatttgtagtaagaagtataaactaaattctgattttatcatcagatagagaaatacagcatactgtccctcatcaaaagttagcatattagaaatgcctgtagtggaatatgaagagtaactaagaagtagagctactaaatgtgcggaatacagttgtgtttttcaaattcacatcaattatatacatttgggaaaaggatttaaatccacaaacaaatccaatcaagtttcattaaacataggcctattttaggatgatacatatataaaatccttttaccttaacagaaatactatttttgtgagaattatgtatctgattttgaaaaaaaaaattacctaatgccacaattcatcctctattgacggggaaatatatgcatttcatttcattcaacaaccatttattgaactcctagtatctttggactggtttcaatgagtgtgccatttaacaataggcactgaggttagtgagatactatctgtagaggtaaaatgtaataatagtggtggcaataaatattgacacatttacgaaagaatcaacagaatttggcaactgtgatatggtgctaaggaagctgaaaaaaaatcctaaaattttttcaggtttaagtcttaggtgactaaaaggatggtggtataaaaatgaaaaaaggcaagttaagagaaagaggtaacttgacaaaatgaaaataaattcaattttagatgcactgagtttgaggacatgcaaaagaaagatctagaagttatctggaaatacatggctaaaatgtttgcatctaaaaatagaaatctggtaggttaatagagacacaatagctgaagctatggaatgagataagcaagagaaagagtgtacagaaagcaagagaacaaggataagacttaggaatgtcacatttagagggtagaaagagaggaaagaagttagtttcagttagaaaaggggaggagaaagtacaatataagggaagccaagggaggagggataaaaatttccagtgctgtacagatgcagaagaagatgcggtataagaaaaagctattgctttattgagggataggaaggtaatgtcattagtgaaattaacaaaaacactttcaacgagtggtggagcataaaccagtcctgtaaggcattaccaactgagctaggcagaagtaaaacagaggcactaattactaactgtcctgagttttacagtttcatttgcatttgaaaaaggaaatttccttttacaggttttttttaaatctattattatctgttaccaaaatacttaatattctttaaattttctttccatgactcatttgtcaagatgattttcttctattaacaaatactttattttatagtgttgatttactagatatacattgaaaccttttaaaatgacacataagaactttatactatccagctttttcctttctttcaaatacacccataattttccaacacaaacatgcttcagtgacaatgaagtctccctgcctctctgcttttgcacatattccctttgtgtgacatgctgtcttccttaatctaaaagactcagttgaaaaatcaactattttaaaagtctccctgacatactctttcctgtgtttttgctgcaaacagtttacaagcactactcacatttgtaattatgtgcttacatgtttgtctgccctggcttgacttaacttcaaatccaggactgttaccctgcatcatgaggatttagcatgtagtaggcacggaataaatgtttgttgaatgaaagaatgaacatattaggaaaccttttaaaatgcaattgatttctctctcttaaaaaagccaaggaagcatccaatcttaagcatctctgccaagattctaactaatgctttgagagtctgttccattttacagagttaaaaatttacctttatgttttcgtaaaaaatcaatgcttttctgcagaacagtagatttgtccatctttctagcattaccaggaagcatggatcccagttctttaatgagaacattaaattgatctctacgtttcttttcagatttgtttctagatactctgatgaaatgaaaaatatgcattttttaaacaatccatttaattacacaagtagtttaatacaatgttaatttagacatgacacagcatgtacttctatcaacatagatggtaacaaatatcttccaggttaccaatatacagttaatttgggcaataatttttcagctcagtttattactaaagaaaattttacaaatcatacatttgacaaacatgtttttatgaaaatgccaataagaaaaactgcattcaaatcacaagttttattcaatctaatacttccagtgattgttaacttacatggttattataaatatatgtactaaatgaataaagacgctattctatgtgaagcagtaaccagtaaacaaacagctattgagaaaaacttgattatttataaaacaatcattttatgatacctgtaattatctgctttgaagtcagattttctaattcagtttctgtttaagcaaagcataatacttttccaaaaggtcagaagatatttaatttataaactacataccaatattctaagttcttccaccttgctaatatatctaaactcctaaagcacatagcttttggaaatcatttattcactatttatttaccattatatttatctattattcattcatttactattttatatctctaatcaaactaccttttcgctttgtccttgtcatcttcttccaccaacccatcaaaaatactactgtcatctctaaaagaaagcggatagagaaagtaagagcagactcactaagcaacagcaatactaaagtgacatgtaaatcaactcagttatgccctatgatttttgtaaagttaatgagttataacattcaaactactaacctatttcctagtaaacattcaaaaatcaaaattcagtaataattatatttttaagcttattacataaattgtaaaagtatttatacttagctatattatgaacacatcatgctaaacaagaatttaaccagtttaaatatcttgtttcaaacttttagtaacggtaaaaacgtatagaaagtcagtgtttgccattatataaaattatttttaactataacagcataatttaaattttttcttagatatttactttctaaaaccacaattactcgtaaacatcacaatgtaatgcattaacttatattaatacatttcattcatttactaattcatttgacaaatatgtattagcactcatgtgctctgttctggacatgtttagtaagcaatgaataagacatttagctgctttcctacagtttttccttctttttcctttttttctggagacagggtcttactctgctgcccagactggagtgcagttgcacaaacatggctcactgcagcctcaacctcctgggttcaagaagtcctcttgcctcagcctgctgagtagctgggaccacaggtacatgccaccatgactggctagtttttttatatttttgtagagatggggtcttgctatgttgaccaggctggtcttgaactcctgggctcaaatgaccttcctatctcagcctcctaaagtgttgggattacaggtgtgagctgccgtacccagcctcattttctagtagatagaaacaagtataaaaatgggagatgaggctaggcgcagtggctcacgcctgtaatcccagcattttgggaggccgaggcgggcggatcacgaggtccaggagatcgagaccatcctggctaacacagtgaaacccagtctctactaaagatacaaaaacttagccgggcgtggtgatgggcaactgtagtcccagctactcaggaggctgaggcaggagaatggcgtgaacccaggaggtggagcttgcagtgagccgagatcgtaccactgcactccagcctggccaacagagtgagactctgtctcaaaaaaaaaaaagagatgagttttaattttttttaaaggggtgatgttttagtaactgcagtctgagcggttagtgggggacacgtgagctaggatctaagtgacaagaaggggctggctatgggaagatgtaaggaaagaccattcctaaaaaataaaatcaagagcattggtggctaactcaaccctaggagcaatattaaagtttctgctgatttatgaagttttacataaattccctattcactcctttagccacacctttctatggcctataaaggcctatatgctataaaatggagtcactattgagatcacctgtaacactcatatcatggtggaggtgcatgtatgaacttggggattccatgtaggccctgaaatttataaaaaattgttatatgtatatgaattttccgagaacagagttcataacttccatgacattcagagataaggaacccatattaataatcactgctttatgtctgaaaatacaaatgtcatccctaggtgtcatactatctagaatgggaaaagcataatgccaaattcatattttatccatcaaaggcagtgaagaaatatcttttccaagaaaaagactatcattaattccgcctgtaactatggcacagttcaaagctattgacatggtgcaggcaggcttctttaaggaagtttcttgctcctcacatcttaagttctggtggagtatacatctttactatctagctcataaaaagggagaagagctgtccccagatgtcaaaagtcacttctgtgtacaagtctagctgcaaaactcttaaagaatcccaatggatggagcacaccgaacagtgcaataaacgcattaacaactttaatgtcagacaaaccaacacaagtaaaaattccagatcatatcttactagctatgtgactttaaacaagttatttaacctctctgacctacagttttctcatttgtaaaatcttgcagaattattgaggttaaataacatgtaaaaaagtattctgtacatttgctgtcagagtagatgctttaaaaatgttgttggattatatcaaatttaagatattattgactgttaagatcaccactattttatgtgcccttaagaaagaaaaaaagagtgctaccaattaaattatgataagagatgctaaaatgtaaaaaacaaagacaacttaaagtcttttcttttctacttttactttaggttcaggggtacctgtgtaggtttttcatgcgggtagactacgtgtcgctgaggtttggtgtaccaatgatctcaccacccaagtagtgagcacagtacccaatagttttttaaccctcactgcccccttccaccctcctccaaaaatttcaagtattaaaatcaaaggaatatggagatttacccttttcccaagagtatgatgtaaagattacaattttaactaatgaaatcctaattatagttacttcttatcagtcacaaatgctaagatgcttgaagggatgaagttagataagaagaaaaaggactccagaaggttccaaggaaacatttgcaactgtcagaatttccttcagagcagctatgaccaaatcactaaaaattacaagtcaggactcatttaaaacacacaagccatatgctgctgactttgcctctggaaaatactgatataccttacttatttttttatactatatttgtttaatacagaaactgaatgcaatagtaattatgtttaggcataaaattccttctatcaatttcatatagaccattattctaatagtgcattttaaaataattatatataacttaaaataagtcttcaaaaacatacctgtcaacaatcgagctcattttactacagcttacggtaaacaacataacatactacgttttcgtcttgtagtagacatttgtacttctccttaggtgaaaagaaaaataaatggtcattagttttctaaaaatgttacttccacaaacttatcttgagaaatactatatgttatcacagagacttcaaaacgttttgtttgtactgaagatcagaacattattttcaagcaaatacctatggctgaggtacatttgaggcttcttttcccctcctaaaaaacacctacaagaaaaaaagtaattcaggctcatattaactttctctttactatcaatcaaaataaaatggacattctcaatattcagtatatatttgactatataactacaaatagtctgtaataacaccatctattcagcaataaatatttgttgaaagcctattttctgctaaacagtacagcaggctttgggcacataacagtgaaagacacagtccctgtaggaaaaatttgcaattgagcaggaagatagatatctaaataattataataagaggtataatgaaggtatatactgtgtaatgctatcactgggcaaggaacaattatgtctacccgtgggaattagagaggggaaacgaggaaatattcttgatgacagtaagtctgtcagggagtcaaaattcttttttaatgcaaatatggtgcagggatgggcagcatcaccatcctctgagagcttgttttcaaaggcaaaatcttaatgaaccagaatctacattttcacaagggctccacgtgataatgtatgaccacttaagtttgagaagcaacaggctggaggacagaaacagataataggtgaaagaattttaagcgacaggaatggcaatttgtaaaggcacaggccttagtgagacaaaagaatatcgtatttgagaaactaagaggtttagcattttccttatgaaaaacctgggatgttacaatttaaagttataattactagaccataaagtttgagaatacaagtggtaaactggcaaaggcaagtcaagtacaggagagtcttactataaagagtctcatacccaaattgaaggaagtaaaacttactgctttaaagctggatcacaagcctaaaatttgtctctctatattctataggttgagtatccctaatctgaaaacctgaaatccaaaatactccaaaatctgaaagcttttgagcatcaacataatgttcaacattcaaaggaaatgctcaacggagcatttctaaaccagagaagattaaagatattacaagaacgtgagattctaaacattcagtcactgttttcaaatgcaccttcatgaaaggaaaggagaataaccctggcaacattgctgcattgcctgtatggttatggctgcagaagtagaactgtgaggggctcagaatatttttttttctttttgtttttgagatggggtcttactctgttgcccagggtggagtgctgtggcatgatcatagctcactgctgccttgaaatcctggcctcaagcaatcctgccacttcagcctcctgagtagctgggattacaggtgctcgctaccatacccagggctaagagttcttaaaagaaaatgagtgacagagtcaaagatagaaataataaaataaaaaggactaacaccaggatgaaaagttgtgattttaagtgtctgaggtagtatcagcagatggaacacagaactacagaattttagaggtagaagagaatttaaagaccacctaagtacatttctctggtccaacagacatatttatcttcatggtaagaagtgaggctgattctatcactagaagaggaagaacagtataaaagtaatagggcaaatttcagtgaattcaaaaagaattgttaagagtaaaaagttcaaaaggccagatctgagccttataaggcacccagtaagtatggcttaattatcaaaaggtagaaaataagacaaactaccaaaaaaagggcagggggtggtggcggggactaggcaacgccaagaattaagggttatactacaggaaaagccttgctgactactagaagggtgaatccaatatagtttagaagatgcaggctgatgctttattaggctgttttactattgttgttaacaatattcttccaaaaattatttgtcgtccagctaatagaacaacgtaagatctctctctctctctctttttttgagacagggtctccctctgtggcccaggctggagtgcagtggcacgatctcatctcattgcaacctccgcctcccaggttcaggtgattctcctgcctcagcctcctgagtagctgggattacaggcccagaccaccacaagccagctaatttatctatttttagtagagatggggtttcaccatattggtcaggctggtctcgaactcctcaactctggtgatccgcctgcctcagcctcccaaagtgctgggattacaggtgtgagccaccatgaccggtcagatataactcttaacagtctagcacaagatcttcatctttccagccaattgacatacacattttacttaagggaaaggagtaagtaaaataggctggacatgcaccctagagcaaatgttagaagatttccctaaacttttaaaaatggtgtcaaattaactttaacaagacaaactggtaaggtggaacagccaaaatactttgtttgcagactactgcaagtcccacgctttcaattcagaaagagactagctagagtcacacttgtccatgctgtggagtctaaggatacagatgccatgccacttccctacacaagctgaagtggaatgtcaaacatataatctaatatagaatacatttcattattttttaagttcgacattagaccacaaagatatgcaatgtcttcaaaaggatcagttgcagttactggaatccaaaattcaccagttttatttaaaaaaactaaaatagtataattggattgtttataacacaaaggataaatgcttgaggggatgacatcccattttacatggcataattattacatattgcatgcctttatcaaaacatctcatgtaccccataaataaatatatatactaggtacccacacaaattaaaattaaaattaaaaattccaaaaaacaaagttccccaactataaaggatcaagttacagctaggaatcaaatgctcctttacttaagcaacttgagatcagagtcatctggtgatatgacttcccagctcaacatgtatcacattactattttattcatacacatgcacatttccccaatttctcaatatcataattttggttaggtggttatatttggagttaacatcattatgactccgtaaatgccaattcacagctaagccatatagtatactataattacttttccttttgagcagtttttcctagagttaccattttgttgtttacctagttttgtttatacttactaccaacttaactacaaattcttccctgtctgtatctactatttcttcaaacacattacacattctaccaatttcaccttctcacagtagtatctctagaaatcttccaacctgtttctattgggactggaaactatctactaacctgaggacaagctgtcttcttgtgatcattattcatcatcatcctggtgattccctgggtctctagttaggtcatattccctgttacttgtatcctatgccttcatcttttttagtttacttctttatttttgttgagtaattcctccaataactgcctaagaaaggggacatgacaggtaaattttttaaggcttcgtaagtctaaaactgtcattagtctatccttaatcaacagtttagttggatactgaatacctggttgaaaatcacttttccttctgaatgctgaagactccactatcttctagcttccagtgtggtgtcaagaagtgcaaagccattctgattactgatcctttagatgtgacctgttatttatttcactctggaaactcccttgttttctaaaattgaacagtgatgtgccctgttttggctttttatatctgtactggtcactcaacaggcttttcctaactggtaactcatgtcctctaattctggagagttttctcgagttgttctctattctttgtttttcccctctgtttcctctctctccttctggagcacttatttgaacattggagatcctggacagttgtaattttcttattttttctctaccattttccatttctttggctctttgctctactttcaatagattttatttttcaacctttccaatgaatttttcatttctaatttcatttcttactgtttctcgttcatacttcatggatatagcatccctcttacctttatgtaaggtttgtgtttaattttcgcccacctaactgctctccatttcccctaacttggtgttttaccttttggtttggcctttgtcttgcacataagaggtttttcctcagctgtctactgatctctgaacatgagctcacatttaagggtaagcgctaaaaaaactgaagctctgtgtgatacagcttgctgactgttaactttactgtagggctatcaggttgaaatatttctttggggaattctcaatgtcagaatctttagatcttttaagatgattataattcagagaaaataattatgtatcttctcaactcttgcctgaagagtataaaaacctggtaccctgggttcttaacccttctatttttaacatgtcacccccattctcagccatgtttgtggctcctttattttatccttactagggaataaatctccagacttctgctaagataggaaaaaggtggctgccttggttccaaagttaagaaaaggatccatggaatataattaccccttaaacagatttgcaacaaatcatcctgttttagttccaccatcactcctatttccagaaatagttttcaattcatgaaaattatagaggttctacagtgccaagaagtttgtttcagctttcccacagcaggcttaggatcctgggatttgcaagaaagttactatgctcccttttgcagtcccaaattttgttgctactgtttcttctccattctctctgtcctgttatgtctttcgtaaaaatcttcttactttagcttcagtgaggtttcaagagaaaataaaatttaattgtattgtttgccatctctagcagtttcccatattctttcatcactcttaattaggctttcatccccaccactccactcaaattgctcactcttattagttatcccaaatctccatattgccaagtctaatggctgttttattctctatttgaccgttaagcaatatgtgatgtagacgaccacttctgcatttattaaataccttcttttcttgattccagtgacagaatattctcctgcttttgtactcatcttgctggctgctccttctcctctaattaatactggcatgtgccagggctgaatccttctaaatctgtatacacttcctagataaatcacacttctacatgccaatgactcccaaatccacacccctagaatagattgtcaaatgcagtcagatatccaactgctttttagacatttctacagattttaaaggtgtccaaaatgtcatatacttaaaacagaacacttaactttcttctgtaaatttgcttctctcccagttttttcccccaacctgatctccatatattctccccatcatttactgtattccagtcacattatgctctttatgttcctcaaacatttcattgtctttcttgttctcactatctataaagctcttctctcagatcttcacacagctggctccttttgccattccgatctcaattaaaattcccctttttcaattaggctatctctgactgcctaatgaaagcagtcaccagtctctaccacattatccttttttttgtacacgtaagacaaggtctcactctgtctcccaggctggaatgcagtgacacaatcacagctcactgtagcgtcaacctcctaggctcaagtcctcctgcctcagcctcccaagtagctgggatcacaggcatacgtcatcatgcccagctaatttctaaatttttggtggagatggggtctcactatgttgcccaggctggtatcaaacttctaggcttacacaatcctcccacctcagcctcccaaactgctaggattacaggcacaagccttacagtgcccagccttacactatccatttatccattttaattctctgcacagtacaaaccacaaatttctcacttgtgtattatttgtgtttctcacttgtgtattattcttcttctagaaggcggttctcatgacagcagggacagcttctgtcttgttcatcactgaatccccagtatctaaagtaattatcggaacatagctggtactacgtttggtggtaaattaacacacaaaaatttttttaaattaaactttccttaaattagtgtgtcaaaatagttgatgaattcttttatttttctggaaaaatatcattttacgatgcattctaagatgcacctttctttaccttttgtactccttggatcttttaaactgattcttcaggaaactataggttcaaggtactcttctatatgaccaaccataagtctcagaattctgtttaaacaagaaaaaatgttagatttattcaacttacatagaagtttatcattaaaagggttttaaaataatttttaaaaataaaatttagaactgtcacaaaaatgtatataaccaattttaaattctataaattgtttctaaaagaaaacaaaataacttaaaacatgaataaactaaaacaatcacttaattctggtacagaagttaaaagataaaagtattaaaaaactgtaactataaaaatgttaatgagtatacaacataaaaggataacattgtgacatcaataacaagggaagagtaagaaagttacatttttatatgcaattgaagttagattgttatacgcttaagacagactgttttaactataaggtgtttttatatataagccccatggtaatcacatgtgaggactgacacaagaaaatgagaggggagtcaaagcacaactacaaaaaataaagaaagaaagaaagaaacacagagaaaaacaggaggaaaggaaaagagggacaacagcactacaagaaagacagcaagcccttctctatcagtaatcactttaaacgtaaatggattaaactcctcaatcaaaatacatggagtggctgaatggatttaaaaaaaaaaagaaagatccaactgcatgttgtctccaagattcacctcagatttaagaacagaagctgaaagtgaaagaatggaaaaatatatcccatgcaaatggcagcctaaagagtataagtgaccatacttagataaaatagatgtaaagtcaaatacaagagacaaagaaggacattatatagtaataagagtcaattcattaggaaaatatagcaattataaatatatatatatatacacccaacatcagaggacccaaatatattaagcaaacatcaatagaactgaagggagaaacagcagatacaatagtagcaggagatgtcaataccccactttcaataatggacagataatccaagagaaatcaagaaggaaagcatagatttaaacagtgtatcagtacagtcatcctttgttatctgacatggactggttccaggaccccccaccaaatattaataccaaaatctgcagatgcttaagtcccttatataaaatgatgtagtatttgcctataacctatgtgcctcctcccctatactttaaatcatctctagattacttataatgcataatacaatgtaaatgtgatgtaaataggtgttatactatattggtttcttaaatttgtattatttgtaaatggttttattctctgaatatttttatccacagttggttgaatccacagacgtggaaccttcagatgcagaaggccaactgtatagaccaaatggacctaacagacatacacaaaacattccacccaacaacagcagaatacacattattctcaagtacacagagaacgttctctaggacagatcacctaatagggcacagaacaagttttaacaaatttaaggttgaattatactaaatatcttctctgatcacagtgaaatgtcagaaggaaaactagaaaattcataagcagatgaaatttaaacacactgttgaataaccaaagagtcaaggaagacatcaaaagagaaattagaaaacatcttgagacaaacgaaaacacaacataccaaaatgtatgggatgcagcaaaagtgttctgacagggaatcttatttcagtcaatgactgcattaaaaatgaagaaagattcctgcaggtgtgctaaaaaaaaaaaaaaaaaaaaaaaaggaaagatctcaaacaatgcaactttatacctcaaagaactagaaaaagaagaacaaagcccatagagagcagaaggaaggaaatatgattagagtagaaataaaacagtgaataggaaaaaaaaaaaatcaacaaaactaagagttgtttctttgaaaagactaacaaaattgacaaatctttagctacactaggaataagagaagactcaaaatcagaaataaaaggagaaattacaactgatgtcacagaaataaaaaagtatttttttgagacaactcaataaatatacaccaacaaattagataacctagaaaaaatggataaattcctagaaatatgccatctaccacgaaggctgaatcatgaatagaaaaatgtgaacagagttcacagcagatttattcataatggtctaaaactataaacaatccagatgttcattgacagtacaatggataaacaaaatgtggtattcatataatggaatgctatacaacaaagagaagactgcatgcaacagcacagatgactttacaagagagtacatagtttttttaagaatagacaaattaatcagtaagtcagaatgataaaataaaaaaagaaaatctgagcagacacatataacttgtaattatattgaatcaaaaacttcccaatgaagaaaagccaggaccatatacatgacttcactgaagaattctaccaaacactgaaagaattaataccaatccccctcaaatgcttccaacaaactgaaaagggaacattttcaaactctttatgaagccagcattatgctgatatcaaagccaaagacaccataagaaaaaaactatagaccaatattccttatgcatattgatgaaaaattctcaacaaaatactaccaatccaaacgcaacagtaaattaaaaggattataccacatgaccaggtggtatttatccctgggatttgagcaaggttcaacatatattaataaaaccaatccatgtgctacaccacatcaacaaaaccaaggataaaaatcgtatgagggatctcaattgatgcagaaaaagcatttaacaaaatccaacacctattcatgataaaaaaaaaaaacgccattcaacaaactaggaatagaaggaatttataaaccaagaaaaggaggaatttctctttcttaaaaaataaattggtttgaaaattatgccctttgactcagtaatttcactttgagaaataataaaataatcaaagatgcatctaaacttttatattcattgagatattattaaaaataataaagctaggccagtcacagtggctcatgcctgtaatcctagcactttgggaggctaaggtgggtagatcacttgaggtcatgagttcaaaaacagcctggctaatatggtgaaaccccatctctactacaaatataaaaattagctgggcatggtggcacacgcctgtaatcccagttactcgggagggtgaggcaggagaatcgcttgaacccaggaagcggaggttgcagtgagccgagatagcgccactgcactctgacctgggtgacagagcgagattctgtctctaaaaaaaataaaataaaataaaaacagtaaagctagaacaaatttaaatgtctaactgcattaacagtggcatgaaaatatatcagacataaacctgaatatagcaaaagtatcaactgtgattgctcctaggtagtttatggatggtgttttttgttctttctttagtactttctaaaatttctcccatgaacatgcattacttttataatcagaaagcttaagtgctgcattttttttctttttcttttaattgtccaatactagaggcctagctatacatgaggaggcaaataagataaaacacaacctgttatctattccagagaacaaaaacttaacagagactatttttctagccatttaaagaaaacaaagtttcatctagttaataattttaaaattattaattaaaaatggctaactcaggaatttgaattttaaaaattaaaactacagtttttccctaacctaataacctactgacccactgacctactttggaatttaggtttgttaattctgataccacaggtatttcgggaactgacggatctattaacattaattaaaagtagtgctgaaatttaattgaccggtataatacaaaacctaaggaacaaaccttaactacttttattaccacttatgaaaaattctaacttgcttctgcagattactgattttgtattataactgaaacagtaattatttctaagagaaaaactattttaacttgcaaagaaaggcccaaatatttaatactttttagattcgttgtttaatgtacgaggaaaaaatgaaattaaacagtggttctcaatttattcaatattgaatgtattagccacctctacaaccgatataagatattggcaaaataaaacacatatttggttttacagctatctctacaatcaatttaaatttgaaaactgacctgtaagaataagaaccacatcccaaaccagttttatgaaccagacctcttaaaaccagagaggattctggctcaagacaaacatcaactgacactataactctagcctgctgaatgtcaagatgtaagatattcactaaacctcattaaataaacaaaaactaaaaaattaatacagttctcttagtgggacaatactattccaacgattcaactaatatatatttttcaagtaatgtctgagctttgtattcatataacagactgatcttgcccacagagtataggagcaccttatccccttttcagagataagactaaggcctacatctgtcctcagccccaagtaagccccacataaaacctgaaggtggagggagagcacaagcctcagaatgaatttcacatgtaatcaggtaccataaacctgaagctatacgactctacacctggccttcatcctgacaccagcaggaagaaagagggagccctgtggtaggcagaataacagcctccgaagaatgtccattccctcttccctggaccttatgaagatgttatgtcacatggcaaaaaaggacactgcagatgtgattaaggataaggatcttgagatgtggagattatcctgcattatccaagtgggtccaaaataatcacgtgagttcttaagaggaaaggacctttcctagctgtggtttgatatatcagaaagaacggtcaaaaagatggcaagttaaaggcataagaatgatacaatggaccatggggactcggggagaagggaaggataggaggggggatgagggataaaagaccatacattgggaacagtgctcaggtgatgggtgcaccaaaatctcagaaatcaccactaaagaacttatccatgtaaccaaacaccccctgttccccaaaaacctactgaaatgataattcttttaaaaagatgcaaagttgctggctttgaaagtgaaagaaggtggccacaagccaaggaattcaggtagcctctacaagctggaaaaaacaaggaaacagattttctcctgaagcctccagagagaaatgcagcccgctgacaccttgggttcaggtcagtgagatttgtgttggccttctgagctgcagaactgtaaaacaataaatttgtattgtcttaagccattaagtttgtggttatttgtatggtagcaacagaaaactatacagaatccggtttctctcgataaacctggctctcaccaacacttccctttcagtatttacagcaacctgcataggagatcatcaaagagaatcccattatgccctccattctttttacatcagtcaacaagaaatgcccaagactcccaagtcatcccccatccctatatactttcatccctatatactctgtatgtccctacactgaccccttttctcttcctcccccaattcccgaaatcctttcgcagtgtcttctggaactcatggtacacatcgtcgttaaaatatcctatttcctcagtattgttgttgcacactcttcaccttacttgctcccagctgtaacctctctcccctctgggagttctgctctaactccagccctttcaaacaatggcttctctctcatgtgagataaaatatatttactctcccatatctcagatgaccaagccctgttggtggggtgaacttccttgtaactcactgtcatttctgaattattctctccctccctaaaaccttagctttgactctcatgccaccagactacatcagctattatcccctccttattgtagtcattcacaaaccccaggataagccccttcactccacgaagggtgtgaccctctccaatacctcttttgaatttcaatgtacacaaaatgatcccccaaaactggccagtgagttccttgatctcttctgcaacaattttgtgttccaccccacctcccactcattctgctagtgttaccccagaattcaccattactaatatccaaaagaccctccgtatcctcaattttaagcatctaagccctctctcacaaactgggatagcatgtgatccacctgatgcaaaaagacaaaaaacacaaactttttttaaaaaaacaaaaaaactgctgggcgcagtggctcacacctgtaatcccagcactttgggaggtcaaggtgggtggatcacctgaggtcaggagttcaagaccagcctggccaacatggtgaaaccccgtctctactaaaaatacaaaaattagccgggcgtggtggcaggcgcctgtaatcccaactacttgggaggctaaggcaggagaatcgcttgaacccgggaggtggaggttgcattgagccaagattgctccacagcactccatcctaggtgacagagcgagaggtcgtctcaaaaaaaaaagaaacaatcaaaaaacaaaaacaaaaaaactgacaatatagctctaacttatttatgttgggtctttaaaaagaaaaaaaaaactgtgccagctcataatctttgttggagcctcagtttctcttcctagtaaaggcacaagggagtaaagcaagtttatttgacatggtcgggaagactaaacatagtgacagtcaatgattggttatgttgttaattaccttctatgagaaatgcttcattctttttcatgtttctctaaactctagccttccttttgaccactgagtcctttatacacttatcatattgataagctattctgtggcaaaatgtaatgattgcttaccactttaatatagttcaagttgtgctgactataaaaactttttaaaattccaatttacagtatttactaacacaaacacatataatgcaaataatgaaaaacttgttcagggctctaaggcttctgaagattatttatcacattccaagacaccaattttcctttctagctttagtcttatttctccttcctcatttcccattctactttactgtacacagactccttattctccagctacactaaggaatcacgtcaccattcctagatagtagaaaataaagacctctacgtaaaacaaaggtttgtccaccagtacccaatatattatcaacataaatatcttaatacaataaactggaattgaccttcacagaaaatcatattgtcattcacatcaagattcaactaatcatgatataaactttatgttattagtgaaaaactgaagaggtactatgtgcttcctatggcctctataaaaattatcacaaagttaatggattaaaacaacacaaatttactatcttacagttctgttggtgagagcccaatataggtctcactgggctaaaatcaaggtgggctaaaaccgaggtgttggcagggctgaattccctcctgtaagctctagcagagaatgtttccttgccttttcaagctttagaggccacccgtattctttagctcatagctccctctactccatcttcaagccagcaggaggccaagtccttctcgggctgccatttcttctgcctctttcttcccttattacattaagcccacatagataatctaagataacctccatattttatggttaactgattagcaaccttaattattccttgccatgtaccctaacatagtggcaggttccaggaatcaggatatgaacctctctgaagggtcagtattctgcctaccacgtaccatggaccaaaaagtctctgtttggcaaagacaaaatcaaatattttttgaggggaaaggtgaaacatcaaaggataatttgatctattaatagataaaagactacagtactatgccagtagttcttaacttctgaactatcttaacctttcatatttcttaaagggaattggaaaataatgtgtatgacaattcaggctgcatgcgttcaactgtaactaaagtctaactttattgctatatggtagcaacaggctctagggatattcttctgaacggaaaaatctgtcaatgtccaaatgaatactagcacatatttccccttttggaaaactaattgttacaccataaacacatatgatgtaatttatatgcactaaacagattgtccaaaaaagatgaattaaaccccagactttgtagaagcctattttttaaaagggcaaatgtatatagatttctgagatggatctccagaaaaaaaaaaaagagatacagaattttagcaacctaaaagaagtacagaatttcattagtactataaatcctctagggacctcttaggaaatcggattattaagtagtactttgacaatgctaggtttagagctaattcatgagttgtttaataacatacaactaatatgtataaatataatgacaatgtttgacatattatgtactacatctatgaggtcaccagagccacttaaaacaccaccaaaaaatgcatcaattttcaaggccacaagtattcccctttgtgcaataatcatttcactgaaaagacagttgttttgacttattaaaactcgggtaaactgccagctgcttttgtgtagccaagtaggcccggcaaattcaaaatcatctgaaaagtatttcaaagaagtttagatgcatcctgaaccacagataattcagaaaaaaactaccataaagcatgtcttcttcactaaaataatcattatatctaagtttatatttaggaaaaaatgtaatccctttgaactagaagattttgcaatatataatttatacatatgttacccatttctgcttttctgtccctatttactttcaaagctttcaaatttaaaaaattgatctatctagttccttattattattattattattattttaacccactgactgtttgatccttaccctaaaatgacaaggtgtggaaaatggcaggccaagaccatatctcaatctgtggagtggcaggggagatggggctcaaactgcataggtctttgcatcacgtaagtaggagtaaatataggataaatgaggacgtgtaggtagtacaagaatccaccagccagaaggcctgtgaccaggtttcacagaatccaacatggacataacaagtatattatagaacagacatatactcttgatacagaagacacgagatctgatgggatttctactgattcatctttaagctcactgactcttctgtcatctccattgttactgagcccatgcagtacatctgtatttcatatattgtatttttcagctctgaaatttccatttgattatttcatatagtttttatttttcagagaactatttttacactcctttcagaagtgttcacttttacctcatgaacatgagtactttaaggcttttttctgataattccatcatctggatcatctcagagttgtcaactggcttatgttctttttcctttaaaaatggtcagattttactgtttctttgtatgtcaagtaattttggatcatatcctggacattctagatattaagttatgagattctaggttccattaacatcctctaaagcagcagtcctcaacctttttggcaccagcgactggtttcatgcaatacaatttttccatggacagcggggatggtttctggacaaaactgttccacttcagatcatcacacttgttagggatggtttctggacaaaactgttccacttcagatcatcacacttgttaagttagattctcataaggagcatacaacctagatcccttgcactcgcagttcactgcagggttcacgctcctatgagaatctaatgctgctactgatatgacaggaggcggagctcaggcgctaatgctcactagccagtcacctacctcctgctgtgcggcctggttcctaacaggccacagtaccaatcgttgtttcagttttcaaagcgttcacaatgctgcttaaatctatcctccgcatgcatctctcaggggcaactctgggatttgagcagtggtttacaccatagttcagctctctaggtctttgccatgtttctttcgctctgttccatgtacgtgtagctcatggatgcagtaggtaggacctttgtgtgttcatacatgcaattagggaatctccccccaaactaggtgtcttctctttgagacttccaaagcatgctccagcttccagagttctctttcccaattcctctggccagagagacggctttcttcttgggattttaagtacatataccactatggcaatgtaattttacaaatggagatggtctcagggcacagctgggagagaaaaaaaggggggaattttctttgtcctatgactagaaataaagggtttctcttggagtttttgctaactgctgcactcaacatgtacttctacaacccagcctaccatttggttaaagctggataacaaaaagaaaaaaaaaatggtaagctaagcactacacaagctattcaggttttgacttcccttctcagtttgcctattactgtttactttcgaaagtcttcagataattgtttttgtttctatctagagggtttttgttgttgtttttgttttgtttggggggagtggtgtgttttgagatagggcctcactctctcaccaaggctgcagtgcagtggtgtgaacacagctcactgcagcctcgacctcctgggctcaagcaattccctgcctcagcctcccaatgtagctgggattacaggtacacaccatcatgccctattgatttttaactttttaattttttgcagagacaagatctcattatgttgcccaggctggtctctaactcctgggctcaagcaatcctcctgccgtgacctcccaaattgctgggattaaaggcatgagccatagcatcggcctaaccggggttttaagttctaatcagagaggcttactccacttttgcctatccattatgttttatccatttcccaattaaatttcacctaatggctttagtagtcacgactaattgttatctagaatcattatttcattaggagtatgcactgtggtgagtttgtaagccgatcgttctccagtgtttctgtttgtttgtctgtttttgcgcttgtttttgagacagggtcttattctgtcacccaggctggagtgcagtggcacaatctcagctcactgcagcctcgatctcctgggttcaagtgatcctcctgcctcagcctcctcagcagccgagactacaggcatgcaccaccatgcctagggctaatttttgtgtttttagaagagacgaggtcttgctatgttgcccaggctgatctcaaactactgagctcaagcaatcctcccacctcagcctgccaaagtgtttggattacaggcatgggccaccacatctgacctccaatgttacttaatagctacaattcttctaaagatatgctttccctcttaactatttggtagtcctggaatataatctctacagaaaaagattaataaatggttgactttttcctttcacttaccaattattttcagaataataaattggtgtatatgagggttttttaaaacaattattatgaattcttgaattactacatttttgtgtatttcagtgtactataatcattacactttttagtatttatttatattaaaatttctgtctttttttttaagagacaggatctcactctgtcactcaggctagagtgtggtggcctaatcacagctcactgcaacctcaaactcctaggctcaagtggccctcccgcctcagcctcccaaggagctgggactacatgcatgagccaccatgcctggcttatacatatttttttaaatttgtcaagtgcagtagtgagaagagggtgaaagagtagaacaaggagttcaatctgtaacggactgtgaacaatcaaatgaaataacccattacctttagactagtcatagtacacttttttaaacctatttttatgggaaattacaaatatacacaaagttagaataataatataattaatcctatatatccttcacccagtttccataattatcaactcatggctaatcaatcttgtttcatctgttctgctccttcccttcctctccactctttcggattatttgaagcaaatcccaagtactgtatcattccatctgtaaacagtccagtatatttgtataaactacaagggcttttataaaacataactacaatatcattatcatatcttacgaagtcaacaaaagacatataagacctgtttttacacgtaaaataacaaaacgccctgagagaaattataaaagtctaaatgtaagaaggcatacaaccttgcaattgattggaagtctcaacactgaaaaacatccaatatctccaaattgatttataaattctacactaagctagacaaaatccaatcaggtttgtggcgggtagtgcggaggactgcttataagctgagtgcagaatttttattgaaattcaaaggatcacgaaagccaaggtaattctgaagaacaaattagaggatttaaactatcagatatcatgacttattataaagctacagtaattaaaagagtatggcaatggcatgacagaccaacagaatagagtccaaaaataaatccatgaataaacagtcccttgcattacaacaaaagtactactgcattacggtagggaaaggatgatcttctcaataaatactactggaacaactggacttccacacggaaaataaaatgaactatgaggcttacatatatcacacataaacctaaatgcaatagttgtaacagtcaagtttatagaagaaaacatagataacatcttcttggctttagggtaggcaaagatttcttaaatgaaacataaaaagcgttaaccataaaaaaatttgataaaatggacttcattaaaattaagaaattatcttaatcaaaatacactactagagtgaagaagcaagccaaagactaggaaagatatcttcaatacaactgaacaactgaaattatctatttctggggtaatcaagacaaccaactcaacagaaaaatcagcaaaagacataacagtcatatccccaaagaggatattcaaatggtcaacaggcatttgaaaatattctaagccttttaaatcatcagggaattacgaattaaaactacaatagacctttactacatatgctccataagagctaaaattaaaaacactaataatttcaagtgttggtgaggatgtagaacaatgagaactctttgtacactgctaatgggaatgtaaattaatttaactactttggaaaactaggataatctcctaaagctaaacagccagataccttaagacccagcaatttcactcttaggtgtctactcaacagaaatgtgtacacatgtggaccaaaagacacgctcaagaatgttcacagaagtattcttcataacagccaatactagaaacaccccaaatgttcatcacagtagaataaatactgacatatccatacaatgaagtatttcacagcaacaacagaaaagatgaaccactgctacatgcatcaacatggatgagtcataaacaagattttaaaaggctaggcacagaattcaaaaatagacaatactgaatgagtcacataatagttatctttgggagtgtgtaataactgttaaggggcatgaaggaggctcctgggttgacgaaaatgtcctatatcttattcttgatattagttaaatgggtgttgacttcataaaaattcatcaaaatgacactcaggatttatgcactttataatatgtgtgttataatttgatgaaagagtaaacaaaaaaaagttagtgatatcatgtcagtcccttgattttttaaatttaattttttttggttatttgactatgaaattaaaaagtctagtaaagctaagttctacatcagcctgcctctttgtgggtactaaaagtcatgttcacgttctttcttaacacaattactgaggaattgtcttggtatgtggatccttcccataacatgaggtcaacagaaagtctagcttgaagctagagttatccaatattcacaaactagaaaattgtaacactgcaggtacttcttcttagtgtaattataaacaatcaatttttctttattacattccagatcactagtttccacagtttctatttggcaaaaagaggtaaaaaaaaaaaaaaaaaaaaaaaaagccgggcacagtggctcacgcctgtaatcccagcactttgggaggccaaggcgggcggatcacgaggtcaggagatcgagaccatcctggctaacacagtgaaaccctgtctctactaaaaatacaaaaaaaattagctgggtgtggtggcaggcgcctatagtcccaactattcgggaccctgaggcaggagaatcacgtgaacccgagaggtggagcttgcagtgagccaagatcgcaccactgcactccagcctgggcgacacagcgagactccatcaaaaaaaaaaaaaaaaaaaaaaaacacaacttgaggcttcacatctaagcttagttttagctggaattgaaaacactcagcaaatcaaggcaatgtatcacaataaggttgtcataagaatgaaataaatattaaatgtaaagtgcttagaatataatgcctcaaagtaaatgctcaaaattgtattaataccgttctaagaaacacatgtaacagacccttattcttgaatttccttcaaaatataataaatatatggtagtaaaaccagacccacttttaaacaaagtatttttatggagctgagaacaaaatcaatttttaatgaatctgaactgaacatattaaagtacaggatcaataaaaacttagtaaattgtactcaagaattttttaagttctaaattatacttattggtatttaactatgaccctacgattaaaataactgagataatcaggaaaaatactgctaatataaagagctcatctttgcattgtattttttacatttgcaaagttgtatttcatttcattaccatattactataaaataattaaacctattttataaaacttaagtcataaacttattaaatccagcaaagaatcgcagaacaggccaggcgcagtggctcacactgtaatcccagcactttgggaagccaaggaaggcggatcatgaggtcaggagttcgagaccagcctggccaacatagtgaaaccctgtctttactaaaaatacaaaaattagccgggtatggtggcacacacctgtagtcccagctactcagaaggctgaggcagaggttgcagtaagctgagacaatgccagcctaggtgccagagcaagactctgtccccctcacccccccaccaaaaaaaaaaaatcacagaacaagaaatacttatacttgtgatcacataatgatacgccaccaaacaaaaaaattcttttcaataacagtaccatcatgtaaacaaagtatatgtaaaagcagtttgaaaaaaaaaggggactatattttttaagcagtcctattgcaatactctaagtgtatttttaatggaaataaatgttaatttgaaagtaacagtagccaggcaaggtggctcacacctgtaatcccagcgctttgggaggcggaggcaggcagatcgttagagctcaggagttcaagaccagcctgggcaacatggcaaaaccccttatctactaaaaatacaaaaattagctgggtgttgtggcacgtgcctatggtctcagctacttgggaagctgaggcaggaggatcaactaagccctggaagtccaggctgcaatgagctgtgactgcaccactgcactccaggctgggtgacagaacaagaccttgtctcaaaataaaaaataaaaaataaaattaactggatgtaatttccagttttatacatagctgctaaacatgtttcttaaactttatacttggaaatcattcaaacatgcagaaaagttaagaatagttcaaagagcttctacatatcctttatcctgatttgaccaactgtcaacaacaatcctgttgaccaactgtcaacattttgcattattgtccatatcatacataaacatattttttgaaccatttgaaagtaaaatgcacatatcatacctttttacctctaaatacttcaactatacctcctaacaacaaggatattctcttaaatatctacagtatagttaccaacttcaggaaacttaacagttatacagtatcttaatgtaatgcctattttctctctttttttgttttagttgagcaaaaactgccctccaagactttttccctcttccaatactgaatccaatccagggtcatgtactgcatttagctgtcatgtctacccagacttctttaagctgaaacacttttctttcagtaaatatcttttgttttgtttttttgagacagggcctaactatgttgcccaggctggtcttgaactcctaggttcaaatgatcttcctgcctcagcctcctgggtagctgggactaggggtgcataccaacacacccggcttctgctaaataccttttaaacaatcttatctttacatggtatcctgcaagataagattttaaaagtggaattcttaaaaaaaaccatatagggaagttccattaaaaaaagaggttcagtgtaagagctgcgaaaagttcagaagacttaaataaaaaaaatacataaatcttcctattcaagagtggctttttagcatatggtatttattttattttatattttattttttttaattttttttgagatggagtctcgctctgtccaggctggtgtaatctcggctcactgcaacctctgccttccgggttccagcaattctctgtctcagcctcccaagtagctgggattacaggctcccgccaccacacctggctaattttttgtatttttagtagagatggggttttaccacgctggccaggctggtctcaaactcctgaccacaggtgatccacccacctcggccttccaaagtgctgggattacaggcgtgagccaccacgcccggtctatagtatatacattttaaagctttataatgaggaggtttccaggtttctttgagatcagcaattcttagattagaggtttatattctctctattaaatagcaatatacaatcaatttatacaaataaatttggccaatgatttgattggtatctgcagaaaatggacctaggctgggcacggtggctcatgcttgtaatcacagcactttgggaggctgaggcagaaggaccacttaagtccaggagttctagagcagcctaagcagcatagtgaaacctcatctctacaaaaaataaacaaagttagctgggcatggtggtatgcacctatagtctcagctactcaggaggctaaggtgcgacgatcgcttgagcctgggagatgcagtgagctgagatcatgccactgcactctggcgtgggtgacagagcaagaccgtgtctcaaaaagaaaaaaaggtaggggggagccaggcatggtggctcacacctgtaatcccaacactttggaaggctgaggttgggggaacacctgaggtcaggagttcaagaccagcctgtccaacatggcaaaaccccatctctactaaaaatacaaaaatttgccaggcatggtggcgcatgcttgtagtcccagctactcagaaggttgaggcacgagaatcacttgaacccaggaggtggaggttgaagccaagagagcaccactgcactccagcctgggtgacagagcaagattctgtctctaaaataaataaataaaataactttttaaaaaaggatctacagaaaattactattttcatcaaaattctctcctccagttaacaaaaacacccagtctcaataagcaaacctttaaagaatggggaatgattttgatcatgcatagacataacagttattggaactggcacataccttgttctttcactggacacttactgtgtgccaaatatgtgccaggcctatgctaactgtggagttgagaaatccagtggtgagctaaaaaggcacagaacccactcttaggaaactggtaatttagcaaaccaccaagactcctgttttcagacagtaaaggtattagttttccctaatttggaaatgaagcaattagattcagagtggtaaatgtgccccgagtcacataactaagtgttctcaagggacaaagaaggtaaacacaaaaattatggtcttctatctcctaatatagtacttaacctgcctgtgtctgactacaaaagagttacttaaccatatcctttaggcctatccattgactccaaagggacagtgtactttcatctccaatgaactacttttgtttcattgagtcagtcatcaactaatcttttaagtacttaagatgttaggtatgtaaggtattatagtaacattaaaacttggttaaaaacagagcagcatactaattttctttctacatattcccacatattcattttagaataaaaataatagaagaatccatttcccctgatttactattttaaaatgacacaggtcaatataattagaatatgtgtaatactttccactaaagaaaaaagtataattaagtcactgagaattggcatggactcctatctctctctaatttccccccaattcatctcttaaaccatagcactcaaatctataaatactccttcagccatgtagagcaaggatcagctaaacttattctgtaaagggccacacgggtaaattttttttttttttttgagacggagtcttgctctgttgcccaagctggagtgcagtggcatgatctcggctcactgcaagcgccgactcccgggttcacgccattcttctgcctcagcctcctgagtagctgggactacaggcgcctgccaccacgcctggctaattgtttgtatttttagtagagacggagtttcaccgtgttagccaggatggtctcgatatcctgacctcataatctgcctgcctcggcctcccaaagtgctggggtctctgctgtaactacagacatatgtcgtggggatacattttgagaaatgcacaggcaatctgtcattgtgtcaacatcacagactatttctatacctagatggtatagcctactatacacctagacgatctggaatagcctattgctcctaggctacaaacctgcacagcatgcaatggtactgaatactcaaggcaactgtaacacaatataagtatttgagtatctaaacatatcttaacatagaaaaggtaatgggttgtgccatgatgacatgatggccatgatgttaccaggcaatagcaatttttcagctccattataatctcatgggaccactgtcgtatatttggtccatcactgaccatgtaatgcatgactgtacttaactgctgctatagcctaaaagcagtcatacacaaaacctaaaaaataagaatggctaatgttctaataaagctttactcataaacactaaaaattaaatttcatataactttcacgtgtcacaagttagtcttcgagattttttttcaaccatttacaaatgcaaacaccactcttagctcatgagtcataccaaagcaggcaccaggctgaataaatttggtggtgtgcagaccccagtgaaggcctgcttgtaaagaggagctgcagtctggctcttcttttacctcagtcagctgacactttatctctatagctaaggcctggcaggaaataattcttactcgactttcagtcatttgcaaatcatcttccttaaactcaggaaaaggtaagttatgactcttacttttgagcactagttttgagaaatttcaggaattgctaaaatactttacatctggatttcaattatttttcccaataaataaccttcttactcctcataagaatgaaaattctaaagataaataaaagctgccaaggaaagtagcagatcattacccaagtatttttataattccttgtcctatgcttccaccggtacactgcaaattccacccaaccatgattaagggaaaagaaacaaagatagcatacctttgagctcaaaatgatgattgaaggtatctagtgagacttgccaagttctaaagattcatttaagaggactgtagaattatccaaaggcatcttacaatgtgatagaatcagcttctgagctccagcagctttgcaggaacaagtaaaaattctgcaaagaaacagtacttactgaaataatgctaaccaatttaagtaacattattatcactagtatttttgtttcatcgacgtatagaacatttattgcgagcctcctctacgtgccaagaattgggaatgtgtcaataaatagatcagatctcatcaacccctctgggaactcaaccgtaaatgggacaaaaagtttgaaaaatcacgatggtgtgaagggaaagcataacagagatacaaaccagtttgctggaaattggttagaaaagttctcctgggacgggtgcggtggctcatgcctgtgatcccagcactttgggaggccgaggcaggcagatcacttgaagccaggagttcaagatcagcctggccaacatggtgaaacctcgtccctactaaaaatacaaaaattagccaggcatggtggcatgcacctataatcccagctactagggaggctgaggcaggagaatagctttaactcgggagatggaggttccagtgagccgagattgcgccactgcactccagcctgggcgacagaacaagactctgtctttttaaaaaaaaaaaaaaaaaaaaaaaaggtttccctaaaggaagagaatttaatgcaagaatgtgtatgatctagccaaataaagcaagagggaagaggtgagaaagaaaattttttgtccaaagggaacagtgtgttcaaatggctaggtgtaggtgaaaatatgacatttgtgtggaagtaaaagaagtccaatgtagatgttcagaatgaaacaggaaatgagaaagggcatttcctgagacaagatgggcaaagaaagaaagcaaaaggtgaagcaatttgccctgaatcacacagggctaaaggcagagcccattttaaacccttaccacttgactgcaatatactagccattctgaaattctaagcaggaaactaaaagttcctagagaggaatttcaggggacctttgcaagagcccaaggaatgactgccctgggccaatagctgaccttgccatggatggataaaagaatcaactgatcatcaagcgtccattgtgcagaatgagaaaaaagtctcatcacaattctcaactaataattaacaattactaagcactttactatgtgtaaagccctgttttaagcacttgacatatatttattcaatcctcacaacatcactatcaagcaagtgctttcattatcctatctatctaattttaatgacacagtccaatcatggctattaattttcttgtactgacaacaagaaatgtcaacaatacttcttgacacaatattgaaagcactttagtgactcttctttcagaaaagtactgctcaaatatcaacaaaaaaagactttagaacattaatttggttcctttagcttttctaatttaataccactgtttcaggtccacataaaaaactgagggtaaagtacagagatttcccattgactccattaatgcacagccttccccatattcaacattccccaccagagtggtacatttactacaactgacaaacctacactgacacatccttatcacccaaaattttaggcttcactcttagtgctgtacattttatgaatttggacaaacataatggcatgcatccactatcatatcacaccgaatagtttcatcggcctaaaagccctctgtgctctgcatatgcatccctcccctcactaacccctacaccacattcatttttttattacctccataattttgccttttccagaatgtcatgaagttggaatcatacaatatgtagtagccatttcagactggctcctttcacttagtaaatacacatttaagatttctccatgtcttttcacggcttgataatttctttttggcactgaatgatatattccattgtctgaatataccacagtttatccgctcacataatgaaagacattttggttgcttccaagttttggcaattattgaaaaggatgctataaacttccatataaagatttttgtatggatagaaactgtcaattctttggttgctagatcatatggtaagactatgtttagtttcgtaagaacctgccaaactgcctttcaatgaggctgtaccattttgcattctaaccagcaatgaatgagagttcctgttgttccacatcctcaccagcactggatgtagttagtattttggattttcaccattcaaatatgtatgtagtagtatctcattttaatttgcatttccatgatgacagatgatatagtgcatcttttcacatgcttcttgaggtttgtatatcttctttggtaaggttatctgtcagtgtacctggcccattttttaactggtttgttggttctcttactgttaagttttaagagtccattgtgtactttggataaaagtcctttatcaaatatgtcttttgcaaatatcttcaagtctgtggtttgtctttttattcttttgataagtacctctcacagagcagacatttttaattaaatttaattttttctaacacggaatacgtctttgatgttgaggataaaaactcgctgccaaacccagtcatctagatattctcttacgttatcttctaggagttttatacttttacaatttacatttaggtctctgatccattttgagttaatttttatgaagggtataaggtctgtcgagattcatttttttgcacatagacagttgctccggtaccatttgttgaaaactatcttttctccattgtattgtctttgttcctctgtgaaccattagttgactatgcaatcatgaattgcattaacaatgtttcaggacagaccgtatatatgacagtggtcccataaaattataatatggagctgaaaaattcctattgtctagtgactttatagctgttgtagccattcataacattgtaatgcaattgctttttaaatacatttagtgtagtctaagtgtacagtgtatataaagtctacagtagtgtaccctaatgtcctaagccttcacattcaatcatcactcactcactgactcaccctacgcaacttccagcccaacaagctccatggtaagtactctatataaagtataccatcatcttttaaactgtatgtttacattccttttctacattcagatacacaaactcttactgttatattaaaattacctatagtattcactacagttaacatgctgtacagtctagtaacagtaggctacaccatacagcctaggtgcagagcaggctatacatctaagtttgtgtaaatatactctatgttatttgaacaatgacaaaatcatccaacaatgcatttctcatctcagaatgtatccctgtcattaagtgacacatgactgtactgatgtggatctattcctggtctctctattctgttccactgatctattaaaatatttgtctatgctttcaccaataccacactgcttgatgactgtagttgtaaagtaagtcttgaagtcaggcaatgttggatctccaattttgttcttttctttcaattttaagttgcctattctgggtcttttgcctctccatataaacttattggaatcagtttgttaatatctacaacaaactgcaattttgactagaattatattcagtctacaaataaaattgtgaagaactgacaccttgttaatatagtcttcctatccatgaacatgttatttagttattgtttatcagagttttgaagttttctttgtacatattttatatatattttattagatttatacctaagtatttattttgggagatattaatgtaatggtattgtgtttttaattttagaattccacttgttcactgctggtatataggaatataatctacttttgcatattaaccttgtatcctgctaccttgtgcttattggttccagtttgtcaattcttttggatcttctacatagacaatcatatcatcttgcaaacaaaatgagttttatttcttctttcccaatcagtatacatttcttttcatttttttatcttactgcattagctagaacttccagtatgatgtgaaaaggagtggtaaaacgggacatccttatcctgttcctgatcttactgggaatcttaagttctagattctcaccattacataaaacgttagctatagttttattctcacattcataaaatacttttaatcttccattcatatcccaataccaacacctaattcagtgacgctctttactgcatttaggctgttatgtccccttacctcttttgaaaaaattattatttaccactctgaagcacaattcacatactataacactcacccatttaaaacctacaattcagtattttttagtgtatttacagagttgtgcaactatcactacaatctaattttagaacatttttatcccccccccactttgctgagctgtagatttttttaatagatgttctttctcaagttgaagaagtttctctctattccaagttttacagttacagagtttttttttaaatcatgaatgggtgttgggttctgtcaaatgttttttaaacatctattgatatgatcatatgatttggttttctttagccagttaatgtaatggattaatttcttacatgccttggataaatcccacttgatcacagcatatagttcattttataaatgttgaatttgatttgctaatattttgttggggatttttgcatttatgttcataagagatattggtctacagttttcttttcttgcaatatctttgtctggttttaggattagagtaatactggcctcacagaataagttagaaagtattccctctgcttctgtcttgcaaaagagaatgttaacattggtgtaatttcttccttaaatgtttggtagaattagaactcaccaatgaacccatctggacctggtgatttctatcttaaaagattataaataattgttgactcaatttaatagatataggcctattcagattgtctacttcttgtatgacttttggcagattgcgtccttcaaggaattggtccatttcatctaggttatcaaattcgtgggcacagagttgttcataatattcctttatatttttaatataaatggaaatctgttatgatttctactttcatgtcttctattagtaatattagcgtatcctttttccttagttagcctagctggaagcacatcaattttattaatctcttcaaagaaccagcttttggttttgttgattttctctatgatttcttattttccatttcactggctgttttgtttgttttgagatggagtcttgctctgtcacccaggctggagtgcagtggcacaatctcggctcactgcagcctccgcctcccgggttcaagcgattctcctgcctcagcctcccaattagctgggactacaggcgcctgacaccatgcctggttaattttttgaattttttgtatttttagtagagacggggtttcaccgtgttagccaggatggtctcaatctcctgacctcgtgatccacccacctctgcctcccaaagtgctgggattacaggcgcgagccaccacgcccagcctctgctctaatttttattgtttcctttcttctgcttactttgtatttaatttgctctactttttgtagtttcctaaggcagaaactttggttttagatctttactcttttctatgtattccacgctataaatttccctctaggcattccatttgttgcatcccgcatattttgttaagttgttttcattttcatttagttcaaaacatttttagatttctcttgatacatcagtgtagtgtggcaaaaaaagatgaaaataaaaatttttttaatagatttcttgagaatctttgacccatgtgttgtttaatcttcaagtatttggggattttccagctgttactgatttctactttaattatattgtggtctgagaacagatactgtctgatttctattcttttaaatttgttaaggtgttttatggcccaaaatgttgtctcttgtggtgagtgttccatgtaggcttgagaagaatgtgtattgtgctgttgttggatgaagtagtctatagatgtcaattatatcaagttgtttgacagcactgttgaattcatctatgtttttactggttttctgcccgctacatctgtccatttctgataatggggtattaaagtctccattataagagcagattaatctgtttctccttgcagttctgtttttgcctcacatacttacatgctccactgttagctgcacagatgtttaggactactatatcttcttggagaactgacccatttatcattatttatgcaatgcccctctttattccggataacttccttgctctgagagctgctctgtctgaaattaatatagctattcatgctttctttcggttagtgttagcatattgtatttttctccatccattttcttttaatctatgtatctatatttaaagtgggtttttttggtagacaacataaagttaagccttgatttttcatccactctggcactgtcttttaattggtgtgctgagatcactaacatttaaagtgatcattgatacagttagattactagctaccatatttgtgattgctttctgttctttattcctattttagtcttccagtctttttctgcctgttgtagttttacatgattctattttcctctcctttcttggtatacttttttgcttttttgttttactttttttagtagttgccctggagttcacaatacacatttacaactaatctaagtctactttcaaataacactaaaccactttatgggtagtacaagtaccacgtaataatcctaatacctccctcctatcctttgtatcattcctgtcattcatttcacttttacataagcgcatacatacatacgtgtatatataagcatacataattgaatacactgttgataacattattttggacaaaccatcagttaaaaagataatgatttttccttaagcctgttaatgtggtggatcacactgatttttgaatatttaacctgccatgtatccctagaataaactccatgtgattactatagtgtaagattcttttggccgggcacggtggctcacacctgtaatcccagcactttgggaggccgaggtgggcggatcatgaggtcaggagatcgagaccatcctggctaatacagtgaaaccctgtctctactaaaaatacaaaaaattagccgggtgtggtggcacgggcctgtagtcccagctactcaggaggctgaggcaggagaatcacttgaacccgggaggcagaggttgcagtgagccgagatcacgccactgcactccagcccgggcaacagagccagactctgtctcaaaacacagaagattatttttatattttgctgaattctatttgctaatattttgttaaggatttttgtgtctctataaagaatattggtttttaatttgttgtttctgttctgcctttgtctggttgcagtatcaggataatacttgaaatgttcccttctcttctgttttttagaagagactatgtagattagactctgcagtgaaaccaactgggcctagagatatctttttggggagtttcagaattacaaaatcaatttgcttaatggttatgggatagtagtagtagaatgttggctttttcattactctcatacattgctggtgggagtataaattgatataaactttatagagaacattatgtcaatacccttaacaaaattacaaatgtttttaccctttggtacagaaatataggggttataaccagcattttaaaaatgaaacatggtggggggtggggagtcggatcgcaggacacctagttatggtaaagggtatttcctgaaactgttgtttcagatatgtgtgtatgagtgtactaggtcataacataaaatatatttcttactatgagttgtggtcatagaagtttgggagctattgtttcagctttaaaaggataacctgaggcaaaaattataagctgacacttagggaagggagggtataatgtcaggatatgaagagaaagttaaataaggcagataaggagacaaagcaaacgtgaaatatgacattaccaagctatgcagagccatgagaaaactggcctatttggggtaaatgcagaggagagaggacggggagaatttatctgaccagtgctaaagagacataagagatctggcaaagattttcccacagggtattaatccctaaacaaaaatgccaaatatttattgttttcctcatgacactatctttgcttaaaaggttgactgtagacattcattgtgctcagacttcaaagaactatatcagtgctatggtctaaatgtttgtgcccctccaaaattcttatgttgaaacttaatccccaatgtgacagtattaagacatggggcctttggatggtgattaggtcatgagggctccaccctcatcaatgagatcagtgcccttataaaaggcctgagggagcttgttcccctccctttccatcatgtgaggacacagcaacaaggcaccagaatgggccttcaccagatactgcatctactagcaccttgattttggacttcccagtctctagaactgaaaacaataaatttctgttgcttataaattactcagactaagatactttgttacagcagccaaatggactaagacaaccgacaagctataagaggcagttccaatgcccctggatgacactgaatcccagatcatcaatgagtaccctcatgtcaatacattttcctcaagctaaccttatattctgccccccacccaatccaacacctttcaaaacattctcatacctgtttccttggtttctccagatgcttattattcaagtcctgcaattttattttattttacttttacttgatagggtttcgctctgttgcccaggctggagtgcaatggagcaatcataattgactaccgcctcaaactcctgggctcaagtgatcctcccgcctcagcctctggagcagctagaactacaggcacaaaccactatacccagccaatttttaaaaaaagttttttgtaaagacaaggtctcactatgttgcccaggctggtctcaaactcctagcctcaagtggtcctcctgccttggcttcccacagcactgggattgtaggtgcaagccactgagcctgcagtcctgcaattctttttgtatataggatagttctttccagagcagggcttgtaattctcttcttgggatgtgctaagaccctgactatagttattaaccagaggataatgagtcatagtagaggcagatcttaagaataaatgtcattggaccaggcgtggtagctcatgcctgtaatcccagcactttgggaggccaaggtgggcagatcacctgagttgaggcattcgagaccagcctgaccaacatggtgaaaatacaaaaatacaaaaattagccgggcgtggtggtgcacttctgtaatcccagctactcaggaagctgaggcaggagaaccaattgaacccggaaagcggagaccgcagtgagccgagattggccactgcacttcagcctgggtaacagagcaaaaatctgcctcaaaaaaataaaaaataaaaataaaaataaataaacatcattgaacatttatggggtcactgcacagtcttcaagcaatgatgacaggaggggtggcagggggtctttcctctgccaaagggaaatgggatgcttctccttgccaggaagcttcagcatgaattgtaggattaaaaattctgaagtacagggatccactctttccctattagggccctgacttagacacacaacacctgcaaaggttgcatatttagtcttctctgcagttgtatcaccttaataatccgattcaaggccaacattttagcatagtctccctgaagtcaacaggataagattctgttatcctataaaactgtcatagaagccctctgggttccacagtatgccttaaattggcaattagttgtgctaaatctaaccacttttttaaggccaccaacaaaaacaacctcataccacaatccttaaaattatcactgcccccacaccgatcaagtgaagtatctgttttctcccaaaaccttgacttctatgagcctcactcccattaattacagatgaaagctttagaattacaatgccaactgtatccaagggtcatcaacacctcatttactaacagcaatagtttcccctaatatgcagatgaactggtgaaaattcaactccaaaaatggcattatgaggatctgcttttgtagtatgaactactcctagaaaacaacacctgaggcaaaacagactgttgacacaggtatcccacagcttcaaatttatattaattttacaatatacatttaaaataaataaatccacagtagacatacagggtttttctccctcccaaatctttttaatactaaggttcagttctaaggaaacaaagtgaggtaatgttaaactcatacaagctacaaattttagaggtattttaaatactctttctcccttactccttcacaattttcccaattctgtgactggaattaatcttcataaattcctcctcccatcccctgcctccagcaccagccctcttgaatccatcccttgctttatatcagaagactctaacattcatatttgatcatgtcactcaaattccttgagatataaaaattgctccctataacaactcctttgtgaactccagatttagtccccaaggttcagccttatctctttcaagtctctcatgatttaaccttttccatttacttgctattccctacatacatcaaattttgtcacacctccaagtctatgctcacggttttttcagtctacaatatttttacagatattcttacaaaagtgcaattttaacgttggtaaaatggtttctttctcaaatgtactagaaaaaaattcaattttaaatggaactacagtaatttgtgtcccttaattaatctgtcacataaattcaaatttctattttttttgtgtttttttgagatggagtttcactcttgttgccaggctggagtgcaatggcatgatctcagctcactgcaacccacacctcctgggttcaagcgattctcctgcctcagcctcccaagtagctgggattacaggcatgcgccatcacgcctggctaattttttgtatttagcagagacggggtttcaccgtgttagtcacaccggtcttgaactcctgacctaaggtgatccacctgccttggcctcccaaagtgctgggactgcaggcgtgcgtcaacacacctggctcaaattactatgttttatagagctcaccttatagattttagatgtgtgctgctactctcaaaattctgattcttgctatggttataccataccacggtggtaacaccccatgaattattggccttcacaaatatgcaaaggaaagaaatgggcctcagactcagacatacttgagcaaattattcactttgcttgaatttcagtttcctcacctctgaattctctctaaatacatctatggatgctatgcaatttttactaatatcttatattgatttgtgtccatatggtatgcatatatgagtgtgtatgtaactagacaaactgatcttagtatttatgtggaagagcaaaaggctaagaatagctacaataatttgaagaagaaaatggagagagcagtcctacaaataatcaagccttataatatgggtctttcaaaacagagatagagagatcacaaatagagtcatatgtatattaaaaaggcagcattataaacaaagagggaaagaatggactatccattaatggtagagacaacaggtacccaaatagggcaaaaagttataccggatttctttcttaccacacgtaaacataaattccaagtgcttcagacccaaatatgaaggcaaaacatatcaatttttagaagaaaacacacaataccttcatatctatagaggagaaaataactttcttaaactatcataaaccttaaaggaaaacaagccaagcacaaactttaaagaaaaaaaataatatatttggcttcattctaattcaaatctgaagtctaatttaatttaaatttttaatttttctaattaccaaaatatcccataaacaaatgaaaagacaaaccacggactgagaaaatataccacagaagattagtatccaaagttcgtaacaagatactacatatcagtaagaaaaaaagataaacaaaagatgccaaccagtaataaactgtttttttttaaaaaaaaaagaagcataaagaacgaataaacataagaaaacatgctaaactttatgaacagaataagtagttggaaaaataggtaacttaaacaggtatcctaccccttaaggaacagtaagattaacagccatatattcttaacctagattcatcaactgttaacaatttgccacatctatactctttccaccatatatatgtatgtatttgtaaatgcacactttccctctctcatatatatgtatgcatctccatatacaacatacaaacatgcacatgtacacacacaaatacacacactcatttacttctgaaccatataaaatgactaactctaagcttgaaagcaaggaagctatcaaaacctaatatggtcatataaaaaagatttagaagcaaatctgaaggggctcctactggccagagacaggccaggttgaataaaaagaaattgtgaggcacagtaacatataatgtgtattgtttagcataagacaaacgaacaggctgggcgcagtggctcatgcctgtaatcccagcactttgggagatggaggcgggcggatcgcgaggtcaggagatcgagaccatcctggctaacacggtgaaaccccgtctctactaaaaattaaaaaaaaaaaattagctaggcatggtggtgggcacctgtagtcccagctacttgggaggctgaggcaggagaatggcatgaatctgggaggcggagcttgcagtgagcgagatggcaccactgtactccagcctgggagacagacccagactctgtcaaaaacaaacaaacaaacaaaaccagacaaacggacaaatgtagaactctcacttgtgaccaaagagtagctagagtatcaagtcaaccctcagggtacagaacagtcatcactatttacaccttcttggtccaatggaccctttatattttcaagtcatcttatgaattatttatacgagaataaagggataataaaaaaaattgacactgaaaaattaaacatatcacaaccaaatttttattccattttttgaggctttgaaagtgtatctacatgacatgggtaatgtcctctgaatgcaactggctgatcatccatgcacgaatctggaacataatcatcctgtactgcttccaggtttcatatacatctctaatacctctccagatacatctccacatacatttcaaatatatttctaatacttctccagatttctaatacatacctctaatttcatatcagcttatcaatatttctactcttcttgcaatttcatcataaaaaaaattgaagaagtttttgaaacctttgatggcttataattttattgaagagtggataccatctttttttgctccaaaactgtaaaacattcttgtttttaagcatcaattaaaatgagcaatccaacaacttttttctttttaaataatctatttccttccagtcacctttgttacatgtctttagcattacaaattgttatccagtaaattttggcatgcagacaccataaaagacgtaagaacacatcattttagcaaaacaggatggtgtaaggctcatcagaaaatattcatacccggccgggcatagcagctgatgtttgtaatcccagtactttgggaggctgaggcgggcggatcacttgaggccaggagtttgaagaccagcctggccaacacagcaaaacccgtctctactaaaaatacacacacacacaaaaaaaattagctgagcatggtggcaccagcctgtaatcccagctactcaggaggctgaggcagaattgcttgagcctgggaggctgagattgcagtgagcggagatcacaccactgcactccagcctgggcaacagagtgagactctgtctcaaaaaaacaaaaacaaaaacaaaaaaaaagaaaaaagaaaatattaatacctattaaatgactgactagacaagaataactatatttatatttttacactcagaaatataattcttcatgcattgatttctgagtttgagaaaattcacctattatatgaataagtgcagcctgagattttgcttaattcatttgacctagttttacttttttattttaaattatacctactacttacatttgtggttcacataaaatttctattggacaatgatggtccagtgattcacatgaaatttctattgaataaagcctgaggtgcatttatttttctttttgcatttatgtgctggtttgtcaaagagatgtgaaacatctttctgtaatttttcctctttgccataatgagcagaaatgaaaatttctaaattctcaactgtttctaatgaaagctgaaagcggcctacaatgatgatatctccagacttataacttccagaaagatgatgtaatactttgggaaatgcaaaaatcttaaaaaaaaaaatacaatagtgacaatttatttccatattctatcactctcctaggtgattccatcatttttccattttcatattatcttttaggagggacagaaataattgatgagtaatttgttatgaatgaaatgaaacaaatcttagtaatgaaacaagtcttagaatgatgaaatcacaatccttaaagctacaggaatataaccaatgaaagatagaatgagttttattcagtttttaaaaagaaaattttggctgtgcacagtggttcatgtctgtaatcacagccctttgaaaggacaacatgggaggatcacttgaggttgggagttcgagaccagcttaggccacataccctgttctttagaaaaaatttttaaaaagaaaagcagccagacatggtggcacacgcctacagttctagctactcagaagtctgaggcaagaagatcacgtgagcccaggaattggtaattatgataagctatgatcacaccactgcactccagcctgggtaacagagcaagaccttgtctctaaaaaaataaaataaaataaatgaataataaacattttttttttgagacagagtttcactcttgttgcccaggctggagtgcaatggcacaatcttggctcactgcaacctccgcctctcgagtagctgattacaggtgtccaccaccatgcccagctaattttttgtatttttagtagacacggggtttcaccatgttggccaggctggtctcgaactcttggcctaaagtgatccacccgcctcggcctcccaaagtgctggaattacaagcatgagccaccacacctggccaaataaaaaaattttttaaagtatatgttacctttctactttcaaaggcctttaagaaaaaatgagtcaagaaattattagtccttccatagttagaactgctcaaaaaaaaaaaaaaaaattccagtgtgtactgatggtatgccaagggttaatacgaaaatgtttaactataggttgagtatccctaatacaaaaatccagaatctgaaatgctccaaaatatgaaactttttgagcaatgacatgacactcaaaggagcatttcagatttcagattttcgggatactcaactgaaaagtatactataaatattccacaatctgaaaaaatacgaaatccgaaacgcttctaatcccaagcatttcagataagagatattcaacctgtaacaggaaatttacaaagcattttccttgactggcctgtcaaactgtatttcaaggtaggcaaagggaccaaagtactgaaagctactcctttaaagaaaaatttcaactaagaagaacaaaagaaatgacataaataggcaaaaatcatcaatcctaaaaaccccatcaggagaaaaagtaatggtaaatttcacaatggatcatattgtcaccaactgaattcactgatcaatcttaacatctttaacactgggacaaccacatatcatgatataacatgtagtaatagtactacttacagaatattcttgttaagagtcaaactagaatctatgaacctttagatcatacattctcaacagtagcaatgtcacattcaagaaggcaaagaaatcttaaacagtaaattaagacagtttctcatcctccaaatcatactactgtgtctgcccccaggtctggggaaaaggtgcagtgtagacagtaaggaaaaaaaaagctctaggccgggcacggtggctcacgcctgtaatcccagcactttgggaggtcgaggtggtcagttcacgaggtcaggagatccagaccatcctggctaacacggtgaaaccctgtctctactaaaaatacaaaaattagccgggcaaagtggcaggcacctgtagtcccagctactcgggaggctgaggcaagagaatggcatgaacccgggaggcggagcttgcagtgagccgagatcacaccactgcactccagcccgggtgacagagtgagactccgtctcaaaaaaaaaaaaaaaagctctaaaaactccgtaatgaggcaacaattaaaaaaaaaaaggttagaaacactgcttcacatccaatttccagttacatgaatacaagaaagtaataagtaaaatgacatcaaaaggaataagaaaatgcagaatgtgaaacgttataaagaaaaattgacccagttacttcaacatggagggtaaaaagactttactgcggtaatcatatttagaaatatactttaaaatattaacagataaataatatgtggaatatacttcaaaatagtattagaagagggtaaggagattaagatatagatgaaacgagagttgttgagtaaataaatcactaaaagtaggtgatgggtacataggagttcattttactattctatatactgttgtatatgtttaaaacatcctgtaaaaacaaaagcatgtttggggcacattttgctttcttaggatattagagagaacaaaactatacaacacatagcttgcccatatattttctatcaaaggtgatctacaaactgatgtcattcctctcccaaataataccttttttaaaaaaagattcaatcattatataggcatgactgaaaatgagaaaataaaataaaaattttaaaagactaaaaaaacataactgggaggtatgtacctgattcaaatcctgatacaaataaagcaacaaaaaggcatttttgaaaaagctgaatatgaactaggtgttttatgatattaaggaagtatcgttaattttgttaggtgtggtaatgataccgagattatgaaagaaaatatcagctgggtgtggtggctcatacctgtaatcccagcactttgggaggcctaagtgagaggatcagttgaggccaggaaatggagaacagccttggcaacatagcgagatctcatctctaccataaaatttaaaaaattagctgggcatagtggcacatgcctattatctcagtacttttggaagaccactttagcctaggagttcaaggctgcagtgagctataattgggctactgcacttcagcctgagcaacacagcaagaccctgtctctcaaaaaaaaaaaaaaatcctatgttttaaaataaatatattgaggccaagggcagtggctaacgcctgtaatcccagcactttgggaggctgaggtgggtggtcaggagttcaagaccagcctgaccaatagagtgaaactccatctctactaaaaatacaaaattagccaggcctggtggtgcatgcctgtaatcccagctacttgggaggctgaggcaggagaatcacttgaacccaggaggcagaggttgcagtgagccgagatcatgccattgctctccagcctgggaaacaagagcagaactccacctcaaaaaaaaaaaaattaattaattaaatatattgaagtatttaagggtgaagtgactatttccttcatccccccctcactgccttattttaaagaaacctggggagtgaatgagatgatgatggtgataaacactcatgtttgccgcccctccatgcagaaagtctgtgcagatgagcacataaaaacaaacaaaaaagaataaatctataagacaatgaaaagaacagagagaaagtgtttacaatagatttctggagaacagaaagcagacccaagtgtgttaagtttaaacagaactaagcgaagcacagcccaaaatctacacatgaaaggactacagtggaggtctaagtcaatctttcagagattctacgctcccctcaatgactaagcaagggccagtgtcacctgtaggtacaaaaagtgaaatactctttttttcctaaagacagttaacaaactgaacagaaagaaactgggtcttctggtgtcaatgtcagtatctgtagagcccatttctatatggcaattggaaagctccgaagcctaaaaacaggttccctgatcttttgccctaaacctaacttgccagcaaacaagagatgctccaactatgtacaaagagttgccagtcttctcattccaagatggcaattagaaaacaagtccatgactacaatccaggaaaccaacagcagtacctaatataatcaagatggtcctttagcaagaaccatgaactaacaataaggatccccagatatacaagaagaaacaccacctagaaaaagaccaagataaagatattatctatttttttagtttttaaaagagacagtcttactttgttgcccaggcaggagtgcagtgacacaatcatagctcactacagcctcgaactcctgagctcaagtgatcttcctgcctcagcctcccaagtagctaggactatagacatgcatgaccatgctcaactaatattttaattttcttgtagagatggggtctcattatgttgcctaggctagtctcaaactcctagcttcaagcaatcctcccaccttagcctcccaaagtactgttattaaaggcatgagccactatgtcccacccagaccaagacaaataaatagatcaaactgacttcaaaaaaatcatagtttattcaggacatagaagaaatctcaaaatagaacaaagtattctcaaaggactactgaagataccgcattcaattaaacaaaaataggtatatttaacaaataataatacaagagtccactatgccaagaactgttacaaatgcttaataaatatgaactcctttactcacaaggtaggtattattatcctcattttgtagactagaaactgaggacaaagagattaatcatttgcccattgtcatggttttgaagttgtggagctgtgatctaaacccacacagtcaggaagtctggttccattgtcaatgcttttagctactatcctgtgttgtctcttgaaatgataccagcagaaaataagcaaaagctactcattaacaatttataaacattcgcaggtcagaaacatacaattgaaaacatctgtcaaaatacagaataaaaaagacagaaaacttgagaaaagagataaagaaatgaggatcaatcaagaaagccaatattctgctagtaagtatcccaaaatgggcaaacatagactaagaaatattaccaaggaaataataaaagaacattttccataactgaagggagacacttgcatttcaactgaaaggacctactgagtccagcaaagaataacaaaaacaattcatatctaaacacataattataaaattccataactacgaaggacaaagataagatactaaagcttatctttgtgagcgagggaaaggatcatttagaaaataacaagacagaatagcatcagacatcttaccgtcttgatgctcaacagaattgagcaaaaacctctaagttgtaagagagaattaatttgaatttaaatttctacacccagccaaactatcaagcaattatgacccaggccaaagctattttcaaacatgcaagaattcacaatatttacattgtaagtactctgtatactggagttaatttaaaatacattcaaagcaggatgcagtggctcatgcatataatcccagcactttgggaggccgaggagggtggatcacttgagataaggtgtttaagaccaacctggctaacatggtgaaaccctgtctctattaaaaatacaaaaattagcaaggcatggtggcaaacgcctgtaatcccatctactgcggaggttgaagcagaagaatcagctgaacccaggaggtggaggttgcagtgagccgagattgtgcccctgcactccagcctgggaaaaagagcaagactccatcgcaaaaaaaaaaaaaaaaagagtaaatacattccagctaaaaaaggaagaatgctataaaagaggaagatgtcgcatctaagaaacagtaaatctaaccagaaatgcagacacggaatagctcagaatgacatatacacagcagcttccaacctgtcaagactgaagcaggaagtaggagggctctaagagtgatatctccaggaaaaggcattccacctaacagttaatagatattatgatccaagcaggaaaaacatctgagaatatgataaaggtatatatttctctaaagaaaaaaagacaattacaaactgtgggaggaaaagatgaacaaaaagtcatctagaatataaagcaatctagcggcatgatttcgaaaaaatgatgaagtacaagaagaaataagtaaatattttatttcttgagttccactagcattatgactttagacccatagaaaaaaaaaatagccccagcactataattaagtaaagtgtaagtgagctaaatcctcatctttcttagcagtgagtcaatagatataatttgaagttagtaaatcaagaaataaaagcagatctcaacaacaacaacaaaagcctaggaggctttactggagaattctatcaatcatttaaaagaattaaccaggccaggcgtggtggctcatatctgtaatcccagcattttgggaggccgagaagggtggatcacaaggtcaagagatcgagaccatcctggccaacatggtgaaaccccgtctctacgaaaactacatcaattagctgggcgtggtggtatgcgcctatagtcccagctactctggaagctgaggcaggagaatcgcttgaacccaggaggcagaggttgtagtgagtcgagatcacgccactgtattccagcctggcgacagagcaagacttcgtctcaaaaaaaaaaaaaaaaaaaaaaaaaaaaggaattaacccaatcctcctcaaactcttccaaagaactaaaatgggagagaacatttccaaactcattctaaaaagccgccattaccctgatataaaaaccagacaaagataccacaagaaaagaaaaccacggtaataaccataatgaatagtgattttttaaatgttaaaaaaaacaaaaacaaaaacaaaaaaaaccccagcaaaccaaattcaacagcacattaaaaggattatataccatgaccaagtgggatttataccagaaattcaaggatggttcacaatacaaaaatcaattagggtaatataccacattaataaaatgaagcacaaaaaccacatgattccaattgacgaacaaatgcatttgacaaaattcaacacccttccatgataaaaacactcaataaatgaagaatagaaggaaactacctcgacataataaacaccatatatgaatatcccacagctaacatcctattcaatggtaaaagactgaacacttctcctaggattaggagcaagtcgaggatgcccactctcatcacttctattcaacacagtaccagaagtcctagatagagcaattaggcaagaagaataaatagaaggcactcaaataagaaagaaaattatctctgtatacagatgacatgatttatatgcagaaagccctaaagaagaatccacaaaaaaactgttagtactaatacatgatttcagcaaagtttcaggatccgaaatcaacacacaaaaatcagttgcatttctatacaccaaaaatgaccaactggaaaggaaaatttaaaaaaaaaaatcccaatttactatagtatcaaaagaggaaaggcaaaccatggtggctcaaacctgtaatcctagcactttgggaggccaaggtgggagaactgcttgaagccaggaatttgagaccttatctctctataaaaataccaaaaaattagccgagcgtggaagcatatacttttagtcccagcttcttgggaggctgaggtaggaggatcatttgagcccaggagttcaaggtcacagtgagccatgattgtgccactgcactccagcctaggtgacagagaccctatctctttaaacaaagaaaaggggtcgggtcgggggggtagtgtggataaaaatactaggaataaacttaaccaaggagataaaagacttgtactctgaaaactacaaaacatcgctaaaagaaatcaaagagagaatacaaataaatggaaaaacattccgtgtttttaaactgaaagagttaatactgttaaaatgtccatactacctaaagcaatctatagattcaatgtaatccctgtcaaattctcaatgacattttttttgcagaaatagaaacaaaaccatcctaaaattcatacagaatctcaagggacccccaagtagccaaaccagtcttgaaaaaccaccaaaaatttggaggcctcatactttcttatttcaaaacacactacaaagcaacagtaatcaagacagtgtggtactgacataaatacagagctacagaccaatggaacagaacagaaataaacgctcgcacatgccaccaaatgacttgcgacaagggtgccaagactacccaatggagaaaaaacagtctctacaacaaacagtgttgggaaaactgaatatccacatgccaaagaatgaagccaaaatatgatattactaatttattttatgatgacctaaaagttttgatttccgaatattttttcaacactttttaattaagtattttagatacatattagaatatttttctgcctagaaagtaattcaaaccatatcactgactaaagatttttgggattgtttgtaaatccgtgaaaaagtgcttaaggccaggcatggtggctcgtgcctgtaatctcagcactttgggaggccaaggcaggtggatcacctgaggtcaagagtttgagaccagcttggccaacatggtgaaatcccatctctactaatagcacaaaaattagccaggcatggtggcacacgcctgtaatcccagctactcgggaggctgaggcaggagaacagcttgaacctgggaggcagaggttgcagtaatccaagatcatgccactacactccagcctgggcaacagagtgagactccatctcaaaaaaataaaacaaaaacaaagtgcttgtttaagatgcaggagagtggacacttgtttactaaattcaagacacactacaaaacttttgcttttcagtaaactctcgatgttttcctttttgcctgtgtcttaaaacattaatgtataaagaacccaatagtaataaaatgttttgtacatttgtttgccatttaatctagcttgtactaccctatgattaacagcactgaagtaattaataattacagttgtaatatgcagcgagtcaagtggagcatcagtgcaacaataccaaacttgaaacgagtgcttattctactctcaactatcaccaagccaatcctcctcaaactcttccaaagaactaaatgtgagagaacatttccaaactcattctaaaaggccagcattaccctgatatcaaaatcagacaaagataccacaaaaaaagaaagctacagcaataaacctaatgaatactgatttttttacccttaaaaaaatactagcaaaccaaattcaacagcacacagtctatgtgctgttgtactgcagaatctaatactcctgggtatttttgttatagcagccaaaactaagatatccattctatcctcacatgctaatagactctaatcccctacaccttgatttggttttctctacaatacaaatatccatctagcatatatttaactcactagtttctcatctggtttcctcagttagaacataagctccctgaaggcagggctttgttccccagcagacagaatagtagctggcacagaacagaatgctcaataaatacttgctgaatgaacaagatgaagaccaccattaaaggtatactaaaagacttcaaagcactactgagaaaaatgaaaggcctaaatgaatggagaggtatactgtgttcaaggatcaaaggactcaatgttgctatcagttttctttaaattaatctatagagtaaatacaaccctaaacaaaatctcagcagccttttctgtataaagtgagaatttttttttttttttttttgagacagtcttgctctgtcatccaagctgagtccagcagcacagtcaatggctcactgcaacctcaacctcctgggctcaagcaatcctcccatctcagcctcctgagtaggtgggatcacaagtgcatgccaccatgtctggctaatttttttctatttttttggagagccaaaggcctcgctatattgccactacactccaacctggtcaatacagaaagacctctttatcagtataaaaaaaaatttttttgcttcttgattatggtgattacaagaatgtttaggtttgtcaaaactcaagctgcatacttaaattgggcagattttaacatatatacattataccccaataaaaatcaattttaaaaaatatacatcaaaaactgaaacccaacaacaaaatacctaaagaacactacataaaacagctcataaatattgagtattctgcatacctttaaaaaatgacaggcgccagctagagtggctcatgcctgtaatcctaataatttggaaggtcaaagcaggaggatcacttgagcccaggagttcaagacaagcctgggcaacaaagtcacatcctatctctgcaaaaataaatgacaataataataataataggaaattgtctgcacttaggtaaaatgaactagtttgaagcaggccaatattcttgctaagaacaacttaaaaagctaaataaattataaaaatcatatttttaaagttagtgaggagctgtggaagcatgggaaagaaggtctaaaattccagtgatgggagaatctttttttttttttttttttgagatggagtcttgttgctctgtcacccaggctggagtgcagtggcacaatcttggctcactgcaacctccacctcagagatggggagaatattttaaaggtatttagatgaccagtatctgtcttttccctgggagtatttcctaattattgcttgggttagaggctgaaaattgaggcctgacctgtgtaaaatattgttgctgaggaacacagaagccaggacagcttttggtgttcacacagggctggaataacaacactaggagactaattctcctaaaaagtttcacgcaaggacctcaagcttaaaggtggtatctcccctcagcatacttgctgaattttaaaaccgtgcagggtaaaaggctacaaagtcaactaaaaaactttgaaaagcaaagtgaaatttcctacctttggcattgctaaagggacaagaccaataggctttgaaatgaatgccttagaagacaacatctgaaaaaacaaggaaaaataaggatagcaaactattaaaatagcaacccagcctccacataatttaagatgatgggctcctgatatgggttggatgcttgtcccctccaaatctcatgatgaaatgtaaatgtaattcccaatgttggaagttgggcccagtaggaggcaactggatcatgggggcagatccctcatgaatggtttagtaccatctcctcggtaataagtgagttcacacaagatctggttgttgaaaagtctgggacctgccccaccttgctctcttgctcccactcttgccttgtcatgcacctgctctcccttcactttcagccatgactagaaacttactaagcctcactataagcagatgccggcaccatgcttcctatacactttggagaaccgtaagccaattaagcttcttttctttataaattacccagtctcacgtattcttttatagtaatgcaaacagactaatacagctccctagcctatctgcatagaaaatgaacttccccttcccccacccctctcccaacccggcaaaatgtaccattacctggtaatgcttacttaagttttttactacacaatgcctggcattcaataaaaaattatgagacataaacaaaacaatcaacagacttgacctaactgacatttgtaaaacactccacctaacaacaaaacacacattcttttcaactgcacatgaagaacacttacaatgatagaatatattctaggccataaaataaatccgaataaatttaaaattatctcattacaatggaattaaattaaaaataacaatgatctctggaaaatcctcaaatatttgaaaactatataacacacttataaataaactatagacccagtaagacatcaggaaagaaattataaagtactctgaatggaatgaaaatggaaacatatcaaaaactggaaacggccaggagtggaggctcacatctgtatcccagcactccaggaggccaaggaaagaggattgcttgaactgagttcaagaccaacatgggcaacacagtgacatccttgtcttcagaaaaaattgtaataaactctggccaggtgtggtggcttacacctgtaatcctagcactttgggaggctgaggcaagtggattgcctgagctcaggagttgacgaccagcctgggcaacatagtgaaaccctatctctacaaaaaatacaaaaattagccaggcatgatggcacgcgcctgtaatcccagcacttaatagactctggtgcgaggatctcttgagcctgagacgtcgacactgtggtgaccccgtgattgggccactgcactaaagcctaggcaacggagtgagacccagtctcaaaaaaataaaaataaaaataaaaaattagccaggcatggtggcacatgcctgcagtcccagctactcaggaggctgaggtgggaggatcacttgagcctgagaggtcaaggctgcaatgggccatgatcacgatactgtactgcctgagcagtagtgagaccttgtctcaaaaaacaaataaataaattataaacaattaaagggaagtttatagcatgcttacattagaaaagaaaaaaggtcacaaatcaatgacctcagcttctatcttaagaaaccagaaaaagaaaacaaattaaacccaaaagtaagctgaggaaaggaaataaagaccagggcggaaataagaaaaccacaggcagtcaattaaactaaaagttaactttttaagaacctcaataaaattaataaacttctagccagactaatcagggaaaaggggagcagagacaaattactagtattcggaatgatactaaatctctacaggttatacagatattagactcattacactttctacagatattaaaagaacaataatagagtattataagcaactttttgcaataaatgcaacaagttaaatgaaatgggtaagttccttcgaaaacttatcaggcatgtgaagagacggaacaatacaaccatatgaccaataaccaacagaaaaacaaacaagataaacagaccaatagatgatgccgatattggaaaagacaagcatttaaataactataattagtatgttcaagagaactggagtctattacaagtctataaaacaacatcaaaggaatactctagaactcaaaaccacaatgtaaaattaagaacacaaaagattattttgacaaaaagagaagatagttttggcatactggaaggcaggtcgatagaaaatatccaaacagagaaaaaaatttttttcaacatgtggaacatgataattaagtttaatatatgtgtaattaggatccaaaaagaaaaaaggggcagaatatatgaaaaggtggtaacagaactttccaaaactaaaaggcatccagctagattcaaaaaactctataaacataaagcaacaaagaaaaccacatctgaacacatcaaagtgctttaaaagtaacacagagagtcttaaaattagccaaggaaaaataaaagacacattatcctcagcaagaatatagctaatacattgccttcaataagactggtagctgacttcaacaaaaagaaaggaagacagaaagcaaccaaacattcttaatgtgttgaaagaaaataactaccaacttagaacttaatagccagtgaaaacacacttcaggccagccacagtggctcatgcctgtaatcctagcactttgggaggccaaggtgggcagatcacttgaggccatgagtttggagacctgcgtggccaacatggcaaaatcctatctctactaaaaatacaaaaaatttagctgggtatggtagcacatgcctgtaatcccagctactcaggaggctgtggcatgagaatcatttgaacccaggaggcagaagctgcagtgagctcagatcacgccactgcactccagcctaagcaacagaacgagactgtctcaaaaaaacaacaacaacaacaacaaaaaaaacaccaaaaaccacttcaaaaaaggtgaaactgccgtgcatggtggctcacacctatacccagcactttgggaggccaaggtggggggatctcttaagcccaggagttcaagaacagccggggcaacatgacaagaccccgcctatacaaaaaatttaaaaattagctgggcatggtggcatgtgcctgtggttccagctactgaggaggctgaggtgaaggattgcctgagcccaaaaggttgaggctacagtgagccatgttcacaccactacactccagcctgggtgccagagtgagaccttgtctcaaaaaaaaaaaaaaaaaaaaaaaaaaaaggtgaaattgagatattttcagagaaacaaaaatagaaaaaatcactgatactaggtaggccagtatcaaaatgcatgatatagggaagtgacagtattattatcctaaaaattgaaaacaacttcaatgtccaacagaagattgataagtaaattattacacagagatgagaatgttacatacctactaaaaataatcacatagcagaaaaatactgacatgaaaatatgttgatgattcactgttaactgaacagcttgcactgcagtggactacattaggagcccataacatcatataagtatacatatacttatgtaatggctcaacaaaatgcaggaagcagatagataatcaagaagattaacaacagcactttcggtggtatgatctccaatgatattaattttttttttttttttttgagactgagtcttgatctgtcgcacaggctggagtgcaatggcgtgatctctgctcactgcaacctctgcctcctgggttcaagcaattctcctgccttagcctcccaagtagctgggattacaggcacccgccaccatgcccggctaatttttgtacttttagtagagacagggtttcaccatgttggccaggctggtctcaaactcctgacctcaagtgatccacccacctcagcctccgaaagtgctgggattacaggtgtgagccactgtgccctgcctaaaatgtaatctatgctttcttactgtttcccacattagggatgtgctattttttaattgggggcaagagaggaggggagaggaggggaggggaggggaggggggaatggagaaaggcaactctttacattaaaccatattttaatacaaatgataagttcttagctaggcatatggtctaacctttattggtatatcccccatgtgtgctttttaatttttttttgataccaaaacctgccaacatgaatcaacctgtactttcattttccactatttggaccttgagagcttgctcgaaggttctagcaggggagcgcagctgctcgtatacccttgacccaagaccagtcctcctctatttgggatggttgtcctcttcaaccaagcacgcagcttcagcttcaggagggacgcacgtggagtggagagggaggaaggggacacctgccgagccagccagatgagctgaatcaaccctggggatcaatggggtaacatgtcacagccagatagccctcacattcaattttccactatttgggatgagaattaaaaatgttaagtacctgaatgtgacctctttgaaaaagaaacttaatcgtcgtcattattaatgtaaaaaatgaaaatgtttctgaaaaatgaaaagcaaattatatccgaaacagcatactttaaaagacaaagtaattcataaaatttcatttttcacaagtgatttctgtagacttctaagacttaaaattaacagaattacatctctgtgaaatatccaactaaagtaataactcagagttgaggctataagagtaagtttaaataattcaacatttgcataatcaaaaaaatggaaaaaaacaggaatctcggtatccacctgtttcacagaagttacacctaatagggcttttaataaatggttgtaaagcaacctgtaaatataaatgccattatgtaattatagtcaattagtaacaattatattgctctgacacttgagtgttctataaataattcatacaactccatctagaatttttgatccagaaaaggagaaaatgcaacagccattggtgtaatgcctacaaggaacttaaaaaatattttactttatgcatctgtaaaaaactataaggaaacagataaacatcaaaaggtttagctacagtgcagaactttgacttttcccccacaatattgttttattaaaatagtcacagtaaataaatgctttatttgacacagcactagaagtaaaaatgtgtggaagaggtgacataatatatatgcttcaagattgagataagaggaaacaattttcttttaatattaacactggctgacatatttgatggtagacaacagttaactgataggatttaatttcctaatttttctagcaatcctgaaatgattaaagaggctgtattataattatcaaataaaacatcaaatggttctttccagcgggaaagcttaaaaaaaactactgaaatagctatcagtctcacagatgcctgctaaaagaacataacaactccttacgttatcaagagctaagatctaagtttcctttcttaactaattaaaaggttaagatacgtattctccctcaaaatcccatgcctctccccccaccaaaaaaaaaaaaaacagccagaaataggctcatccttacaaatgttgtatgtaattttcttataaaatctatcattttccaccttgtgttataatgtctatgcttttcagttgggcatggtggctcatgcctgtaatcccagcactttgggaggccgaggtgggcggatcacctgaggtcagcagtttgagaccagcccggccaacatggagaaacaccgttgtctactaaaaatacaaaaattagccgggtgtggtggcagatacctgtaatcccagctactcttggagggctaaggcaggagaatcgcttgaaccaaggaggcggaggttgcagtgagctgagatcacgccactgcactccagcccgggtgacagagagagactctgtctcaaataataataataataataataataataataataatattattattattattattattaatgtctatgctgttttaaccatactagatttcaaaaccactgaaggcagggtcaattatactgcatctttctaggtatctcccatagtaaatagtcttgatcaatactctgaactttttgcaaactccatcagctaaaaagaattaaggtttggtaattctttgtaacctggtttaaaacaaaccctctggaactattagagaaccagagggatggatggaggagagggtagtgcatattagttgtttgttgtcagttaagcaaaagccaaaccaaagagcctcttctctccttttcccttcaaaagctaaattttatccaagtcagtatcagtgtcccttagttaaggacagtctgcttaggttcacttcagaggagctcaagaggctggtgtaatctacgaggctttcgtaggagtctgcaagcaagtacagaaggaaaaaaaatcaaagtttaacccatacactatcgatcaagtcaaaagccaaagaaaaccctaaaacttggactctaaagagtcctataaaattcatggaatccaagcaccttttgggtttgttttgtttaaaacagggtgtcactctgtcaccaaggctgaactcctgggttcaagtgatccctccacctcagcctcccaattagctgaaactacggtgtgcaccaccccatctggctaattttttttaaaaaaattttgtagcaaagaggtctcactatgttgcccaggctggtcctgaaatcctgggctcaagccattctcccacctcggccgctcgaagtttacagtgaattaaatctataccagataaaactcacatcagtatgacctcccttcaaactctgcaaatgcctccataacaattggcccctcactagtgaaaagatgagtatgacctatggtctatatcagatgttaagctttctgacaggctccaagtcatgtccctgtcctgtaggtaataacagagcccatactggaggcaaaatggcaaagcagatgatcattcaagatgattccgttttcaaggctgaaaagaacatatttgcaaatgcacagaaaaagatctacaagatcatacagtggtgttaacagtgttacccttcagtcaagggtatacgagtagctgtgctccctagattcctctggggaggaatgtgagctagaagtggatgtaaaggggttgtcacttattatatatacactgtattaactttttatgagcatcaatttacttctgtaattttaaaaataagagtcccagctactcgggaggctgaggcaggagaatctcttgaacctgggagccggaggttgcagtgagccaagatcgtgccactgcactccggcctggtgacagagcaagactccgtctccaaaaaaaaaaaaaattgaaatgtaattccatttttaaaaaagattgaacggacccacatggaattcaaatgaaaaataagtgacactttgcagaagtctattagaaaaacctacatatcaaacagaaataatataagtatcctatcctacaaaataaaaaggaatactggtaatattacaaaaatgcccacagcaactgcaatccattactcactattcactactttcattacacaatattagtcaccagggggagtttgagggtcccctcccaaaattatatctcatctaacagctgcctgtgcagtcttaacctcattaaacaggttttcaacaatccagtcctaaaaaaatgttcattttgtacactttcatgagaaacaaccagacacacacacacacacacacacacacacacacaccccaatttacctttcactggggttcatgtttgatttcctcaaaagaaagaaaagtttcccaacctgaaaagcaaactaacctagacaatcaagtttactagcactttaagggaatgttcacatcctcctcataattgtttgtcatgaaactttggggttaagtaaaattttacccatctatgactcctgaaaaaaagaggagggggaaacacaaactacactctgaaagcagcataatccagccataatgccaaatgtaaacagtcatatattttagcaaggcaagatataactaaacatctttaaaagataaatgcctgtgacctctgcaatcttaaaaattaaagtgtaaatagtcataaaaggtatcccaaacttcctttttagttgattttcctaaaaaatatgaaaagcaatcatattgaaaatgactcaaatcaccataaattaggcaacaaaaatcacacaaattatttgggggaggaggatttttgtttaatccagtttatgagtccataatacacacaaaaatttgaaaacatgaagacatacacataatacatctcatttcccaccattccctcagactatttctccctctcctctattgttagttttctaaatcctcccataatttctttatataaagagcaaacataaacttgtattattacacctcgcccttaagatgtaacacactattcacaaagtaccgctacaccttgcttttttcacttcatagcaaatttttgcaatctttgcatgttagtacgtagaaagcttccttattcttttttcataactgattacgcctagctttagaacattttcagtctgctttcttcaggctaactttttttttttttactttttttattattatactttaagttctagggtacatgtgcacaacgtgcaggtttgtcacatatgtataaatgtgccacgctggtgtgctgcacccattaactcgtcgtttacattaggtatttctcctaatgctacaggctaacctttcaagacattctgttcagccaaccacttatcacaggaattaatttccttcccccaagctttgaaaaccaatcagatttgaggtgtcccaagggataagtttcagagaaagcaattcattatctaaattacatccttttaagaatgtttattttcaaacaggtagaggggaatattgcacaattttctctaatcgcttaaagctacaaatcagaacgcaatcttcaaagtgaaattacctttgatttggggggatcagcgttatagtcaaatcaacgactgtaaaagtttacttcttgtgcttttcttccactgtaaaaatttttttattttttaaagaaggctaaaaagccttaaagtctaatagcacggcattctaatagcaggaaaccacaatctgatttgatctttcatctgccaggtcagagactaggcttttatcttgcagaattaggctcacctaccatcaacaagaggacctctacaaagctacaaacactttcaaagaatataaactctgcggcgctgcgtgtaggaaattacactccaggggccagagcgccagagccaactccagaaaacccagcttcactggcggaaagaaatctacaaacgccagcggcggtgacggggaacgggaagcgcgggtggacggaagaagagaaaccgagcgcctcgccgccaaccctcgaacccgcgcgcggtcgctggagtcagac

SEQ ID NO: 1594 - DNA, 162933 bp, Homo sapiens
attcacattttctcccaattttattttgaacaaacacaatggtaagatcacttcaatggtttgaaacaggtttgtggatacaatgaagcatctaatggaaaacctagagatggatggatactctaacatgtaaagtaaacatgtccattaataacaaatgtacaatgtcttctatatatttttttgcttgtatgttgaactgtcactcaaatgtacttaacttcattggacaaggtataaggcttgccaatttccaaagtctggcagtccaaaatccttagtagccattctggaactgctattgtttatagcatgatatgattgtgttattttaaatacagctttgttgtaatatgcctcctccatccctaaatacacattcacctttgatgccttaaaaatggacttctcagtaggaacaatggaaatttcaccactgtctattatggtgagaacctatttctgacaacatgagacgtagagaaagcactgaacttctgtgccaagcctgtgggaagggattgttggggtcacgggagagggaagcagaagcctctgtcttctaagactccaggttatttcagaatatacaagttacatttttgatttaatgaaaggttttaggtaacactgttagaaacaatttaaacctttacaaaaaataactcaaattgattcaaagatgcagaattcatcagattatcttatagagaccagtgtgacttaattctccctagattttatgaacaacttttattaacagaaatcaaacttattgtccaaagtgacaatatatcaaagaaatacataccaaaacctgctgccattatagttgttaacatttttattgcatatttacaatgtgtggaacattataaggatttacagtagaagccaaatttcccagcccttaaaattttaataggaaaaatcgaataaaccatacatatttttgaaaatgagcattagaaacacacagatgattataattctatagactaatacaggtgaatgctgtatgtaatagaacagctgggagaggtaaaagagtggataagagagtcatcagagtgtgaaaaaactacagctgggtggtattgaataaagagacaatattgaaaatatttttaaacgctaaaatgtcccgtaaaagcatagctatcccctatgcaaaactgtgaggtagaatttttcccaccccgttttctgctcttctggccaccatttgggggacttccctgtccaggtgactctctctcacatagctgtacctggggcttactagcaatacatgctttccactaccccctcaacctcatcacagaaataaccttttctgttcaatgatcagtcttactttacctactgaaaacgggtggtgaaagttagtaacataaacaaaccagtgctgtttcttctagctaacatatcaccatggttgggctttaacctttcaaggagtgaaatattgctaaagtttcaggcataggaaccccttgaggagctgtctggggcagacaggtctttgctttcctcagatagttccaattgtcatccttgaccatgaacaatgccattgttattccaaactcacttcttctaatacttcaatatggatcataaaaatagtttacacctttatgcacatcaaaatacaaaatacagggcacaataaaactgaactggaaaaaggtatggcagtttcttttaaaactaccctgtgacccagcaattctaatccaaggaatttactgcaaagaaatgaaaacctatgttcacaaagacttacgtaagaatggtcatagcagctttatttataatggccaatcctggaaacagcccaggtatctatcaataataggaaattaagaaaacaaactgtaatattgtcatacagtggaatactactcagcaataaaaaagaacagcaataaaaaaatgaagccttgtagaaaagcgtacatgttgcgtgactctatttatataaagttttagaacagaaaaatcttatggtagaaaaaggaacagtggttgcctttgagggtcaagtagggacaggaattgactggaaagggcagtgtggaaactttctagggtggtgataacgtttcctatttccatagcactatatgcatttgccaaacctcagtgaacacatatttctatgcacttcattgcatgctaattttatgtaaaaaagccaacaatgaactctagttaatgatatgcaatttaaaatgcatcaaataataatatgaaatgatgaatggatatgtgacaaagcaagcataggtaatgctaattagcatctaggtagtgagtacactataaaattattttaactttttaatgtatttgataattttcataacaagatgttgggtaaaaatacagggtgcaatgtttaccaaatagttttgctgagaatttcattactgattttatgacagtaagatcatcaaattcttctaagtgtccattgagaagtaagtttctcttaaaggcttctgagactattcgtaagtgtgatgtgagcaatcagttctcaaatctactctggtttataactgtcaaagtggtatttcgatcctttcacctttacaaaatacaatacatatattttgatgatatattctgagcaaatctgttggccataaagataacataagagttaagatgagaaaacattcctaagagaaaaatcaaacatacaaattttatttaccctaacttccagactaaaaaagaatctgtaactgtaatagaaaagaagtgaggcttggtcataaatagtgagtggtctactgtgttctgagtggaaaggcacccagtcatctctcatctctcccccaagacagaagcatttggacaccctaaagacatggtattcagcttgtgaagacttctaaggtgcctcctggagattcactgggaactggctggagttcaatagcccttttgtcagaaagttttctacatgcctaacttaaaatccctaataacactgctcctgataagtagcagttgataactactttcagttaagaattcctataaaattacatataggaattatacatacagcctcataaagttctccaaaaaaaatctttaaaaatgtgcccactgctttcaaaatatttcatcatagttctggctgtcttttgatctctaagttcttcatgttctagtacaggttctgctttttcttgaagtagagggactagtgtttattctcaagctttcatgtttgctttaaaattctgcagtaatgttgagtcatattaagtgtcatacccatgaacttttttcagtcttaaagactcccctgtatttatgccagctcacggagtgtccttagttctatgcctctattacagtatcagtcggccattttctgttcatcatcactgcctgagtttaccaagagactgctcctctctaagcatagccagcactaattgtggtcttttcatgctttgttctgttttttttttttttttaacctcattattgggatacttaaataacagatttatgctgttgttgtttctactggtcggtgctcgctcactaatatccaatcctagtatgattttcttttacttgtgtctattaacagggttatgtcacaccttgtcaacctcaaaacagatgatactcatcacttgtcttccatcttgctgttctattatcttcctacaaaaatagctaatttgtcagatttcaaagccttgttatttactgatgagcttaccaactggaccttttgtatcttcagtgtgtaattctgaagatgcattctgatacactagtgaactgggggtgacggtgaaggggtggtggaactaagggggtggggcggcgaacataggcaatatgccatttcctcaccatcccatgcttgtcatgtgagacaacagaaaggataaagaatactctattttttattctgaaaagataattatagcaatgataccttccattctgtttatttctggatattttggcttcaacaattctttatatcatattttattcttgaaattggtatgacttctctgttttacagcctgagataaattctcagatatttttttaacagtaaatggcaaagccagatttttgaagccaagtattcaagctccaaacactttccattatattcattacagttcttgttttagctggtatgttctttcctctacaagtactgccattatttatgcttcttagctaaacctagacttttcagtagcatgtatgaaagtcaaataatgtcaaatggtaagtttctacttcattttatctcatcagggtatttgttgctctatataccagcatagtatattttctactcccaactgaagcttttcatttttaggactgaacgttaacaataagtctactaattaggttaactgcttagctatgttccagccatgtttttaatgctagagaatttttcctttgggggcttaagcaaagatatcctaatcatacagatctcactactgatgataatatacttaatggtgcttgtttctgcctgtaccattccctataggctgaagatgtaaaggacattagcaaccacagtatgtttagtttttagtagcaacagtattttactacggccttgtgtactttgggtaggatgtgagaaggggagtagtacataataatgcccaatctctattagcaagtaacttacaatgtagtagagaattctgaactatttcttcaaatgtagaccatagattcagctaacttcataatcacatcattggtaacaatgggtttagatcagagtatggtttactcatcactgttagtaaggtaacttaattgtcatgctcacgctaaggagtacgacactaataataccactccgtatgtcagctaataagataacgaaataacaaacatgttaagactagctaacacatgggagcaatagccaatgtaaatttgtataaagtgagaagtattcaatcttctacctaacaatgaagcctagacctgccatcaatatcccagctggcaggctgagcagtttcatcaacatcaccaatgagtcaccagaactgaacaaagtgaccaacaatgaggactgggaacaaagccaatttgacctaaaatgaagtcatcatttttgcataactctgctgggttagacatgtgcgaagaacagatgccaaactgccattatatattaagcttacacaggagcaaacaaatgataaaagaaaaaaaaaatcctcaaacaaacaaaaaaacccaaaaaaaccaaaacaaaatgaaactaaccctgccagcgtttcaataattccctgagatgggctaaaggaatgtgggaggttgtgacatatataccaattacaaatgagtggttctttcagagacttgcaagctgatgttaatttatgacatagaaacagcttgtggtttcaaacacactgcagtcacttttttcacacgtttaccttaagtgagctttgaccctatggaagaaagttgctttagggcattactggattttcattcataactctatgtacagatacacatatgaaagcagcagcaaatttacagatgaggagcaatgatattcattatgttaaaatcatacttggcctcatgtgaaacactcaatttacaagtaacatttatgaatcctgccttattttactttttgtaggcaagatagcttaaggtatataaaaattaactcatttggcaattataactccatgagttgatggcagaattactaacaaaccagttcctttctagcaaagtcttaagaaaaacattctaactactctgaaattcagaagaaacagatattgagtattgatatttagttattgagtataactaaatatctaaagtagttagtatctaagaatctaagaatagattcacttgtaagtcagttctaactttaaaaaagtatgtttaaaacatacttcagactgcaatgtaacagggattattactaatgcctataatacagcattcatatttaggaggaatgggcatctgttatgcatgagcaagactgggaataggagaagacaagattccttccctcaaaagagcttactgggtacagacataaacaactgtagaatgtgatagcaccatcatgaagactgaaataaataatcacaaaagttcatactcatagcagtaaagccccaaaggactgagaagatgattcaagtatagaaagaacttcctggatgttctcagaagcagtgaccacataagacaagagggagcagttgaactttgccctgaacttcctggcatgtttgactaggaaaaaaggctgcaccattaacctaaattgttccaggaggaaaaggtgataaatattgtcaatctttaatcaaggttgaaatgtcaactaggcaattaaaaagaagtacaagtctagatttctggaccaggtatgtaatccagaacattggtataaaataaaaactctaaggatgagataccgagaaaagagccaaaagcattctgaggacaggatctgagagagcacatgttcagcaggcacatcttaaattagggttatgcgactgtactcacagttatttcagaggatagcatcttcaaggaaggagacactgtctaggaaaggttgctcaatggtgtaaatgttgcagagaaaagggtaagggattcagacggagaaaaaaaccattcagtttggtaactgggaggccattgctgactttcaaaagaacagtttcagtagagtgctgtgtaaaaccagactgcaaggtgctgagtagtgagtgatgaggatgtaggggcactggatgtggatttctccaagaagtctgtcagtcagtgaagaaggctggaaaaactagcaggttaaaagggaggggttttttttttgcattggaagatacacgagcatgtttgtagacctcaaaaaggaaccagtatacaactcgtttataattttgtaatgactacaagactaaaaaataatttttaatattttaaaaaatgttctgaaataaaaatacataaaatttaaattatatgcattttaccatttaaacttaatacaaacttaaaagaactagcatttcatgataaattttatttctaaaggggtcatacagttctgttattggactacttcagaatttattttgcttttagactataatgagaaactaaattttattaacaattgctattttagttcctgaaagattactctgatataaaggattacactgaagtaattatgtatgccttcttcctcagccctcctcccctaaagacaaagtatcttcagggtagttaataattttgagaatatttttcaagttgaaaaagagaaaaattagaaatagtattccattattaataagttcttaaagatctaaattgttcacaataatttttcatgataaaacatgcttatttattatatacacatgcttacatatgtatttcctgtctaaaatacatgcaaccaccatgaaaaaacaaatattaaaccatcctcacagtcctaagaatgcccttttaaataaggcactcatgtttggaaataggatgtaactactaaattaaataagatgtttaaagaagtcttttattaagcacaaacaacttttaatacattatcaatacaaataggaaaaggtcttttaatgactatgatatatcaaagatctgaaaggctttctctgtattgacacaataaaaataatcaattctgaagaattacaaagtaaaattttgaggacaccactgtctactaacaagagtttaactactgtctaaatttactaaatcacctgtggaggaagggcaacttttttttttctttttaatagagagaattcctactcttattagcaccattcaaagcttattatcagttgtttgtctacaaactgacaggtcaggtaaagctttaaagcaagttttcagtgcaatgtttatagttccttcttttaagatacttggaatctacagcctcgaagcatgttaagtaattatgccttggtagtagcaaggtgttaacatgtaaagagaaatgtgtcatgaaaagaaatgagacttattttggctgtgaaatgcatcttaaggtgtggtggctaatgctgtagtatgttgacaacatgcgggattatgaactgcaaatctgtaggtagctggtagctattagctctctgtggtcaccatttcaggatgtctcagctgctgccttttgagattaactagtttcatcctgtctctgatgttttctgcagtagaagccatgtcacttggactcccaaaatattgttcggttctaaaaatcaaaacacacagaaaaacctcagattaatacaaatctattaactgcagtgaatacaaatagaagcaaaaatttaccataaaaaatctacatgagatagcctatgtgtaaatatcagttcatcggtgatcatactgtttgagcaggaaattcagcaggaaaaacattttttaaaatggcataaaatacattaagacatgatgagaaaaatatattgatggtataaaggttatatcatgtgtagttatgataatagcaacaaattgaacaatgaaacactggaaatatgtgggtccagaaggatgcacaaacataaaatttatacaggtacttgagtgctaccggctggggacaccacttgtctatagagctggcaagcaaaataaatattctttttaatgttatgacattttttggtacattaacagataaaattattaattttattctactctcaaagatactgtattcagaatcacagaatatttttagagctggaagatttcttagaaattatcaggttaatctctttatttttcagatcagaaaagtggagcctagcaagttaaatgatgtaagcaaggtcacccagggaaaaaccagaatttgaacctaggtctttgagcagtgaatccagagagaccatcaatctcttttattttaccaggagaaggtataaaagagaaatctgtctaacctgtcaaacaaactatacatggcataaacagattaccattatattaataattatggaaaacactacacacaactttgggaaatatttaattcagcaaaatacctaaaagagatatacataagttttaatatgaatataaagtggaataaaacagcaattccaaaatattaaaggtgggtgtgaactttgaatatatagtactaacattcttttatcttaaaaggatggatgaggaaatgacacatggactatctgtgaaacacagacgagaagctgaagcaagcataccagggagaggtgttcctaggctgacatgggtagaacaggagactgactgtgtgacaactggctgtgaaatgtaggaatcagggagggtaagggatcctggaatggaacaaccagaagcacgcctgtaattctgctactagctgaattttgttgtcttttattgcagatgtgtaatacaactttaggtgactttaggctacctctgattgttcaagtttaggtggggcttgagataacgtaagtatagactatgaataatattatttcaagggaataaaatgccatcttttcaatatcaatcccaaataatcactggaagatcatggcacagtagtagcagtgcttattatgtgtcagatctgttttaagtactttatacttatttagctcaggtaattcccacacccccataacctgaggaaggtatgagtgttacatggcagtttttagatgagggaattgaggcacaaaggttaagtggcttgcccaaggtgttacagtgagtaagtggtagagctgagacctctggctccagagtgcacagactcatcacactataccacaacgttaaaggtacttgtatttttatttactggtttggttactctatcatttgaattaaatatcctctggattatctctaaattattttcagtaagaatcaggtctaaatcaccagggatgaagctcctcctgattcttttttttttttttttttgagacggagtcttgctctgtcacccaggctggagcgcagtggcgtgatctcggctcactgcaagctccgcctcccaggttcatgccattttcctgcctcagcctcccgagtagctgggactacaggcacccgccaccacgcccagctaattttttgtctttttagtagagatgggttttcaccgtgttagccaggatggtctccatctcctgaccttgtgatccgcccgctttggcctcccaaactgctgggattacaggcgtgagccaccacgcccggctgaagctcttcctgattcttttcctgatccatttattttgcatcagattatttcatatttttatcactatttgaaatggaaaggtgtaagataatcaggaccccattccttcacacataaagaaattagaacgccatataacacagtacaaagggaatgggtttggagccacacagacatacctgagattgtaagtttatgctaactcttagaagctgtgaaatcctgagagccttacttaatctctgtgggcctcagtttcttcatttgtaaatcaggaataatcatactggtttggtcctctttggtcaaaagtaatgaaggtgaaatgtttcacttggtacttggcatatattgtgaactcactaaacatcaatcccttgtcccctcttccttttcctgaatgaagccccaagtcacactattccccaccatcatagccaaggctagaacccagtgtcttaatctagtcaatgatcattctacaacaagctgtcaagaagtaacgcatctgttgttggcaagtaccattactgtggctaagaggtgtggatttcttttcattttaaactaattcatcgtaggagttaaagatgtggaccaaacctaatttacttggctttttaaagaatagatttcctcttttaatgatttcactttaagaccacaccaataaaaaataaaattataagaacatgccccatacccatcaggataaactactggaacagttaatctatccaaaagtgatttcccaactgcttcaatttcatcaaattgctcctcatcattaatagcttcaggctcttctggacagtcctgcaaaatctgcaacaaataaaagagcaacatcaatcaagagacacagacaggtctgcagtttcagaggatcaccccaccccacaaaaaaaaagagagaaaagaaagacacagaaatggaatcaagctcatacaaatttggtagattaaaggcattttcttgttcttagcatcttcaggtataccactatataagattgatctattattggcaaaattcttcaagaaattcaaacaaacaaaatgaaatacataattcctactaacaatatggtgatttccaagaaagaaaataactagactactatttggaaaataagttcaatctgtccttaagaagtattctttcatttatattaagtaaccatttattgaacagtttatgtttatgtagcagtctggaaggtgaaggaggtatagactgtgttctcaaagagcatatagacattacaaatgaaaaattatataaataaaaaacaacaaagagtacaaataaataactgatgtgacaactcagctagatgataatatttaacaactgatctgctggcttgagttaactgccataaaatgattaggttataattcaaatatggtaatctctatagtccttgatgagatactgttcttcactccaccctaaccattaccatttaaattaaaccacaagaactgcaaaatttgagagagagaataaaaagtattcatttttacaacttttttttgcattacactttatctaatcatgtttacttcagcattactcatgaacggacatttttgtattttaaaactcaagatttaatttagatatttttctaatcattatactatacaatttgcttatagttgtggttatttatatttatgcttatggtataaaatagaatacagtcaagaggaaagtaatatctgataacaaagggctttacttaggtttgtacaacaagctccaggaggtggagcctgcagtgagctgagatcatgccactgcactccagcctgggcaacagagtgagactctgtctcaaaaaaaaaaaaaaaagttatcagtggtgctagacattgggccaattgtcaccctttgacagtgaggtgattgggggagcagtactgtgattacacagggtggggggagcttctgggtgctggtaatgttctgttttttttgaacagtacactgagtacacaggtgtgttcactttatgaaatctcactgcacagaatacttgtggtatgttttctatgttaatagtatacttcataataataaaaaattctcattgaaacaatcagtagataaacaagttacactattttgtatacttccacttatcatcattaggcccatgttaatcaaacactgatctacggagttcaatgaccagctgagaatgagttaactatggacccttcccaacagatgtacttcataactcagatagaaactttaattcctgaggttccttgcaacatctgttccatggatcaagttaggtttgctaatatctcaaagtgtatcgaacattccctacatataaacttttattgtaagagatcaaaacaaaattaactacataataaagttccttttcagaatggatatgtaaggcttgggtagaataaattcttactatgaagagtaagaaaaaagttctattgaaaatgtgtccaaataaccctgcatattttattttttgtttctgaaattaatgaccttaattcattgaataataaattctagaatgaatctttaaagaacacatataaaaaagcattttacttttgtccttattcttatttttttaatgtcccgactttataaaatcacaaggtgccttttaaaaaatgtgtgacaattaatagcagttgccaaagcaaaaagtttcccttccaggcataacgaaagagattgaactcatgatactctaaagaacagagggcatattctggacaccaggcttggtgaggagagaagtgtaaagagaagaagactaccaggtggttctggatttctccaatcatggctctccagcactggtaaggattaaggaaatttaatttgaactctctaaggcaatgtattatatctaaacaaaccgtaacaacggaactaatataaatattgaaaaatagattagtcatatagttacattactaaaattaacatattttaaacacatataatcaataccactgagaataacatttcaaaaacacaagcaaaccttttcagcatttgagtgaaatgcaatagccatttccaatctatgtactctctcttcagatgctattgtaaattgtttccatactctgttcagtcgaggaagtgtatccccagatgaccgagaagtgcagcgcaaagattggcataacacaactgtggcctgtagcaactgcctgccatagtcataagtgctctaaaaaagaaaaggaaacataaaattgtaataaaagaattcttaagagaaggatggggaaagtgtgcaggaagattgtcgttacagttaagtgacactactagaaatcaatactgaataaatctagtggcacttattactacaaatcatctgtgtgtataagtaataaaggggaagctatgtttttgttagtttataataagtttcatggccaggcacagtgattcatgcctgtaatcccagcactttgggaggctgaggtgggtggattgcttgaagttaggagttcaagaccagcctggccaacatagcaagatcctatctctaaaaaaatgaaaaaaattagttgagtttggccacacttgcctgtagtcctagctaccttggaggctgaggcaggaggatcacttcagcccaggagtttgaggatgcagtgcgctatgattgtgctgaaacatcatatcctaattgacagagcaaggccttgtctcaaaaaaacaaaaattgttttaaaatttttaattagaaaaaagtctccttctgttaggcttccccactttattctgtttcccccatcgcagtctgcttaaatttcactggccagaaagaatgtctgcttatgaattaatcaaaactactttcaaaagtaggtgaaattaggcactttatattccatataggaaactacatctgttaaaacgtgaactcattattagggaaaataagatactttttggcttggcgcggtggctcactcctgtaatcccagcactttgggaggccgaggcgggtggatcgcttgaggtcaggagtttaagaccagcctggccaacatggtgaaaccccatctctactaaaaagacaaaaactagccaggcgtggtggccggtgcctgtaatcccagctacgcaggtggctgaggcatgagaatcgcctgaacctgggaggcagaggttgcagtgagctgagattgcatcattgcagtccagcctgggcaacagaggaagactgtgtcttaaaaaaaaaaaaaaagacacttttcaccacaaaaaagttctgtattattatgctaacactagtgtgatgcagaaagtgaggtttcttatttactgatattaacatccatttcatattaacttctgtggatgaacagttggattgccttaaaaatgccgtaatacatagcataaatcagagggaccatgcagaacatgtattcagggaaacgtaaaccctctcaagtttatgcaggctagttttgatgcaccagctgacattttcttaattctgtgacacttctggaataacaaaactaaccttcttgtacttggaaggtaaagttacattataatcatgcagaaagctattcaaacactgagcttgtggaaaaggaagataaccagttttgcacctgtgcaacatcaacaaattttctatgcttttccagcaaaactttcgtttcttgagcatcatcgcccaatctgatgtgagtcttaagcagagcatccagaagttcacttagccattctactgcctaaacaaaaagacataacaatgaagctggattcagaactctttacttattgtatcaaaatgtcatttatacagagattactatcatgtgattaataaatccgttaattataacctaaagtcttaaaagcttatttcattcaatgataagctacatgaattaatgacctgtcctactcctcaaaattctttaaatctgaaggcaagacatactgaagaaaagcattcttttaaaattaatatcacataataaaagatcatgtatttctgtatgtagatccatcaggattgcattacagatttgtgttactacataaaatcaaaaattttatctatatctaactgaaatgatgttctctgatgataacgacaaaatatatcaaattgtttatctggtattgaaatttctcttgcagatgcaagagagcaaaatgcagtgtgctccaccagattttatcctggatgtaactgacaacctaatcaacaataataaataataaacgatcccaatctctagctcaatagaggattatagaggatttcattgagaaaattaagttaaatgagatcaatcaactagctgggaataccaaagtgtattcttcaacaagatagataaactagaacctgacttcaagaatttacttttttaggaccatgaaaagtacacttttgtttgtagttagataaaatcaatcttctaagaaaagttaactacataatgtagctgactgctccttacctgggcagcatcttcttcacatttaaacaactgcaccatctgaagcatctttaaccttcgcacatctaccatgtcttcacatctaatgaacccaaacataaatttaactcatcatttctgttttattgattactattgtaacatcatcatttggtacatgtattttatagtacactaaaatacttagtcctaaacaatggagaatgcaagtattttgtattgatttgtaagaattttagggatatttatatcaatgttacatcaaaacatcaaaatacccaaatgatactcaatgacaaaccctcttaaagatagcatggattctgcaaaatattaaagcaaaatgtaaggacaatagtacactaaaacccaaaaaaaatctccattgctgtttagcatcaaacaagtttcaaggataaaagtgtaatgtttctcaaatacaggatgatatttttttgagacaaggtctcactcaagcacctaggctggagtgcagtggtaccatcatagctcactataacctcaaactcctgggcttaaatgatcttcacatcccagcctcccaagtagctaagactacaggtgtgcatcactatgcccagctaaagaaacatttaaacattaacgcttttcattatattatagtacctaaaataatatttaattctgattttttttaaaaccctccatctacattcttaaaaactagatggagggcttaaaaaaacaaaaaaactctactgacctctgggtgtagagaaacacaattcaaattatttttttaatctcattgtggtctttttggataatataaccatttaaatttttaaggcaacttaacctaacttaactctggtccatttccttcatttccatgaaattctgcgtactgcaggtgggatgggggactcccactgcagtctcaaataccgataatatgttaccagacactgtgctctactatacttgatgtccttaaagaaagcttaataacaatatagaagtaggtatcacaaggcttttttttaaaaaaaaataaagatgctctgaataaaagctataacatgacattaaaattcaacttggttaaagtaattctacaatggactgaagggaagtgataattattttttaaatatgaaactaaaaaacaatgtaggccactttgatgaagatggtatcatacatatactgtattcaggtattagataatgtgtgctggggaaaatataagatatggtctctactatcaagatgctcccatttgcagagatgttataagtactattataaagctatttaaaatgttttatgagagtagggaggagcaagtgactaacttgccttagaagtccaaaaaggcttcctaaagtaaagtaagtatccctgagtcttgaagagtaagtaggaattcactgagcagaaaacaaggaaacaagtattcttagtcatggatgcatgaaacagcatgatgctttcagggagataaaaacaactgtgtgattttatgggaatgttatagaagataaaattatgcaagaattggattatgaagggtctcctacattattccaagaagacaaactccatctgagcaaacaggaagtcactgaaggaagttttacacaattgttgtactttatgaaaattacacttatatacaaaaagctggagagtagccaggccagaggcagataagagtttaagatcttgaccataaatgtttgagattcagagacagcagaacctggacatttgattaagctataagggatgagaaagatgaaggattttaggataaatctcaagtttggtagctgatggtaactttaacctaggcaggaaattaaaaaaggagagcaagttttagaggaaaatgattccagtctggacatactaggtgatctggtttggatctgggttttggatttgtgtccccacttaaatctaacatcaaagtgtaatcccaatattggaggaggagcctggtgggatgtgattagatgcctccccttccaccacgattctgtttcctgaggcctctccagccctgcaaagctgtgagtcaattaaacttctttcctttataaattatcctgtcttaggtatagcagcgtgagaatggactaataaatacaaggggcctggtgggagatgactggatcatgggggcacatatcccccttgctgttttcatgtcagtaagtgagttctcatgagatctggttgtttaaaagtgtgccgcacctcccccttcactcttttcctctttctccatccaagtaagatgtgtctgtttccccttcaccttccatcatgagtggaagtttcctgaggtttccccagccatacttcctgtacagcctgtgggactgtgagcccattaagcctcttttctttaaaaattacccagtctcggccgggtgcggtggctcacgcctgtgatcccagcaccttgggaagccaaagtgggcggatcacgaggtcaggagtttgaaaccagcctggctgacatggtgaaacaccgtctctactaaaaatacaaaaattagccgggtgcagtggcacccgcctatagtcccagctactcggaaggctgaggcagaagaatcgcttgaacccaggaggtggatgttgcagtgagccttgatcataccactgcactccagcctagtgacagagcgagactctgtttcaaaaaaaaaagaaaagaaaagaaaaattacccagtctcaggtagttttttatagcaatgcaagaatggactaatacactagatttcagcagtacatggggcatcccgcaggcgacactaagtaggcaattggaattatgggtctacagcacgggagagctgtaactactaaaccatgatctattaaagaaagtaattcaagtagtgagaatgtccagggagaatatataaagaagggaatctggcctcagaacaaaccctggaagcagtaactttagctagtggccaagaaatcagtgacaaaaaccaagaagaaacagagaaggatcataaatgtgttttcaagaaagatgaaatcgaaaagtcagttgtgcctaacgctaatcacagttaagcaagtcaagactaaaagtattctctgaactttaagtaagatacagcatttattacgttggtaatgctggtaagagcaacactgaatgaaatagttagggtagaagtcagactgaaaagagttgaaaataaattggaggtagtgggggaagtagtatgaatgtaccgtaaacctatccaaatgacttagctgtgaggaagagttctaatgctaaaagacaaagagttgaagaggaagacgtacccatatgtgtgattattatttttaaaacaggagaaatttaagcatttaagtgagggcaggaaccagagtagagaatgggatttgatggagttaggagtcaggagggtgatcagaatcagagcctaaatggaagctcagctttgatattttttgatataaacggagagctctatcatcctctgtggtgacagaataaaagtaagtttgcagatatgagggaagaaatttctgcctcatgactgttttctctgtgatgcagaaggaagctttctgtgaagttttgttgatgatcataaaatttttaagtgtgcaaaatttcatataaccatgctagattgtgtatattgcataattttaatcctttactttgcaatactttgtagttgctattgcaaactgagttttcaaagaatcttttgaattcctagttttatagaaaatgaaactaaacatcactagtccactgtttaatcctcctacagcaaatatgagaacaatgaatgtgtgacattctgtaagtttagatgaagaaacagatcaatgtagatgacaagtttaatggcaactctaaactaaatgaaatttaaaaagcaaaattattcttcagtaagttttttttaaagcagaagagtcatagactacactggggatatggaatttgaaatagttgagtataattgaaatttttacaacccaataaaaaggaaaatggtacctaataattgaataaattattactatgttagtaaaattatatacagtaattatcacattcaccaaaaacctactacatgtcttctatataacagttaagaacgttttgtctgtatataaaatgttatataacttcattttaactaatattgttattattttagtaaaaagtaattaacggtcaaactttgcctttgttttctaagctgcatatcttccatcactccttgtatgtggtccacattttctttattttcaatggttacatcctttccataggcccaggatgcctgattggagatctgatccaggagaccttgacctttttcacgcaaaccttgcaatcccacatctaaaacaaaagttactagatttaatctcttacacaactaaggcgctttccctccctcaaacaaatcgtctcatcagatattgtacctggatcccaagtataggagctttgtacagtaaaccaccttgggatggaatcccaagactccatcctatgaacatttcaagcaataaaaccctttaaatgtaactcgaattggagctctctctcatgccaaattctccctaaagggaattttgaaaacatgggtttccatagacaataattacttttaaaaaatgaaagcagaagaaaaatatgaaaattcctatttctaatagaaaacaattttctgttttttcttcctgcttttatgctgtccaacttataggagaacaaggcaaacatgttgtttaaaaaagcgcataagccttgcaaaattttaagacactccagcaatgtatcatcaatgtcaaaggatgttgaacattgtgactaaagatacagtctagcttctataccataggaagcaacaattagggtatatttacaattctccaaattacatgtgtaaaggaactttttttttttaaacaaagactgtggctcaagaaaactaatattttaaaagaaaattcatttgtcatattaaacactaaatatgtattatgcataccatctgttaaaataacagaggctggccaggtgcgctggctcatgcctgtaatcccagcactttgggaggctgaggtgggcagatcaccagaggtcaggagctcgagaccagcctggccaacatggcaaaaccccatgtctactataactaccaatacaaaaattagccgggcgtggtggcaggtgcctgtaatcccagctacttaggaagctgaggcaggagaatcacttgaatcggggaggcagaggttgcagtgagccaagatggcaccactgcactccagcctgggcaacacagcaagactccatctcaaaaaaataaaataacaaaggctgtaagcaagtaaaatgtcagtacaagtgtgatttttcaaaccaattccctaaggcagttttcaataatttggtttagtcatgtgcaaccactttttactagttctctgccttaagttcctgtttcctctcttccattgccatttccccttttgtccccccttgatacgactccccaccttcccattgtcacatcctgaccttttaggaaagttcactgtgcttcctgctgtagaaaaattctaaaggccttgatgtcaaatgacatcaagcctacatcagcttaatgtaactggaccccttaatgtaaatgtaccccactccttggagaatgggtaatctgacaatattcccagtttggtgagacaagaaccaaaaaaccaaaccaactattttttcacaaggttaggataaagcaacaacaaaaatcattgcataaaacacaattttgggcatacaggatttaccacagaacatttcacagctaattacagttcatgcatgcactacaaataattgttcatagtatatgcaagacacagcacctgtagatatagctgggtaaacaggcaagggtaaaggcccagtgaagggaggagtgactaactaacgatgaaaaataaaattttcagcataaattataacccctcaagggaataaaatctttttatactatttttctgtttcctgaaaataatactaattagttcagtgtaagttgacttaattgtctaaccatggtaatgatatttaaaaaaaaaaaaaccttatgtttcagcatttttaaaatctgcttaccaacacttttcagcttctcttcaagcagttttaaagtttgctgaatcgatgctccatcagctggtgctacatctacgcacaacatccctaataagccatccaactgctgagacaactaaagcagagggacaccaaagagataaccctgatgtaatcagcatctaaagtgtttaatgattaatgaggtttatatctaatgaggttatcacaattacacttgaaaagactacactgttacaagacaaggacgaatcattagaatatgcattatctggaagacagaacacacagatgcatgcaccaggaagacaaagaagtacattcaggtcagcagaatgcaaaaaagtattgagacttccatttccatctaagttataaagcataaacattgagaaggagtcaaaataaaatattctactagattggaacactctagttagacaataaaaggttgaattgcatgcagaatgacttaaaaaatacttgtttttaaaaaaaatcaaagaattttatctcattacccccaccagtaattcattttattggttcagaaaaataatttaggaggcatgcaaacctgaaaaaaattacgtgtaggtaagtgttcagataatttgaagaaaagaaaagaatcagaatagacacttacatcttgggcaacaccatgaaattcaagagctgcttgtaagagattttgcctaaattccagctgactggcctgtcgataacaaacatcactaagttgttgctgcagtgactttagttccacaagatcttcctcatcgccagcattcaagagtgctgcaatttgctgattaagttccacatacactgcaaaccattcctgtaatcaagatgttacaaagtaaactaaggctcaaattagttcctggaagagattacattttataatttctccagataaactaagtaatacatgattttttttttctaaggcaaaattattaaaattgagggtggaaagttcctaatcctgtgatccctggaactcaatccctgacctctaaatgttctcttctcttccttgctctaagtgaaacctgtccgccctcagtcacccctgcagccttctcaactgattactgtttccatgtctgacatactgcaagcctgaaggtgggtttgggtgcctcgttcctcactacttgcagaccatttattttccctcttctttcaaaaaaccgtatcccctttgaagtgcatgctgttagattacatcttttcagctttctgtgtggtatcacctcatccacagaagggtttagcaaaggtcacactgccttcctctcagcatcagccttcttagtgacttccactacataggcacccaccaccatcctgaacctccagttccttgactccctccctcacctccaactaacttgtcctcacctcaactcagctacctcttccactggccataaaaacgtgtcatcatatactactatgtagctccaaaaatctgtttcatgaaacccattttctgaccacctattgactctcccattcacctctgtttgtaggctcacacctacaatcccatggaatccaccaatctactgacctctctaccatccagcacatgagaacctctgtcctcacttccatccttgatcaaaggctataaccacctcccagcatataacccatgcccctgcctggctttctttccttccatcagaatgacctgttgaaacctgagatctgttttctctgcctaatgtgtgcctgtaccagagtagccgaacatgggtagactaaaaacaactaggtggatagcgctctctctcttttccctcacatcagaagggtaacgtgctgatgttgttacaaggcttagagggagacacatctcagatgagtgtgagcacccatcatcatgcttataaactacaaaaggattgacagatctctttttaaagttatgactaaataatctcaaatgagtctttggcaatccttttatgtttctctagtaaattcactttctcattctcatgatcatttatgtttttttcactatcagtctccaattcccttttcacttcttcattctcagccaaagatcttaattcactgggaagtaatcggaaaactctttcatcttcccaccaacaaatccccaaccctccgttcttctacagccctatgctctgccctcagagctgtaataatcagccgcctgtctcttcttctaaggccaaccactccacttgtgcattacagcctatctctgttgcctacacaaagctttgctctcacagttatcttctctgtctcccatcagttcttctgtctcaactggattatttccaccagcatataaataagctgtaatttattaaacaataaaatacacatttaagatttgtgcattttactacgctgaaattaaacctcagttaaaaaaaatttttttcttaaaggagttctctgtatttactcttttctcatttttcattctttttttaatccattccaatcaggattttgttttcccacccttctgaaaccaattgtcaaattcaccaaaaaattccatcttgccacaaatccaatggtcaattctcagtctttattttattgaacctctcaacaaacagctgcatttggcacaagtaagcacttcctcctccttcaaatggccttttctcttgttttctgagacacaacagctccttttagccttctttgctggctctcctccctctttttgcacttaaagtttaggttgacccaaggctcagttttccagaggctctcttttcttctcactgggtttggatgacttcacctagtcccatgcctttaaatagatctataggctaagaattaccaaattaatataggctttaaatatatctataggctaagaactaccaagttaatataggctctaaatacatctataggctaagaattaccaaattaatcatcaacactgacccctcccatgaaccccagatactgatacccaactgcccactagccaccttcatctggatgactactagatatctaaaatctaacctgccaccaaagacactgattcactatcctcccaacctgttcctctcgcagtcctccctgccttagtagctgctaaggccaaaagcctgattctttcatcagcaagtcttgctggctcaacctcatcaacttctatcaattctcattacttctaatgcctccatctatcagccccccgccttccattttcattgctagtctctgttccctattttccacacaatagccggtgatttgcttaaaacataaattaattatctgtccaaaagtttcaaataacttcacataacatttaaaataaatttcaagtttcttttcatgggctaaaagacattacatgttttggctcctgacttcctctaaaactttattttctgtgactctcctttgctccctgtactctagccacaccaacattcttgctgttcctcaatcatcttcctgtgctggggtgtttctactgctgtgtcctctatctgaattgccctttgtttggattacttctcgacatcatttcaaggtttctgattaaatgtcatctcctcagagaggcctttcctaaaatctatacctatattgctttccgctccccaacttgaatgtaaattccatatagtaagacagtattatatggcaaaagcctagaacaacacatgacacatagtatgtgctcaattaacattcattgattgaaggtataaaacattaatcactgtagatttactgacattacattaagtaggtaacagagggtgattttgtcactcagggaacatgtggcagtgtctggaaacattttgggttatcacaactgaggaatggggatgccactgcatgcagtaagtagaagccagtgatgctgcaaaataccctaccatgtgcaggacagcccttacgacagacatttatctggcccaaagtctcaagagtctgctgaggatgagaaatcctcctatatccaatggtgatgataatatctgtcttaccttgtttatcagttattgtttggatttaactcaataacaagcatagaatatttttaaactacatagtttataatggttaacagagactattttaaagtagaaaatattacctcagaaaattatcactgtcatgctctaaaatataaaaggatttcaataccttattcatagtacttacatatcattaaatgctctaaataaataggcttaactctttgaagacgtaatagcaacgattctgagaaaagcagtgaaggattagagtcctagaatagcacttttcagagctaccagcattagaccacttggggtgtttattaaaaatgtctaagcttcactcctgacttactaaatcagtatctggagttggccctggaatatatatttcaacaagcatctctgatgactcttatgcctgttaaggtttaggaatcaccactgtggagctaattatttcctggtttgaatttgtaaaatataggctccagcaacctgaccagggatgtaaatacattgtgaggactagtatgtctcaagaaattaacacctgaaattagagacattgatattaccgattgaggttgccataaagaaatagtctctctgggatgtggagagcaaaaaaatctggctaatacatttgcatgtatttaaaaaaagtcatccaaatgtttcttcctaaaaaacgggtatgtacggccgggcacagtggctcatgcctgtaatcccagcactttgggaggtcaagatgggcagatcacgaggtcaggagatggagactatcctggccaacagggtgaagccccgtctctactaaaaatacaaaaattagctgggtgtggtggcgcatgcctgtaatcccagctactctggaggctgaggcaggagaatcgcttgaacctgggaggcagaggttgcagtgagctgagatagcaccactgcactccaggctggcgagagagctagacactgtctcaaaaaaaaaaaaaagaaaagaaaaaaaaaaaaacccagtagaatgtagactgcctagaaccttaggtgtattttgttcacttacagccattctccggtctgtctcttatgtatatttaactgtgtagaaaatgattattttatagcaaaataaaaaaacaccaatatatgggatttggattgagatggtaagaaaagggcttgaaggttcacatttaggacacaagcagtcaggattgacaatgcaatcatgttggcagtgacgcatacttggtgaaatgatggatatttatactttataccatgaaatgtgaatccatatgtaggcagaaggaaacagtgccaactcgggttaaaaaggtgattatactcagactacacattaggagaaatgagtcttgattcgccaggtagacctgttctgcataatgcaccagagaaagtggtttctttgtagaccagaactcagcactatgagatggtgggatagtgacaaaattctgaagtagtttcagatatttatgctcctcgatgttcctatcacacacgcttttcctaccacacactttcttcaacccaaaacataaaattagatttttgaactaaactgcttttaaatttattgtcagttactataaccattttcatgtaccttattttttttgttgtgttctattaaaaaaccaagttaacttctaattaccaatccttgaactagaactacaggttggcagaaatttcatttttctatgtattaaaacttaatatcctaacaaatttggggtttttagctttatttctgcattatgcttttatatggactctaaaatttaatatatgacataaaatttaatatatgacattgagctggtaatgcaagattgtatgttaaaagttttctcaaattctaccgttaacagctgtcaatgccagaaattagtcatactttcacaagacttgaacaattccaataatgctttaatctgttaactcttagttacagagagaaaagaaagcttttaataaaatattagaatatcttaaacatcataagctaaaatattcatccagcatcaaccaacctattctcagggtgacaatgcagtgccacctattggctaaaacagcacaactggctttttaaaaatatgtcaaaagtgggaagaatagtgtaatgaactccttcctatccagcttcaataatgatcaattcatgggtaattctgtttcacatacactcccatccattcaatctgttcctacctcccaattctgaaacaaaacccaaatatcacacatgatttaaggaaataaaatctcttgatagccatcaatgtttctttaggtcatgtctataaatgcagatgtcaatgtatatgtacattcctaagtattaaaagtacaagaatgaaaaactactgtagcttaaccatatctgtaaaatttagtagctttctctaagagacagctagagaaaggatcccccctgggtatcaagagatctgtgtcttaacaatagtccaactattcactgatcaaaaaacgtagcttcccagttttttcatctataaagtaagatgaagatattagaataatctataaggtattttgcaattcaaaagttttatatattggttccacattataagtaagcttaagcacatgggaagggccacccttaagcgatgtttctttaagctgattttgaaaaccttataaatatattaaaaatacaaaaccaacatctgaacatagcaatttctatgtacatcatctgcaatttcatccatactatacgcaatatgaaatttgcttttgaagtctttttgtaaacttagagtacagtacagtatgtatacaatccaatttctaactgtaattatttatcttggcatttaaaaaaaataataaaatatagataaatcctgtctttagaatcctcatgtgccatgtgtccttcctaaaaagaacttttggaatactttcataactaaatccccttaggtgaagtctagaatgttctagagtaaatacagttttttaggaactaaagagaggaacaaattgtagactctaactatagtaacatgttctagaacagtctaccaggttcaaacaaatcacaatccatgttaaaaaaaaaatcaaaacattattttaaaagtaccaagagaattaaaagattatatcctcaggaacagggtttgtaatatgattattttagtataaaaggaagaaccattatgttggaacctgtgaaatgcataaaataaatcgattttcaattatgagatttcattttcaagttttttacaagtactaattagaaaaattgcaaggaatatatatgtagtgcctttagacaattccaaatcttgtaatatctcttattattccttcagctagattacaactgctttagggtatagtagtagattttctgccaataccagtaattgctatacctgatttacagaacattacaaagaaagcaatatgaggaaactaagcaaaatggaatacatttagaagaaaaataagaatcagatattgttaaattctagtaaagatgagatttactcattcattcaaatttattcccaagcaaaccatattacttattctttaatcttgtttagttaaaaatggacatttcctaatactatccaacataattagaggaaagaagaaacgttgcagaaattaatgttccgacggtacttaatgctcatctgggtccagagtttaacattttgaccaccttttttaagacaacctaaggagaagggaattaatggattcaaattttatttttccaattttgtatttaatctattttaaattaccaaagtaatatgaccttagggagaggggggtgagctaccccgtccacaaactggatgatctctttctcagtaatgaagaattaactgtaacagagcaggagattaacgaacaccagcttctttcacataacaagttgttaaattttaaattatctttaacaattattatctataatctgcttaagaatctatttatttcccaattttatacctgtgatttgtctgattacccctttcacaaatacaaaagggacccctaaatgctcagagaatggaaaaatattctgcaccctctggacttactctccatcagttgtgtttaatgcagcaattctgctatcactctcaggcatttaattgtactatatactcccaataaagtgggggtgagggggacttgaaaacagaagtttctgtcacagagactacagatgaaagctctatttttgtattatcactcttttttctgtcactgtagcttttaaaatttcatgcaaattgtgcttctataaaaatataattaaactgcattagagacaaaaccaaaaacaaccttctaattaacatgtactaagtaatcaaaatgtactttatgacctctaggcacttaacaaactgtacttcatgccccataccaaagtttgcagcaacttatcactcagtaccacatatgctactaattacccacgttcataatatcattgtaacttgcagaggaaaaagcctctcacactgtgctggctctcaatctcttcgtgtttctgctgtagggcctgggaggccctaatggagtctccaatgccccactgggctcttagttgttctgatccaggcccttctagccagttcaccacctataaacaaaagttgagataacattttttaaagaatcagaaacttttcaaactttcattctaacttatttttcccctcccaaagttccccaattatttttaatgtaaattatttacattctatcacataggcagtaaatgtttcttttggaactacacagctataatgtgacaacattttcaaaacttaaatgtggaagaatgtacactgtagcatcacaagctttcagctatctgattatctttcaggctaaaagaaatctggaatgcttctataaaagaggattaaaaattaacttacgaaaagagaatcagagaatcataagatttagagttggaagaaacatcagaaatgatatcagtcaaagttcttaactaacatttaagaaaactgagtttcaaacagattaagtgacttgcccaagataacataatccattattgaaaaactggactaacagccatatgttctaactcatagtctaatgttcttcccaagcattgaaaaaactgactgaattaactactataaagttaatataccactttatcacttcaaaaataaaattaaaaactaattagaattatgctaatgtaataaataccctcttggactcttcttaggatcaaccaacattcagacccacaaaaggccccactggcaccagtctgctagtaaggatatagggtgggaactatagtttgccaggatgacagcatcaggagttcttcagctgagtccctcaagcaggtataaggagatgagatcagtatggggcagatatgggagacactctggcatcaaaacatgataccccacaggactatgcccattatgagtcactaaactcaaggatccccaccccaagttatgccttccatcatatattaataattctcccagtccagatctggaataatgtttactataagcaatattgcctagtaacgtagttgacattccaatttttaatcaggtcttcaggggaacagagctaaagggttaagcaaagatcaagttctcatgcagaaggagaggattgtgctgacactctacccacaatcatatacactctgaaactacaaacacattgtggagtaattttagtggaaaaaatggtattaccaagctttaccttttgccaaattagaaaaaggaatttaagaatagatgtatggttatatcctaaatctaaactcaggatagctcccaagaagtgaatggggatatctctgcagcataatattatagacccagtgggtaggcttaacgtagaaaagagcagtgcagatatacatttctgcttttaccaggttaaaaaaatatatttctaaatctaacagtttatggatctttttataattatataaaaataccacatcataaagaaaaatcacataagcgctcagccctgtttggatatccacagattttcatgcctgaattcaaccaatcacagattgaatatatttgggaaaaaaaatcaagcacaaaaaaataacaatacaacaatttaaagatacaaataataagccagtacactataacagctattttcatagcatctgcattgtagtagatattataagtaatctagagatgatttaatgtatatgagagtatccataggttatatgcaaatattatgccattttatatgagacttgaacatctttgatcttggtatccacagtctgcagggcgtccttgaaccaatccaccacaaataccaagggacaaccatattctatttccttccattaatttttcacctgcgtaagggttttcatatgctactccagatttcagtgttatagccaattctcatagataacaagtagttttcatcccgtttttcacttagcattaaactataatactttaatgatttttccacttggctattgttattataacataattttcaatgactttgcaaatccttttttcagaaggccaatcctgttgcctgcctgcctccatctcttctatctgtccaaccaagcaaccaatcaacccactcttattaagagctaagtaacgtactgcctcaaataactattgtacctgctatcaatacttcaattctctattgtcgggaacataggatgtttccaatttccatcaattctaagtaattctatgactaacacatatatagcagttatatataatgtttttttttctctgttttattttcccagaaaaggtttccaatagagattggaatggttttccaatagagatcttcttgggtccaatgatgatgtaatactaatgcttgttaatatactttacaaaattgctctctaaagctcttgtttctatctgaaatacccaattaatgacagtttgaactgtaaataacctctacaaggtatacaaactattgactgttaatatactttataaaattgctctctaaaactcgtttctatctgaaacatccaccaattaatgatagtttgatctacaataacctctataacatatacaaactattggtttttttgttgttgttttttgtttgttttggagatggagtcttgctctgttgtccaggctagagtgcagtggcatgatcatggctcactgcaacctctgcctcccaggttcaagcgattctcctgtctcagcctcctgagtagctgggattacaggcgcccgccaccacacctggctaatttttctatttttagtagagatggggtttcaccatcttggccaggctggtctcaaactcctgacctcgtgatgcacctgcctcggcctcccaaagtgctgggattacaggtgtgagccaccgccccccggcccaaactgactattgtttttaaaatacttctgccaattgaaaaaacagaaatctttccatattttttaaagattagtgattgaatacattgcaaatgtttgcttattcaaggtatgtgatattttgtgatttatctcttcatgttctttgttcatttatgttctagagtcttaaagaattaatatataaacttgtcccttctctttataaggcttaatactagagagaaggctaggcacagtggctcatacctgtaatcccagcactttgggaggctgaggtgggcagatggcttgagctcaggagttcaagaccagcctgagcaacatagtgagaccctgtctctactaaaaatacaaaaattagccaggcgtggtatgcacatctatagtcccagctgctcaggaggctgagattggagaatcgtttgagcctgggaggcggaggttgcagtaagctgagactgcaccactgcactccagcctgggtgacagagtgagaccctgtctcaagaaaaacaaaacccaaaaatctagacagcaaaactcaaaaacaaaaaagtcaaagtattattgttgactcagtggaacagcctaagtgctataactttctattggctaaacactgtttacacagcgctaagttcattttcaaaactgtattatcagatgctctttagagtgcaatggttttttcctcaacacatccactttttctgctttactcttttgtatgagttatctttggagggctagggtactaggattctgtttctctctgctagcttggggaaagtatcattttttcacgaaagagacaggtaagcagtgcgatataaagaaagccctagccatgattctgaattctgaattctcattctgccactactggtgggtctgaattccggctctgcttcttctagttgaaagactttggtttctcatcttttaaatgatgttaatgatacctacagtacagggctgttgtcaggattatgacactcattatatgtaagacagcacattaatgatactaataattgttagcctctatgcttttcttactttttctgtagcctagttccctccgtccactaactctttatggagtttatttcacatctgcattttacaataacaaccctgagtttcttgagaaagtccctgaactactgtatccgacactttaagaaacagaaataaaaagaacgagttttaaggaaacataggtaaacattttagaacaattttccatgtcttttttgggaatcaattgcttctcatttatcactatgtgttacaaatacagatatagaaacatagtgataaaatgacttttaagtattttaaataatgtaattattttactagaaatatctaagttctaaaaataaaagtggaacaaatgcatataaaaaatttcactaacaatgtatagtttttagaaacttaagacatcattaaacatttagactttgattttagaataatctagaaacaaaagaagcaggttaatataaatcgtgatagctggggataaacaattcattaacatggaacttttaaaatgctgtaaattgaaaaataaatcttaaataaagcaaagatatctctttgcctcaaaaaaccagttacatagtaatggacatatatatgtatatatatatggccttaatataggctgaaagtaatttcccttagtatacaacatcagtaatgtagacacagtaaatatgcctatttctaataaaaatgatgcaaattgaggttgatgccccagtaaacaagtctatttaaatgcattaataatggcagtttgccaaactaggttataacttaatttcaaccaggacatcttgctcaatcaatctgaatattaacttactggaaaaacagttctatccccaatccatatcaatgtgacccttcaaatggttacatttacatgcaaagtataaccttggagccatgcttttagaatccaccatgaaaaatatttacactggccaaaaatgcttgtgactatccatgcttcttgcatggctaggctcatttttaaaaactgcatgacagaacatgtagaagtatgcaaagtcaaaccaggcagaagggcatgtcaagcaaatgtcaaccatctaacctggagaaagagtatggagaactgagaatacagcctccagctgtatgcttatgcaatgcagtgtattctatttggcatctatgattcctctctacagaggaagaaaagcacatggatgattctagaaataacatttgcagtgctggcagtaattactgccacaataaataatgagcataatgatagcacatttcagtgaagtggcactgtgtgctatccagaagcatgtgaaatctaatttttaactgtaacagcagcagcagtatggagaatctctgcataccacatgaagtcttgtgctaccaatttgaactgtgggggaatcacggataaatatcatggttattacttatataatttatccatcaaagcaattgattcctcttgcattgttttcagtgatgagtcattaaaaacaaaagaagtttgaaacaattcaattttcactgatttaacagagatactcagtttataattatctttaaacaagcaaaaaaattttcacattttcatcaaatttgtaagactgaaaatagtatgatttgtgctctgtgtgaccaacatatgatcaatgttactatatagttcaatatatattatcatatagtaatcattttcgcaagggatatagatatttccttaaaatgtgacctgtgaaaaacagagtacagaaaacattatatgctgaatattattgttcaaacaaattcacttgttatcctgataaagaaaactgaatatgaagtttaccagtttttaacagtaatctcgttaccatcatcaccatcattataaatataataatcgtcatctcctttctccagtttcttccttacccagttgagctggtctgtcatttaaaaatgtgtttgccaatacattaacgcctttgcccctctgtctttctgtcataatcacttaacccatttagcaaagtaaaaatgctggataaatcctgtcacccatgtttttggtgcctgaacctcaacagccagccatgaattgtcagatagggttacataaaaagccagaaaggttctgcaatacattcaagatcaacactaccccaaaatacagctacatttttgtgatgtgaaagttgtccgaatcaaaatggagtcactaatattgggggaaaaataaagaaccctgacaaatagtgccagagaaagccatggtgagaggttctcaggcttgtatgcctgctaacaaaaactatcacaaaggactgcaaaaatcaaaactatacacaaaggcattgcaacttcacacaaaaaatacttctgcagcctgggaagcatggtgaaaccccatttctacataaaatacacgccaaaaaaacagctgggcatggtggcatgtgtctgtagtcccagctactcaggaggctgaggtgggagggtcacctgagcctgggaggtcaaggctgcaatgagccatgatcaggtctctgcactccagcctgggtaatagactgaaaccctgtctcaaaaaaaaaaaaaaaaaaaaaaaaaaaaaatccttccacaaggacatctgtccagcaattgcctgtccaatatcagaggctcatcgcccttgttattgatctttagaaccaaagacaattatttcaaaacaattatgtaatcctcatttttttcctttaaaaatgtttgtcttcctttacctctctgaatatgcacacagcttaccatgacatgcatattcccattgtaatgttctattctctaaaacaaataatatcttccttttaaagagcccctcactgttatttaggttgacagtgataatttcactcttcgattccccacaaagaaaatgtttaatcacctccactctattcaaaccactgatcctctttaaccatcacccctgcaatttgtaccatcaagcagatggccttttcctctttatgaaaaaaagacacatcacacagtgactccttcaaacttcctgatgcctgatttacatacagagcacctctggactcatctaaaaccgcccctataaactttataaaattaatcagggaagaaagaagggggagaaatgaaaatataccaagcttgcagcatgttgaacattaattgttaggtcagatcagtttcacctgcttcctcatagttgtttggtgcctattgacctagaatcatggaccctgtttcaagattatagttccccttaactgttctatagataacaacctaaacattatgaatcgttaagttttcactttgagacattccttcaggtcctgcatactgacaaaactactgtgccagttggtttgaaggaccccactgactcacctggtctgaggggccccacaagacaccgactcaccaatgatgcagtttccacatcctgctgacttcatctcccttgcctcaaccaatcaacaaccccaattttccagccccttaccctacatgatccccttaaaaactccagctcagaactcctcgaagagatggatttgagggtctcctcccatttccttgctcggtgccctgcaataattaactttgctgtattcctgctgtctgtgtaactggtctgttactggccagaggaacctcatggtcctatggtaatcctagccatccttcctgcgacacagaaggagctctcgctcttacattctaaagcgaatcccttctattgtgctttgattccgtttacgtccaccttgttgggaactcgatagtattaattattccttctctcttgtgtattcaacctctccccctcaacactttcaagcaatctttaaagtttttcatatcatgaaaagaaagaacaactatccttacccctcctataggctgaactgtgtccctcccctcaaaaatacatctgttgaagtactgacccacagtacctcagattctaacaatatttattaggagacagtctttaaagaggtaattaacctaaaataaggtctttagggtgggcccaatctaaatatatgactggtatccttataaggagaggaaatctggacacagacacatacagagagaagacaatgtgaagacaggcagaagatggccatcgtcaagtcaaggagagaggctggaacagagcattccctcacggccctcaaaggaaccaatcctgctgacatcctgatctcagaactgcaagaaaataaatttctgttgttaaatcacttagtctgtttgctacggcagccctcgcaaagcaatacaacccctcttccaccacttatagccattactctatttctcatctttccttcagagacagttatcaacgacttgtctatactcattgcttccttcaccacacctccctttcattcctgaattcactccactgttgctcttggccttgccactccatgccctgtggtcaccagtgacctcaatcttgtgctttctaacagacattttaagtccttttactcaaccttacaacagcgtttgacagggttataactccttccctgaaatgctttcttcccttggtttccatgacaaagaactcttcacactttctcatctctggccagtccttcactgccttcttttcaggtgtatgctcctctaccttgccatgaaatgtcagagtttctcaaagttcagtttaaagcactcttcttacctctctcaactttctcttcggacaattttcaatcacatcaatgcttttaattaccattcacgcacagatgacaaacaaatataccccagcccagacttcgaagtctggacctgttgtggactacccttctacatattctcttagaagtcacagtcacctcaaacttaacaagtctgaaaccaaactcatgattctccacactattttgcatccacagtaatatccaaatcttgcccaatgttccctaggtgggcaacaccattatcttgcaaactaggacaccaagtcttacaagtcagaaatatgattcgtctctaatatcttcttactcatcctaatcctactcccatcactctccttgttggcacctggcatagctgcaatttcacagctgtttgtgtcatcatgtaattatctcccatgaagcaagaaccctatttttactcatcatgacattgctgagcctaggacaatgtcatactattgtagacatttttttttttttgaatggatgaactaatagatgttattaatagaagactcattatgtgccagacactaaatattttataaaaattaccttctttaattcttgtaacagtcctattaagtaggtattattgttgttgcggttactgttgttatcctttgcttactgaagaggagactatgacataaggaccttccttttccccaaggtcaagcagcttggaagtggtagaagagggtagattcagattatttgggttcagaatatgatttttgtactgctctgctactctatcttagtggttttctaagataagctaatgggctaaaacttacctgaatttaaaacaaaccctttaacttatgaatgaagtccatggaaaaagccacatacaattaacgtatgctcagaaatctccagtttatatgtggttatcatggaataaattctaaatccttttgcctgaaattcaacatcttccatgatccaactccttccttccttcctttcaaatctttttttcccatgacatcttgatgctctaatttgagaagccacgaactagatcaattgtgcaggccaattctggcccaccacctgtttttgtataataaataaaagtttattggagaatggccacacatattggtttatacaatgtctatatctgctcttgtactataatggaagagttaagcagccacagctgcaagaaagaccgtatggtccacaaagtctaaatgtctggaattttacagaagtttgccagcaactacactagacctctagagtagagtctagttcaaaagaaatacatataataactaccactgattgagagctgggttctttccaaacactagcctttcaaaaggggtattattattcctgtttcaattaagcaaagaaggcagagagggaaagaaagagaggaaaagaggaaagaaagaagacagttcaagcgaggctcaggggtgaagtatcgtgaatggtcacacagctaagtgaagaaactgggattgggatcatgctctatgactcaaaaaggccatccacttcccactgtgcctactgcttcctttttcctcaacagaacttgggattctacgctgctatgatttaccatgctactcttcatcctccacaaaatgccagttctttcaaaacctatcactgcctggtgaaatcagatacattctgggaggacaatctcaaatgctacttcccccactaagtcttcccagattacctgaagctagagaaataatccatcctataattgcccataacctctcagtcatgtccttgtgacccttaacactttctctccctaaacttattgatagtaaaaaccaagtctacctttatatcctgtaaaaaacctagcacaatgccttccacagaggaatcacttaataaatgtttatctaatgagtaaatgaacctagatttaaaaactaggacgtttccagtttgcatttttaaataaaatattcgaagatttattttcttaattattcaacataaaaatccagagtgtaatctaaataacagaaatgtctccctttagtattttagcctacttttcttataaaaataaagtttaaaagaaattaaaattcctaataactaaatacatttaatattttctatcaatattataaaaaatttgatattagaatcatttgcattacatgtgttattttgttaggatagaaatactctttgtaatacctaaattaaccaaaaaactaagttattagaaattaagaataaatcaagtatcaataatgaaatgttatttattgcaagaatacactgagaccactgatgacgtttccaagaaccagttatttttgaagttcattgttacactaagctgaatgctcaatgtcatcactgtgaaaataacataacttttaattcaaatactatttgtaaaacaatacataatttaaaagttttagaatccagtttgatgtgttctaaggttttctatatagtgtatataagacttaatagtcagtcacatagtagaaattataaggaattaaaaagagttaaatatattcaaatcagacacctacctgcattaccttctgttgaatctcttctaactgtgtgcgcttgctacgttgcctacaaacttcctggtagcgggtatattgctctcggagtgaatctaataatttcataacctgtggctgtgcaagaagttcatcatccataggagaccatgaaacccctccgtctgagccattaaatcgacgctgctgtaattcggacaacaattcatgccctttacaaataaaagatacttgaaattaatatctgtaaagaaatgtaattctcacttctcaatattcccaattctagtcccttgtttttaaaacctatctacctacatatctaccaggttataaatggaatttaaaaatgtatgtatcacaataagtaggaaaactgtacatattaatatatatatgtgtgtatgtgtgtgtacatatatattatgtaaactagatagtatattaaaatgctatatcatatatcataaatatacgcaccttagaaatactatactacatattaaatatggcatacatacggtttatatttttttttatcaatcacatttttgttattggtgaattcattactcaggatactgtgccaaacaatcctatttccctgtagagcaaaattatactgtgggatttctgtctgatggtactaatccaagtaatatgttgtaggatttcagtattaatccatattctcaatcacagcatttaaaaaaaaggtgacagtataataaatgaatgattaaagggagaaaagtttttattacaagtacaaaataatatttatataatctctatttataagaatcttcacaatatattaactgtgaataataacgggccatactagtgttagaactgcaatgaatgtgactcaattacagcaaactcatgtagaaaatccactcatacatgagaaactacaattgtagaatgtgcaacaactaaagctgtagatattaaataattttaaaagtaaataaggtaaaaattgtttttgtgactaatattcaggcatcaaaacaatacacatatttaaattctcttccttatttagaataatatcttaaatttaaatggctttcaatatatagcaactgaacttttattatggtttggaggtatttctaatttctaaaagtacccatgattgttctaaacctttttgttttatactctctttcaatacttactttaaaagttaatagcatataaaataggacctagtagcatataaaattaaatttacaatagaaattgtaaaagcttcttaattcaatgaattaaaataaaaagctttcaagctgctaaacatatatatggaattaagttttaaatctagagcagtatttttactgacagtctattgtacctgctaaatatataataattcagagattacaagtatttctttgttctctaacaaaataagctgtatatcatactggaagaacttaggacacctgaatcaatacaacaaatatattcagaatttacttctttattatttattacattttataattggaaaaataattgttttaaaggtttgtgcaaagtctttttatatatattcataaaagctatgaatatcagaatacatttatttttttctactttgacaattgtcacccttgattatttttcttgtcgatatcattttcattagagaagcagcatagcataatgatttcaaagagcatgccttgaaatcaaactgcctaggttcaagtcccagctccagcatttactagctgtgtaacctatataagttacttaacgtttttatgcttcagctttcccatcttaaaattggaatgacaatagtatctatttcacaggactgaaatgagttaacatatgtaaagtgctcagacagtatgtggcacacagtaggattagaattatgagctattattaaaaaaaagatcagaaataaaattgaggtatttcaattggaaaaaattacaatttgattctcttagagtttgtgaaactgctactagagatatttgggttggaatatacatatcaggcagcactatgtgcttgcactatgtgcaaggctttgcaaggtgataagtgtttttacatcgatgattataaaacagtagagctttggctttggatttagctatggagagagagcttaatagttacttgatcttcggcaagtcattttggcttcctgcagtacaaaatagataaaataatactaattatctcaaaggcttgttaggagaatgaaaaataaaaatacataaacacaatgtctggcacataaggagtgttcaataattctcatagcaacccagtgaaataaaaattttcatcttcattttatagataataaattaaatccaaattaagagagagattattattaatttttaaaaatattataaagctgcggttccccccacccccaccctgggccacagagcaggaggtgagcggcaggccagcaagcattactacctgagttctgccacctgtcagatcagtggcggcaccagattctcataggagcacaaactctattgtgaactatgcacgcgagggatccaggttgtgtgctccttataagaacctaatgcctgatgatctgaggtggaacagttttattctgaaaccatccctcacccagtccacagaaaaactgtcttccacaaaaccagtccctggtcctcaaaaatttccccttgagttccttccacatgtaccacattcatgctgaattcatgtttatttaatgaacgaatcaatccaattggtttactggattattatcacaaatattttttaaatcttacctgtctgaagaactgtttcaggatcaaccgatggaagaaagtttaaatccacagacctggaaaacaccaaaggagtaattttcaaaaggcatatttctatcaatgtaactttaaaaattcctttacatataaaaaaacagaacaggggcacaaaagtatgaaaatctgaagcataccatcctaccatgctaacttctctcaagcataaggaagcccattaggaaaagtaaatactagtagccagagaaataccaacgtaataaatcataaaataactacttggaaaaatatagtttactgtttttagtcataatattatttcaaatatatcaaagaagtccatttagtatttatccaatgagtatttgtttcaaaatgaagtttgtcatatagtaacccagaaatgtaacattaaaaaatgcatgcagccatcctccagacaaaactttatttacctacagcaatctttgatagctgtgaatattctgtcttatattccaggggtgtgtgtgtgtgtgtgtgtgtgtgtgtgtgtgtgtgtcctagcagttgtactctcttccctaatcatacttcttgtgcagctggacatctgcctttattttcctaaacacatacaggaaagaaaagatgaaggaaagaaaggggacaatgaccttgctgctctaactgactggtctcatgctaaatttttcactttttgtcaatggatctaggccctcagatgcttcctgaggattgacataaagaaggttgaaaaaaaaaacagacagctgataaaaatttgcaagaggagggactctattatctgggatctggggtttaaaggaaactaagcaataacacgtcagttccttgaggaggaactggcaaatataagattttgatatttcatgtagtcatggaaaccaggacttcccaaagtgtttcccaaaacactgaacaagatatgtttgtttttttgttttttttttttttgagacggagtctcgctctgtcacccaggctagagtgcagtggcgtgatctcgactcactacaacctccgcctcccaggctcaagggattctcctgcctcagccccctgagtagctgggactacaggtgcgtgccaccacgcctggctaatgtttgtatttttagtagagatggggtttcaccatgttggccaggatggtcttgatctcctgaccttgtgatccacccgccttgtcctcctaaagtgctgggattacaggcatgagccaccgcgcccagcctgaacaagatatgttttaaggaagcaattaaataggtttctttgctgcactgcttcttcagaacctttaatctgcaatattcacagtcattctcaaagagggaaatacagtcaacagcatcaaactctttgatcatggactcattttctatagtcaccaacatgggatgtctttcccaaggaatataactaagaaacatcaaacttactcggatggactattcagaaaacaagtccagctaattttcatcaagtaactcatgatattttcacttcctaaaccacagcatatatgtgtgtgatatctacagacacacaatcacatatttatatacatatacaaaatttcataattttacatttttatacggcatctgtaggatggaaacattcctaactgcttgtgactttaatcagatttacattcaaaccgtttgttttcacagtttgactttgttttaatcaagattttgtgttaaaactatgatcttacacttgaaaacttgatatgtgactatatttggattcaaggaataacaacaagcattttattaaggttccactgtatcttcaaggtcagattcaaaggagacagatcggatgacagggaacaccaggattctttcacatttcctaatgaaaaattactgttttagtgaccagtaataatcaagtggcctgaatagttaatttgcttgctaaagtgctttttatctgaggaggaggacttgctctaccaacagaaaagtgaaagctgacaaggttgtaaagttcaagggaaatctgttaacatgataaatctaggtagttacattcagataataccactcaactattacttcattgcatatcataaaacactaaattccccaatttgaattcatgaatatcacatattttacaagagcagaaaaagttctataagctagacatttaagtgctaatgtattcaaataaggttataataattgtatttcaaactgcaacttttttcatattcttaaccaggaaagaagataactctaaaaaggtagaaaagtgtttcttttgaaaacacgttcttgaaacattttacatagtgtcagaaaaaagtaaatacattactattaatttaaaaatgggccgggtgcggtggctcacgtctgtaatcccagcactttgggaggccgagacgggcagatcacgaggtcaggagatcgagaccattctgggtaacatggtgaaacgccgtctttattaaaaatacaaaaaattagccgggcgaggtggcgggcgcctgtagtcccagctactggagatgctgaggcaggagaatggcgggaacccaggaggcggagcttgcagtaagccgagatagcgccactgcactccagcctgggtgacagagcaagactccgtctcaaaaaaaaaaaaaaaaaaaaaaaaaaaaaaaaggcttttgtgaagaaactctgattcaaaccaatacattttacatgtaaagcaaattcaaattctcacgaatattgtacgtcaattttgattgaatgaagactttgtttactgtagttcttttagcttgcattaacaatagagatatcttttatcagaataattatagttttgcaaggatataattgcatgccactagccacctacctttctttctcttgctgatttcctttatcacttccattgttaatcaaagcaagttcatctaataatgatgtagattcctttgtaaacttctcaaaaacctacaatatgagttttattaacatactaagaacagtcttaaaaattaatatgtaataaggattgtcagttaagagtaatagaattggccagctaggatatgttttccttccccagcagttcgtgcaattctaccaccagagcacaacaatgtacccaagagaagacaaaactgtttcctaaagcaatgaatagtttcatggataaataatttttaaaatttaaatacatcaataaattatcttcattctccattcagatacgtgtttctttgagaaacatttgcatcgataacagttctaactacatacatgtaatttagaacacgctaagtctctaataacagttacagaacacttctttatgttattctatcaccaacacatgttggtttcacataatagttgttatatacatgcatgtagcatttaaaattagttataattttaatgatttcttcaaatatttctgaaaaggaatttgggcaagtctgtttaagtaatgaagtagacaatcacttgactaacaccactttttaaatatggtggaaataggctgggtgcagtagctcatgcctgtaatcccagcattttgggaggccgaggcagaggggttgcttgagcccaggagttcatgactggcctgggcaacatggagactccatctctacaaaaaataaaaccttcgtcaggcatggtggcatgcacttgcagtcccaacgacttgagaggctgaggtggaaggactgcttgagcccagaagttaaaggttgcagtgtgtggtgatcatgccactgcatttcagcctggggtgagaccctgtctctaaataaataaactgggtggaaacagaattagttatccattcagagataaccaaaagttcaccattctccaataaaattattatttaatctaaaatgagttaatctgacgtttgttctttcagtagttcaataaaaaaaaaaaatcaaattacacagagttgcagatttcagaagtctagaatgccaaagacgatacattttcacaaatgaaaatgcttaatctgtcaaactgctcttcaagttgataattcaaattaatgtttaaatatcctctgaaaatggtatagcaactagatcacctcaagaaattatgctactgttggctgggagcagtggctcacgcctgtaatcccagcactttggaaggccgaggcaggtggatcacgaggtcaagagtttgagatcagcctgaccaacatggtgaaaccccgtctctgctaaaaatacaaaaattagctgggcgtggtggcgcgtgcctgtaatcccagctactcacgaggctgaggcaggagaattacttgaatcccggaggcggaggttgcagtgagctgagattgcgccacagcactccagcctgggcaacagagcaagactgtctcaaaaaaaagaaaaaaaaaaattatgctactgttattctaattaaaaattttacaacctttactgatgctactaatgacagaacagtaatagctaaaacttatacagtgccactatatcatgtctggtgctgttctaaatgctttatatgtatattcatttcattttacccataatcacacaaaggtaggtactattactatcaccatattacagatgtgggaatcaggccaaggcaagattaaacgcattgttgaaggcctagcaactagaatcaggattctaatcaagtaagtctgacttcacagtatttgtctattatgctataatgtggtatgcacatatttctccatttttgtaaaaagaaaaataatctatattttaatagactaaaatgataaagttatcaaaatatatcttatttctatgcaataacattttatctcattgtaatataccaaccagcctcttatttaaccagtccatgtgatcataggtgagactcccaccaaaatcttctgttaattggcatggttctatataacgagtcaatttgttggcggacactaaaataacctataaaaaggttaaaagaaaagaaacatttagtaacccactattaaaatccacgaaagtaaccaggaggtaaaattaggttaaaatatgcaatattgtttccaacatgatgacacattatcatttacttaatacaatatttaaaaccaattcaataagttatagatacctgataaaaaattcatcaaaaattttttctaataccacattttaaaaaacaacaggtaccagcagttcagatgaaatattttcaaaaatattttatcttgtttctttgtaataaaaatcaataatcaattccttaatgcaatgaagtaataaaaaattttcacatcatcttaaaattagctaaggacattaaaatgataagccctatgaagagtaaatctggcaatcaaaaagttatccattttaaagtttttctaatgttcctttgattacatataaacaaaacaagtcctccggttgtagagtataacccacaataacgtatgccaatatttaatttttagtaaaaattagaagatcagagtatttataaacttgaaacgtacatattaaaatgctaatcttttaactctaaacttaaaaagatttcaaatacaaattaaataagtacctaagagaccactgcagaactaaataaaacttcagtgaagatacacatgcataaaaaacaaaatacatctatggaagaaagatattcaaatggtagtgttaatactaaatgacatatggaaatgtgaatttattaaaaatgacttgataagaaaaataatgtgtctggctggaaagagcatcattgccactctcacaataacaaaagccagacaatctgcaaaattataactttttctggaactcctaagaaagctgaggttacagggaaacctgtaactagtttgaagttgaagagaaggcaagcaccacagagagaaaggtgaaaggggctaccacagagcgcatgtgcgaaatttttggaactcttctgtatcttgattatggcaaaaattatgtgactatatgtgcttgttgaatctcataaaactatatgctaaagtatgaattttacttcacataaattatacctcataaaactgactttaaaaaaatttaaaaaacaacttaaggaggacttgtggaagaactcagaaggagacaaatgaaaaatttagaaacagacacaatatgtaaaacaaggtacatccatactgtatatgaagttataatatcaacaataaataaggagaaattaccaagactgctttgccggaagagggaaaatttcatcctcaggaagacaccaaaaacattgcatgaaaaattcatagaactatgaactctatcaaatttgagtgtacaacaaattgctattgataacaatacattaaatggaaattaagtcttaaatatttatatgaggaaacaaagcctagtgaataatgagctaagtgacccatctaagaagtcaggagaggaaaaagacagaataagtccaaagaaaatagaagaaaggaggtgaaaaatcagaagtaaatataaattaagatattacaggggctcaaaaaagccgaaacttatttcttgaaaagactaatgaaatcaacaaacttctgataggaggaagcaagaaaaacaaagtacaaataaataatggtaacaacataaaggagaataccatttcgttgatagcaatggtttaaaagacattaaggacacaagacaattttgtgccaatacctataaactcagaagaatagacatattcctattaaaaagtgtaacttatcaaaactgacataagaaaacaatacctacaaccaatgaagtgaatcattagattctttatgttttcagtaatcatgctgttagtgatagttttagtattgccattctgcaatcacttgatgaggaacaaagccagtgagtgagatgggatattataattctgccatccccaacaaccttaagaaaatggcatttttggcaagggaggaaggaagatgtgggagagaaaaagcatccttacagtgctcgttttaaattggaagtatcagtttaaactccacaatatatttcattttaaatgaacacacacacactctctcgctctctctctcacacacacttatatgtatgtgtattttctagttgtgtccaatggaaggtttagaaataatgaccaattttgtagaaatgtatgttcctagcatccagactgtgatctctgagtaccatttctcataaaaaagaatcaggttttgttaaaatagcattagtcaaaaaaataataattttaaaagaaaataaaaggaatcacaccatgatgagtgagcttggaacatcttacccagacatcaaaaaagctatcaaagactactatggttgtgacgaaaggacatgaaaaggcttccactgaccaaatatgtgacaagttacacatcaataagaataataaatgccatgaatcgaaacattaaatacgcttaaatcaatgagtgcatactgacacaaaagaaataatcaccattggactaagctagagaacacacttattataatgaaaacgagactgggcacggtggctcatgcctataatctcggcactttgggagaccgaggcaagaggattgcttgaaaccaggagtttaagaccagcctgggtaatgtaagaaaacccaatctctacaaaaaaaaaaaaaaaaaaggtgtgtacttgtagtcccagctacttgggaagctgaagcagaaggaccacttgtttccaggagttaggctgcagggagctattattgcaccactgcactccagcctgggggtcagagaaccccatgaagaaaagaacggaaggaaaggaagggaagggaaagaagaaagggaaggaaggaagggaggaaggaaggaagagagggagggagggagggagagagggagacagaacagcaataaagagaaacaagcatttatttcacttttcatatacaaactgtattactggatagacaaataataagtttctcattataaaatgattccagctagtaaatgaaggaataatagaactagattatcattttataatttttaatgaagtaagagatctagacactgaacattaatggctgctaacgtcacaaaaaagacaactattacaaatctcatgatcaaggaacacatcaccacctgtgaagagccttagaaaaaggaaatcaactctaaaactaatcactgtctaaatccaactatcaatttataaaaacacatgtaaattataccacagggatactttcagaaatatgcagactactggaaactctataggacaaacaatttggtctcttaaaaaaaatgtatacgagaaagagaagttaagattaaaaagctgcatttaatagacatatacagaatctcataaccaataataagagaattacatgttcttttcaagcaagtatgaaatattttaaaacttgactgtatattagtgcataagaaagcctcagcaaatttcaaaggaatatataatataaccacaaaattaagctggaaatcaataatcaatcatatcagcaatccgtattactgatttctagctcactgtagtctctgcctcccaggttcaaaggattctcctgtctcagcctcccaagtagctggactacaggggcgtgccaccatgctcggctcatttttttttgttttttagtagagacgaggttttaccatgttggccaggctggtctcacattcctgacctcaagtgatccacctgccctggcctcctaaagtgctaggattacaggtgtgagccatcgcatccggcccacaactctttttttgggatccacagaaaggctttcacactagggaaattaaacacaatcagatcccagaaaagaacttttcctttctccaaaaatgtcaagcaatatattaataagatatataactatatatactaagaatgaaaccaagcaatatacatttattctatgagtaaataaattacttgctaaattgagcatgaattcacatctgaaaagataaaatcccagagcactctctcctgaaaatgcaggccgggcatggtggctcatgtttgtaatcccaacgatttgggcagccaaggtaagaggactgcttgagcccaggatttcgagactgcagtgagctatgatcgtgccactgcactcaagtccaggcaacagagtgagattctgtctcaaaaaaaaaacaaaacgtaaggatggtctttttgctcttcaattgcatcttatttaacgtaatattctatttaaatactgacaaaaatctctcttttgagaaatcccactatcatgtcccttatttatttttaattttccataggttactggggtacagtcagtgtttagttacatgagtaatttctttagtggtgatttgtgagattttggtgcacccatcacccgagcagtatacactgcagcatatttgtagtcttttatcccttgcttccctctcaccctttcccccaagtctccaaagtctattttatcattcttatgcctttgtgtcctcatagcttagctcccacatatcagcgagaacacacgatgtttggttttccattcctgagttacttcacttagaataatagtctccaatttcatgcaggtcgctgtgaatgccattaattcattcctttttatggctgagtagtattccatcatacgtgtatatatatatatgtgtgtatatacgtatatatgtatatatatgtgtatatatgtatatgtgtgtgtatatatacacatatatatatcacatatatacatcacagtttctttatccactcattgattgatggggacttgggttggctctatgattttgcaattgtgaattgtgctgctataaacacgcatgttcaagtatctttttcgtataatgacttcttttcttctgggtagatacccagtagtgggactgctggatcaaatggtagttctacttttagttctttgaggtatctccacactgttttccatagtggctgtactagtttacattcccaccagcagtacggaagtgttccctgatcacggcattcacgccaacatctgttttttgattatagccattcttgcaggagttaaggtggtatcacattgtggtactgatttgcatttccctaatcattagtgatgttgagcattttttcatatgtttgttggccatttgtatatcttcttttgagaattgtctattcatgtccttagcctactttttgatgggattgtttgctttttttcttgctgatttgagttcattgtagattctgcatattgtcctttatcagatgtatagattgtgaagattttctccccctctgtaggttgtctgtttactctgctgactgttcattttgccatacaaaagctctttaatttcattaggtcccagctatttatctttgtttttattgcatttgcttttggattcttggtcatgaaatctttgcctaagccaatgtctaaaagggtttttccaatgttatcttttagaatttttatagtttcaggtcttagatttaagtccttaatccatcttgagttgatttttgtacaaggtgagagatgatgatccagtttcattctcctacatgtggctagccaattatcccagcaccatttgttgaaaagggtgtcctttccccactttatgtttttgtttgctaccccttttacattagctgcaaaaaaataaaatacttagggatataccaaaccaaggaggcaaaagacctctacaagacaaactacaaaacactgctgaaagaaatcacagatgacacaaacaaatggaaacacatcccatactcatggatgagtagaatcaatattgtgaaaatgcccatactgccaaaagcaatctacaaattcaacacaatccccaccaaaataccatcattcttcacagaattagaaaacacaattctaaaattcatatggaaccaaaaaagagcccgtatagccaaaccaagactaagcaaaaagaacaaatctggaggcatcacactacctgatttcaaactatactataaggccataataacagtgtcattgtttctttgttttcatatttagaatcataggatgatttatttcatatttaaaatcgtaagatgataaatcacaggatgagttatttctgggttctctattctgttccattggtctatgtgactatttttataccataccagcacagaacccagaaataaatccaaacacttacagacagatgtcccttatattaaacttaatttttaataatgtgttattgattcacttaacaatcattatttagtggagctaaatttatttattagaagacgtgtattttagtgttgggaatatgaggatgaataagatatgcttctggcaaagaaattatcttttcatttgtttctttgcaatatttctctgcaatattccagagacagttgtgtaatgcacaagatgtagaataaaattttctgctttgttctaaggcctttgttgaaaataccctaaatgtcatggctgcttttgtcataacagcatagagggccaaaggctttactagaataccccaaatgatttccaaacccttttactagggaaaaaacaccattattttacaactgaaaacatacaaaactagcagccattcattccaggtctgtgccctagttctgccacaaattcactaaatttgtagaagacaatctaaaggaattcaccactccaagcttattccccaatcttttgaagaagccaccttcattaaattatctatgatgtttctttaagctctaaaaggacataattctaatgagttgttatctgatacatttaatttgggccattctctctcttatattacctatcttgtccaatgaagagctctcgtcacttttctatccacactggttagccttaccatatgtattcctttctacttttatagttcctaaatgcaccaaaatcattgataaacatgtttcaagtttaatgagccacacggaaattttccagttaacagttacatacaacggaagtttatttccatgtgaataattctcttaaaagctctttttcctaaaattaacttaaatgtaaacagtacagattcaccttcttttatgacataacacatatttaagagcatattatcctttaatcaaaataatttttttaaaaaaattgaccaagattactgctattatgtttttacctatgcaaaatagttttaaataagggaaggacacaattatggagagctacagaaaactcattttctccattattataaaacattttatacaatccatattcttataaaattcactggtggctattaaaagttaaaacagtagccctgccatgtagacatacagaattgtatcaacaccaaaggtatctcaaagttaaataacgtatgtgggggaaaagcaacagtttacacaatcggcagactcacaatcacaataatttccaattgacaacttacagaactatctactgtgatgaaacatctcagtttccactgcaataatctcatttttgtttaagagggtgaaggtgaggagaaagggcagagtaggctggctaaagagcaataaatgtttccattttactagaaacattcttttagaaaaagaatgaagggaaaagacatttaagagtgtgcaatagtaggaaacatcttattctatgcatacgcttttcgcctaacaatcacctttataaagtgggtcaggatcagcatgtgtaagaggaaagagaatccctccttccagtgcactgcaaaaatacactctgtttacaaaggtgaaaaactgtccacctgcttttggaaaattacaccacttactaggatacaacatataaataacagacaactgcttcccagaggacaaaccaagtttgaataaacagacaattcaactccactccaatgatggcaaacatcacagaagggtgtgatttcactgctgtgaatttgctcgtgaagaccaaattcaaatgtgcaagcaaaagtaagaaaccatttgcagggcgggatttaggcctgaagtagaactggaatgctgaaaaaggaaaactgtgtagagatttctagatgtttgaaaagcaaaaactcgaagaaaacagagaaaactgacacatttcagggtaatgcaacaaaacaagattaggaatcccagactaggtgattttctataaattgtttcattacagctttttaaattacaaaatactggtagggcttcctatattcctttctgttacagcccttgaagagaccactaatttccatagatagcaaacctatatgaaagtttaaatataaagcaatgcaaatcaaaggatcagttttatcttattggaaatgttctatgacccggcaaagaagaaaaaaacaaagaaagaaacataatgaaaaaaaattttttttgagagttttgctcttgtcacccagactggagtgcaatagcacgatctcagctcactgcaacctccaactcccaggttcaagcaattctcctgcctcagcctcccgagcagctgggattacaggtgcccaccatcacgcccaactagtttttctatttttttagtaaagatgaggtttcaccattttggccaggctggtcttgaactcctgacttcaggtcatccacctgcctcagcctccccaagtgctgggattacaggcatgagccactgtgcccagcccataatcaaattttttaaagtccatcctcagagagcaattatcaactaaaagtaagaacaaaattagaaaagattccccctcaaaatcatattgagatcacatgtattacgtataattcattttcatcctatgattctaaatatgaaaacgaagaaacaatgacacaattgctgaaaattctaaagaaatattttccaaagctacaaaaaaagctttgaaaatcttcagtgaagtgattaatgagtaagaaataacaccgtgaattagagcacaaatatttaaaagtacaaaatggcacaaatatatataattatattagattatattaatttaaaaattatatggttctttattttctgcaaaaccttcttttaaatatttattgacattgtcacctgttctaattaagtgaccaattgatagaaacatcatattctaacctaaagataaaccttctttaaaaatcaaacaatccattgcctgtgaagaagatggaaccacaaactcaacattttcatttctcagaaaatatttaaaagagtaaattttctaaaagtatccagcatttctttagactagcctattgtgactctctaaatcactatttcccagttatgaaaatctcatacactctccatatcattctactttttttttgcagaacataatgaagtagtatatataataagctcattttaatttttttaaaaaaggatttacttattagtactacaaaatactaaattaaagcaaacttcataataacacaccttaaacaattatttttttttagagacagggtctctctctggcacccaggctgaagggccactgcaccttgactcttcagctcaagtgatcctcccttctcagccttcctagtaactaggaatacaggtatgcaccaccatacctagctttttttttttttttttttaattttttgtagaggagggttctcattatgttgcccaggctggttccaaactcctgggctcaagtaatcctgccatctcagcctcccaaagtgttgggattacaggtgtgggccattgctcctggccttaaataacatattataccaagataaaaatgtaagaccaatttgtatttttcccacctaacaaatgacattaaggctcttcagttaatttagaaacagttatgtaaaatacaatgattcatcacaaatcatttataaagttacctttcatgttgaattttaagattacacatacatcacattcaaaatggtattatgttgggaggccaaggcgagtggatcacgaggtcaagagatccagaccatcctggccaacatggtgaaaccctgtctctactaaaaatgcaaaaatgtgctgggcgtggtggcacatgcctgcagtcccagctactcaggaggctgaggcaaggagaatcgcttgaacccgggaggtggaggttgcagggagccgagatcacgccactgcattccagcctggcaacacagtgagactccgtctcaaaaaaaaaaaaaaaggtattatgccatcaaaaatacagcggaaaagctattttcatgacctgatatttgaaattttaacttttatacttttaaaaaacctagctggcttgtttttgtaattttcatatttctttttaagcaactatatatgagaaaaagtttgcagtcctggactggtagataactctttgaatgtgtaaagtcttttattctccaaaaatgaagaaccaaatttgatttcatcacactgcatactatgttttttaccattatttttagagtactaaagacatcttgatatgctacataacaattttatgaaacgagtacaatttacacacttagtaataattgtcttgaggcaaatttataggattatcatccttattctccttaagttgtcatgtatcaattatcagtgactcttatggtttgttattcaccagtggtttatttgaaattgtttaatagagaaagtcaccaaactgattatgatttccagctgagtgataaatctgagcaactgacaaatctcccaaactagtcaactaatatctgaaagttttccaattaatatattttaagtaaaaaaaaaaaccatattttttaaaagatagtattaaaaatatgattccttcattaaggatataaatcctctggaacaatttacaaaatcatgtaggaaaatgctaaataatgttgctcttggcttggaatacaaagtttaaagagagactgatacttactttgatactaaaatatcaaacttcaagaaacagcttatattatcttgcagtgatcaatgcagtatgtcactgatatccaaaatcaagttttacaaaatatcctcctattaaaaaataaaattcatctataagaaaaactacctaaatctcagaaacaggcagacattattactgagtgttctttcatgcagtggtgggtttgtatctttgattgactctctatagactgatcagtaggtattaagctctgtaggagtagaagttaacttgtagattctgtttagaacaaaggcaaataggctgggcacggtggctcatgtctgtaatcctagcactttgggaggccgaggcaggtggatcacaaggtaggagttcgagatcagcctggccaacatggtgaaacctcgtctctagtaaaaaaaaaaaaaaaaaaattagctgggcgtggtggtgcatgcctgtaatctcagctactcaggaggctgaggcaggagaatcgcttgaacctgggaggcggaggttgcagtgagccaagattgcgccactgcactacagcctgggcaacagagcaagactccgtctcaaaaaaaaaaaaaaagaataaaggcaaataattgttgtctaacgagattgatatatttccgtccagtggaataagagacaacctcaaagtttataacttatggatctatagaacaataattagttttgtatctaatttggttggcaatcttttcctataaaaacctgcaattcctcaaatgctctttgaaccacagcttacaaattactagtaacctcatttatcaatgaattgaataatgtatttgacttatgctcattttatatttgcattagagtcatgatttcacctttaggaaaacgacactttaacatatgctttatcaatttaagaatgtggagtggatgaaattctgactttcatcaactattttcaaatagccatctccatgaacattctaatatttatgcgtaccattaaatttatgaagaaaaacattactagttgcgttcaaagtagctatcattttactaagcagaaatctaaatctcaaatctatcctcacattaccaaagaaatctgaaatctaataatcagcataaagggaacaagaataaaaatatgtatattatatatatatataaaagaaggaaaaaaaaaagatcactaccctgcacaagcatttcaaacttttgctaagtcctttcaaaggcaatacaaaacataaagttttaaaaataaagccctacataaatattacttttccccttcattttatacatgctagagaagttaagacaagacaaattaaatgactaaaccacaatattgtattaactagcacatatcatggttcaacaagtttgaagagaaaggtatttaccatatggtctttaataaaacatttgtgcaggttttctttaatctcaaattttaacttgcagaaagattaaaaacttgtttctcttttactctcattattccttctgtaactataatacttatcctttcctagtaaaacattccccaaaaacctaccactgaaacttgcattttgtaggcactgagatggtttattattatttcactattgctaagaatgtgcgtgcaagatccagaatgaaaatctgcctttgtatgtatttctgcacttagtaaagattcatgtgtgtatatatgttcatacacatactattttgatgtgtatgtctgcttgtacctgtttgttgaagaatatttttctcactcaaggaaaataggtttctataaaaactggaaagaatcagaataaatggagccaggggtgttcttgaaagaagagcatcatggaagtctttggtcctggatcctacaattatgtatagtctcaaaaaagaacatgattagatccagtattaacaggtaagagaataaagcaatttagaatgggtgctggttaacattaaataaacaacactttaatgagtgacaaaaaaggagagtggagatccctttgataattaatctctccatttgaggacaagattaatgctagtatgacctcaattttatcttgtcattagacagaatatagacactatcatcaaaccagcaaaacctatcatagtcaccaggtacaatgctgctgaaggatacgaagtacttgaatataatatctgagttgctaaaaaggaaaatgaacaggtaggtatctatgtcagagataggaaggatatacagagaaatattaaggttagcaatgagagatgaatattcaattcctgatgaaaaacattggaggagtgaatagtaaggaggttacctagaagaaaaaatttagaaagtatcatgggcaagaaaacaagaaatcatgtgggaacaaggtgtcaccaaaatgaccactgggtgtatacttgatgagcattgtggacagctggtaataaatctttgttgcagataatttaattttaaggtaaaacatacatttatgcttacaggatcaccactactcttaacgaagtttttaaaatatttttttaaatatttacaaacacaggcttaattacaacagcctaaattatccaaaataataccaagaaaaataatttgcaattaaacgagcatctatgttggatttaattatatagagctctaagtctcatttaatggatagtgttgaactgcccccttaaagccgggtttgcctggcagcgtattaaccagcatttgaaattactctcaactcattaggaaattgggcttttaataagtgcctagcgctttcttgagaaaatatcctagctgaatctcttcaatgtctaagaaaacatattgatataagaagttttaatgcttctgttttaaaacaacaatctatgacaccacatcaaggtagacagaaattctgtcttctattttatcctccaagatgcagggtatttaatcactattaatttctataacataagacccaactaccagagcatctctgagcagatgcctatttagtttaagcaggatgtgacaggtgcctcataaaagggatcttccgtggtaccgggtgttcacagctttagtttcggctatttacccctggttcactttgcattgtctcagagcaacattccctgcatgccccaggccatgaactgcagaccttactagctggctgaagtcttcactcaccatgctcctgactcttgaagcaacattcagacctcctggcttcagcttttactttcttccctcactatgcttttgtctctttttgttggggcatagttttccaatcaactaccagggcaacacccttcctaatgtgatccagcagccttggtcatcttcccttacattactggcacacatccttccacaaagtctacataatagtcaagtctaccaatgacaaaagttgaagagaaaagtgggaaaaaattctggcatctacttaggatgtagaaagttggaaagagcatggctccaactcttacataacaatgaccaaaaaaaatgcaagttaatctgaaaaaccacaacttttctgaagccactggagagctaaattcacaaggaaaccaattaacctggaatctaaggaaagatctgcatcttcaagaagatggaactggagtacttgcttacctgggaaaaatgccagacctgatgccagccaggtaggaatttaggttaaaatttttaatgaatcactaaggccaaatgtgggctagtgtgaaagtacagaacccatgggaagtatagacacaagaattcatactcacttggaggctgaatctctagaggaaagatctctgcaggagtcatgagaaagactggaaataagaggaataagagatttgaaaaagcctctcttggagcacaagcctgggtgaggggaagagcagccactaatggaaaggcatgaagcacagcccaaaatcttcaatgctatctctcctatgaaaaaaaaaatcttagagtgctgcggaaaggactgaaaatcctgctgaccttagaggacaactgaagtcccaccacaggtggaagaagggaaaagaaaagactatcacaggggagggagtagacccaggaatatattataaacccgaactatcataggttcccaaaactgggggaggggcaacattacccactaggctgagggacacagagcctgcctaagattgaggctgaataagaacaacagagaatgcctctctaacaaatactgaataacaaggaacagcagcctattgctgagagtcaactgtatacagaaagactttctctgaggcgcaggtacaaaggaaagacctagagcagagggtagaacaaataatgaaaaagcaaaattctctggcaaaccagcccccatcttcaacacaaagtaactctagagaaatgagaagcctgtggtgcactgaggaaaataatagcaacaacaaaatccaaagccaactcaattcctggttagaactcaacccttctcttatgctatcaaaagcctaggaaaagggcaagatgagcccatgtgcaggcacaaatactacctacacctcagtctttactgtcctaaacaagatgtctaacattcaataaaaaataacaaggcacacacaaaaaaggaaggaaaatgacccactgtcaagaaacaaagcaaacaacataagtggagtaagacagatgcagatatagggactatcagataggaaatttaagatactgatgctatagagaatgaaaaataacatgcaaggacagacgaggaatttcagcaaagagatagaaactctaaagaaaagtcaaatagaaatgctacaaatcaaaagcatggtaattttcaatggtctcatcaacaaacttaacacaaccaaggaaacaaagagtgaacttgaaaatggatcaagagaaaatacctaaactgaaacacaaagagaaagacacagggataaaaataaaacaggagaccaaagaaaatggtgagaaaatttcaaatattttatcatacatccaaatggagttccagaggaaacagaaaaagggcagataaaatatttgaaaagagaatgtataagcattttccaaaattgatgacagacatcaaaccaggtatctaagaagtacagagaacactaagtggaataaataccaaatagaacacacagagatacagcaaaataaaactgctaaaaaccaaaatcaaaatgaaaaatcttgaaagtgcctgaagggggaaaaaaaggcaaataacatacacagaggaccaaagatataaataacagcggccttcttgtcagtgaccattacaatgagaaggcaaaggcaatgagacagcacttttaattttatttaatttttacttttttttcttttttgaggcagggtctcactctgttgcccaggctggagtgcagtggcatgatctcggctcactgcaacctgggcctcctgggttcaagcaattctcctgtctcagcctcccgagtagctgggactacaggcacatgccaccatgcccggctaatttatgtatttttagtagacacggggtttcaccatattggtcagaccagtctcaaactcctgaccctcaggtgatccactgccttggcctcccaaagtgctgggatttcaagagccaccgcacccggtgagaaagcacttctaaatacagttgacccttgaacaactcaggactgaattgcacaggtccacttataagggagttttcttctgcctctgctacccctgagacagtaagaccaacccctccacttcctcttcctcctcagcctcaagacaatgagaatggagacctttatgatgatccacttctacttaataaatagtaaatatattttctcttccttattattttcttaacattttttctctagcttattttattgtaagaatacaatgtataatacatatacaaaatttgtgttaattgactgtttatgtaattagtaaggcttttggtcaatagtaggctattagcatttaagttcttagaaagtcaaaagtaagttagacacaaattttcaactgcacaggaggttgctggccctaacccctgcattgttcacaggtcaacggcatgattaaagtgctgaaagacaaaaaaaaaaacttgaaaataattttcaaaactaaaatagacatacagattttctttaggcaaacaaaaaatgagacaattcaatgccaacacacctgcactgcaagatacattaaaagaagtactttaggcagaaggaatgtaacaccagacaaaaagatgaatctccaaaaagaaacgaagaatgccagaaatggcataaatgaaagtaaatatgaaattaatttaaaatttttaattgctgtaaaagaaaacagattatctgtagcaaaaaaatgcagcaatgtagtgtttgtttatagcacagtaaaagtgaaatgcataacaataatgggatggaagtattggagatatactgttttaaggtccttctatttcatgtgaagtggtataattgaaggttagactgattattaaagacgtatacagtaaacagtaaggtaaccattaaaataattaagagacataaattacaagccaataacggagtgaggtgtaattataaaaaatacttagtccaaaggcaaaaaagaacaaaaaaccccataaaatctagcaagatggtagattttataaactatatcaataattgcattaaatataaatagtcttacccatgaaaagacagagattgttaaactggatatgaaagcaagatccaactatatggtgtctacaaaaaattcattttaaatataaagaagttaaaagtaaaagaatggaaaagatacaacacactaacactaatcaacagaatgctggagtagttatattaatatcagacaatgtacatttcagagccagatatagtatcaggaataaaaacattcaaaaatgataaattgggccctactcaccaagaagacatagctatcctaaatctttatgcaataaacaatagagcttcagaacacatgaagcaaaaactgacagaaataaaatagaaatagttccacatataacagttggaggttgcaatattcctctttcagttattaaaaaaacaggcagacacaacattaccatggatagagaagacctgaaaaacattaagaatcatcttgacagttacagaacactccatccaacaacagaatacttattctgggaatcaccaagatagaacacatagtgtgtcacaaaccaaaccttaaacttaaaatgactgaagtcagccgggcacggtgcctcatgcctgtaatcccagcactttgggaggccgaggtgggcagatcacctgaggtttgagaccagcatgactaacgtagagaaaccccgtctctactaaaaatgcaaaattagctgggtgtggtggtgcatgcctgtaatctcagctacgtgggaggctcaggcaggagaatctcttgaacctgggaggcggaggttgcagtgagccgaggttgcaccactgcactccagcctgggtaacaaaagcgaaactccatctcaaaaaaaaaaaaaaaaacctgaagtcataaaatacatattcttgaccatagctcacaaacattaactcaaaatagatcacagatctaaatttaatgactaaaactatacaacttttagaagaaaatatcaaggacaatctttgtgaccttgagtaaggcaaagatttctcagattatgacaacaaaagtctgattaataaaagaaaactgtttctccacctgtgaaatcagaaagcaaaaaaaaaaaaaactgaaaaagaggacttcatcatagttaaaaaaatttcttgaaaactgttaagagaatgacaaggcaaacaatagactaggaggtaatatttgtaaattatgtgtctcataaatgacttctatacaaaatacataaaaaactctcaaaatccagtaacaaaaaagaccttattttttttaaaaaataggtaagagatttaaactgataccatctgtgatactgtgatataagaaatatgcatttgctctttgtccccggttcctggcacagaactcctgaaacccttgtaattcctaggtgacaggagcatcctttattacagtatttggtctcagtccccagttatcgacacaagagttacaagatccttggcatttctggagtgataagtgtttttttggatgttagtaagatgagtggtggctgtgggcctctaaacagattcaagatgaaggcttgtcaccaaaaagaccaaggcataattagagagttgaaactttcatggccactcctctccctccagggaagggagagaggctggagactgagttagttaatcactaatggccaatgatttggagagtttctgggttgataaacatgtacacaggccatgagggtggtgcaccccaactccctagggttcgaagctcctgcgctctggatcattctagaccttgcactttgtgtatcacttcatctgggttgttcatctatattctttatataaagccagtaaatgttagtaaagtgattccctgaattctatgaatcaatataccaaattactaaacctgagaaggggcttgtgagtacagaaacagttttcctaccaccagtcaggggctagaaatggagaagttaactataggagcatataggggaattctgggggtgaggagacacttcctgatttcttgattgtggttttatatgttttgtcagaactctcagaactacacactaaaatgaattaatttcactgcacgtaaattatagcttaatttttttaagtaaagaataaaaccatgtatttttaagaaatttcaagccatctcctttaagaataaactaagttttctcaaatctttctatccaatatacattaacaaccttttctccataccaaaaatacactgatattgacctcggtaaaaataaaaatgagtgtatagcatggcaagttccaaaatgaatctttattatctgactgtaagcattccaagggcctatattataccaggttggagttagtctttgtattcttcaaagttcccacactttatttagacaatgtaaagtctgttatttatcaactctcctactgggaagttgagaattaacaggtgtggaagaaagaatatgacaaactgcttagatttacattccatcatagtgcttttttctaacctacagtaagatgcactatcacacaaggaaagtaaaagagagaaataaaaagtcagtaggaaagaatggataactgtgttcatgtattaaaactggccagatactaaaaaataattatgacatgtcacaaaaaatagactataatttcaactccaaaatgtccaggatttcctagtatttgttaaatttcctctccataatgcaataaaaaaatttaaatacaaaggttctacttattcaaagaagttaacaaagaatgatacaattgaaaatggaaaacaagaaagctttcatgatctttaacaaaatatcatacttcattcagcaagtatccaaatgctgaccatatactaattattacttaggcactaattaagcattccttaagcactgcttagtaaccaatgctgaacggtcaaaaataatttcagtaaaatactatttttaaagatataatggactttaaaaaaagagattacatttacctcaaagccaagtctatccttctccttccaaaaacaaaaatgcgttactttcttatcccagaattcatctggctttaccacacaaacaagggacacctcagctggaacaacattctataaaatacagaaaaataattacaaattacacatgtaaaatgaataatttactaaatttataaattaccagacagtcaagattatgctacataagagatttttggagaagaattaaaataataaagaagaaattctctagacttcaaaacatacatggcaataaagaagaacttgaaagacaaggtgattcagaaaatacttcaaataaaaaatgcagcataaattgtacatgtgaattactttttgttttactgaatctctgtactaggaatatgtttagcttaaactgtaagagttaatttttagttgggaaattattaaatttgatttttctacagtatgaaaaattttttctaacacaatcatcttggagaatttcttcaaaagacgtaaaatcaattttctcactaaaataagttttttatcagtcattatacaatgagaccaagattttacatgattattaacttgaagaagaggacaaaaagctaatctttgacgaatacaatttcacatttacttgatatggttacttatactacctaatgaactgaaatgaacatttatggaattaataaatatttcacatatattttatcaagtcctatagagtctaactttaaaatgcatcttaaatccaacaagttctaccgcctgcattgttaacaacgccaaactatccagctttctgaaatatcatcattacaaggctccttgcttgactttctcttgcactctgaatgaaattcaaatctcttaccaagacctacaaggcccttcaagctcaggcccctgttggcctctcagatctcatcttacaccttcccctgctagctcactcctccacaacagctcgctgctcctgcaatatgaaaagtctgttccacttcaggtctttgtccatgctatttcctctatctggaatgccctttgccttatacctaggagtgctccctcagtttatttaagattctattcaaatattccctcttcagagaggccttccctgtctaccctacctaaagtggcatcatctgactcagtctctttcactgctgtatttttcttcatagcatttatcaccatgggctgttacgtttgcttaactgcttattgtctaactcttcaagtagaatataaaataataaagataataaaaccttcccaatggcaggtaccttatctatcttgtcacccctatatttccagtgtttatgacaaatatctcacatatataatagaacacatgctataaatatttgttaaataaatgaatcctcattactaagtagatctcattctcttaattttacaggagagtaatttgagcttcagagaaacaaagtcacttgtctaagataacagagttaaaaagtcattgagctgaatagaaaccacctctgtctgactctaaagttctactacactacttcgtatgctctgaacctgggttcaatacattctttccgaaaggtccagataataagttattccaagctttgcaggccataatgtctctattgctaccactcggttctgtcaggatagtataaaagcagccacacaccacacaatatataaatgaatgggaatggctgaactccaataaaactttataaattcaagggcccaacctctgttctagaccataaattgcagcactgaataattataataataattactattattactattcagggaaaaatggaaaacctttggaggtaaacatgcacacatcataaatctagcatcctctgcaacaactggattgtgactaaggtaagtaaaataaattcaatgatatcaaaacttttaccagaggggctggaaaatttaagataaaattgagctttattcatatattgccttgtggaagattattatttcaaaatcattgaatatgaaagctgtgagaaagaagagaaaccacacccctcattttagagaataccagttataggcactgtggggtcccaaacagctggtcccagtaccttcggagatgaaagcaatgaatgacttcatatgtagaaactgtttgactagaagtaaaaaggccattgcaacttctgaaaatgttaactattaataaatccaaaagctgttaaaatacctatcagaaaagaaatcgcaagaggggattaaatcatccattgattgttcttcaaaactgccactgatcaaagtccagttcaaacagcaagtcccaaacagctcatctgtgacacagttgaaatgacaggatgaaaggaagaacacaaggtcataattaatggatttcttacctaatagttattttaacaactttcacagagaagagttaattctcaaggcttgaaatataaaagtgctggaagcacttttttttcaaagaaaaagttattttaggacaccaatttgtgctcccttaaactgatcctgcggaggctatgtcctttctaacccaaagagtgattctagcctgtaatctcagcgatttgggaggctgaagcagaaggatcacctgagctcaggagtttgagaccagctggagcaatatagtctctacaaaataaaaaaagtagccaggtgtggtggcgctcgcctccagtcccaactactcaggtggctgaggcaggaggactgcctgagcccaggagctggaggcttcagtaagccatgcaactgcactccaggctgagtgacaaagtgagtccctgatataaaaaaaaaaaaaaaaaggtgggatggggggattctcatgatgaaaagtttaagccaaacatttaagaagaatgaggcaatgggtagaaaattcagagaccacctcagcagacacatgccactggtaaatacacattttaaaatggataaagtcaaggcctggggcttacttagactatactaagttccaattttaagttatttaaaatccttgagcctcgttgacctctgtaaggttgtgaggccaaaattaaatgagataaatttatatagcaagcttagcacagtaccaaaaacataataagcactaaaactagaactaaaacctaaaattaccactttgttcctatcccttgaatccctttctcccaattaacctaaataaatgataaaacgttaaaaaccattctccttaattatcatttaaattttaaaattatatgcctttccacagaaccctaaagtagctaccttatttgttgaattcatttaaaattcttgatctttctttcaatatcactgatatccacttaagtgaattcttatgattccatgttactaccaacttatgtttcccctagactggcctgccatcaactactctcattgtatttgcttcattatgagctatatgtaagtcagagtacctgtgaggaaggccctcttgactttcatttaaattggataattaaaattttacctctctagaagcccttctacagaaggccaagtgcatgagagcaatctgccctccgcatcactcaaatgttttccttttccttttcaaatcatatcttcaatacccttaaaataaatcaacaaatgtctactgggtgcctactacatgccaggggatcacataaacattctgtgtggaacatgaggaaacataaaacacaagactggcatcagatctcaaaaagtttgtaatcgtagatgtttattaaatgttaatttgtgaggggctgaaattcctgaggacacagctggtaagtttcttctgggctacaaataaataagatcatcgtgaatcctgatgctttatgtaggaaataggggaccagaagagaaagacatgccagaatcacctgagaagtttcttcaaactacacttaaccaatcctaccacccacctatagtttcagaatggggtgcaagagggagaatgatacagacaccagagcatgcaagagctcccaggtgagtctcatcatttcaatgctcacacatttaaaatcactggcctcctttcttaaattacttaaacatgacatattattttcatttacaaacctattagaatagaggtgagatatacttaactgcttaaattcaaacctaaggagttgaatttgaacaatccaatagtgataagtgcattttcacaactcagtcactgctaggaagccaggcacagtccaataaattaaatgcatttgccattttcaccaggatctgttgctgtaaaataaaaaccatttcctgatagacaaaaccaaaattacctgtagcattacgactactgttttcaccacattccactgtgattttctgccatccacaatcacggtaaatcctctagccttacacttctcactgaaacaaaataaaattacaaagcattaaaacaagctccagatttcgttcttcataattctaaataaagaaggtttaaaacttaatcgcatatggagtagaattaatctcacttggtttagtttacattgtcaataaataaaattcttgagagtatcctttcattttctcaagcaatttatttttctcattttaggaaatgttcacaatttacaaactaatgtggcaagaaaattattctaaaagcataaaagtcaatgtcttaaaaagtaaagacatcaaagcaacattcaaacagtcctactagtctctcaatttcttcgtctgtaaaatgggatcacagtgaagtaagttactaattgccaaatgtgttatatatttcttgtctcacctacctgccagaagtataagatttgtgaagtcatagttcaaaacagatagaaaataaagtaagttattaataaaccacaataatgggcttcttagcgttcctttggagaaatttaatgagatgaggtagaacttgctgattcaaaagcttggacagaccatgtctaacccacttatgctctcacttttgcattgtcagtcacaggaccagcaaaatattatcttcagtgttggattcctgtattacattgagtgatttaactattaactaaacacttcccagaagtctaacctagtaaaacgcaacaacttctggagggaaaaactccattctaaaggccaaaactacatacctatcattatcattgttattattattgtgtttacttatcaacttaatgtaaggatctcaattgctctccttccaatacagtaaatggaactacagctttgcttatcagagcaagattttggtagtgaaacctgtccccatccaaactgttcccagttacatacattatagggaaaaataaacagaccttttcctgggatttaaatccaccaccagttcaggggactttactagtcctcctcttctccctccaagcatgcacgctagttccaagaaggctcttggagaagtcatgccctgttctaccaagaaacactaagaccacaagaaatgaggatgatattgctaaaagtttagagtgggagggaacagccaagcactgaagctgagcttccaaagtaaacaaaagagtattcaagaggtaaggcaaactgatgcatatgttcacacaaaaacctgcatgtaaatattcacagcagaataattcataatagctgaagagtagaaacaatccaaatgtccaccaactaatgaagaggaaaacaaaacacagtataaccaaacaatgagacattattcagccataaaaaaagaatgaagtactgacagttgctaaaacatggctaaaccttgaaaacattatgctaagtaaaacacgccagacacaaaaggacacacactgaatgattccatttatatgaaatgtccagaataggcaaatctagagacagaaagcagattagtggttgacaagggttaggagggaagaatggagagtgagtgccaatgggaacacagtttattttgggctgataaaaatgttctgaaattagatagcataatggatgcacaacctgtgaatatactaaaaatcaccgaattgtctactttaaaaagacgatttttgtgacatgtgaattatatctcaataaaacaaaagtactctatttttggatgcgcatcacaagataaaggatccactaaatattccttgggaaaaactaaaggtaaggccaatacagtgatcacttgtgggttagcaaaagaaaataaaagacttgcagagggggctaggcgtggtgcctcatgtctctaatcccagcactttgggagactagagcaagaggatggcttgagccaaggagtttgaggccagcatgggagaccagcaagactccatctctatttaaaaaaaaataaaagacttggggagagaaacaaacctgacacacaatgactatctgtgggctcaagtaatgaggggactcctggagttctccaccaacaaaacatctaagaagaccaccatgacataggagaggatacaagcccaagagtgatcagctaggcagggtagctggctgttgagcggtctggagtagtggcaacaatgcagggattctaccaatgcctttttcaggaaggagagctaagacacagcagtccaggagagggccttcccaccaacagaaatgtgccatgtgccattctcataatgtgatactttctcaacactggcatctgtatccctgagatgcaggttacacaaccgttttgttaaatacattttatacaagcaatacatttatatttcaaagcacactataaattaatctgtacattaagactaagaaagtaatgaagcttgcaaataccatctgtagtgatcttaaaggaataaaatactctaaatttatctttcagagtacttagaaacacgcttaactctgtcacattctcacattttactaagatggataatgaaaatacacagaatccaaagataactatttcaaaattgccagaccaagtggtctttcaggtacttgaaaggaaatagttttgttttttgcttcatccctgtaagtggaatgatggcttaaactgcttttaacaacatatttaatttagaagcatgttataccctttataaagggcctgttgtaggacctgaagtgtcattaataacaaattcctatagccactgttagcatgtttataactatactttaagaacagtaatagaaaaaaaaatctaagacccagcctcctagttcctagtccagttgagcctttcaagggtgacatagctgagttaaaacagctatgtaaacgtgaaactgtctaaacagtccactcacttttgacacagaagacaatgttagtggatttcctggggccaacatcctgcagatcttcactcatttctttgattacaactaaaggctccttctcttccactcatacagctctgctggtacttacataatggcactaatttcacttatgcttttattataattacttgtttacaattcatcttcattagataatatgcttccagaaagcaagaatgttatcttacaaatgtcctggcagcttctagcaccatgctttaaatatggagtgcctttaataatgttagatgacacacatcacatcactcctcagacacgacaatagctttccatctcattcagaatggaagccattgcctacatggtcttccatgacctgactcctgactctcttctgatccccctcccagcactgtgctcctctctcaaactgttccagccacactagcctccttgatgttcccagaacatgttaaacctgctcctgcctcagggcctttgcacttcctgctcactctgtcttcaatgctcgttgatcagattctgtagggtctgcctctcctttcaatcatctctggtaaaatatcttcttattttgtaaagtatcaccactctatcactctgactcttttcatgctttgttttcatagcactcatgaatatccaaaatactgtacacttagtatctgaaacacaaaacaaacttagggccaacctgtgtagaaaagagtcaagaaatgcttccattctcaactgtgctaggttacccacttaaaatagctatgtatcacactttgtccctgtgttcattaaaaataagcacaaagtataagaaattgagtaatttctttttatttttgcaagaattttgaaaagctattattatattcaaaacgttaagatagtcattgcatgaaaaaaacaattttggacatctcctattaggaagaggctaccttagctagctacactgctggagatgttggcagatgttcacagctggaaggagttaaacattaacagctggaagctgggagacaaaagcaggtcacaaaagaatgtagatacaccagaaatgaaaaaacctttctagacacatgctgggcctgatctgctagggtaaacttaaaaacattcctaaggacaaaaagaggggtgaaacatgggagataacgtgataaaaacaaagtacattattagttttagattttctaagtggtggacatatgggtgtcaccgtataattccttcaactttcctgcatatatgaacattttaataaaatgttggggggttacgttttaaaagcactcctgagtggtggaaattctgaatgaaaaacattggttttaagatcacacatctagttaactgctctctagcatcgcaatggagagatcaaaaacaccttagctctctaaggaaatggcaagtacggataaaaagctgacagccatgtttgttaatcccaaaattatgggaggctgatccaagaaagcagaaggatagagttttcatgaatatttgagaaggccaaactttagcaaaacaatcataagaaataaagtatccaggtatctattttgccttgctagaatgagttctttcatcttgcttcaacttacaccttctctgctagttggcaggtacgtgtagatatgcagaaactgattcatcatttacactggaggaacatcatatgcacatttacatgagaaagagaaagaaaaaatttaaatagtataggctattttgccttccactgtacttcctgcttatccacgccagagtgaacatgagcccagagatgtgaatgaatctgctggtcctttagcctccctcagttacccagtgcctcggacaggtgagcatcctgttgaactgaatgtgattccagtatacacaaacatgcattttcttaaaacaaacctaatcacaagccaactatgtcttctggaattcagtgtgaataacttgctccaatgctgaaggaaaacctaacatgttcatggaaagataatacagtctctgatccaccctcaggcatttttcaagagtaactttgacaattaggagtttttgcttttcatttgaacctcagaattggacttcacatgagatgcaactacactgaattctactcatctgaagtacaaaaaggctctaaattggtgtcaggaatcatggactctcatcccagctgtgcgactcactaggtgtgagatcttgggcaagtaaccataacctcagagtttcaatttcctcaactacaaaataaggcacttggctcagatggcacttgacatatttaaccttctatgaatccatctatgaatatttttttcataatttgtaagctataagtctggctaaccatggttacctaaaaagcagtttgttatctaatgatgaacaagttagcaatccacagcttgggggattagcaagattactgctaatgcaattagctaatgctaatactaatgcactgactacaggttctcatcattttcacccccagaaactgaaaaaattgaaaattttcacatgaagaccgctgtttccacaatattaaaaaaaaaaaaaaaacagcaacagaatcattaaattatagaacactattggatgcaggtgcgattaaaatcagttgttttaaccccatactctgcaaggtggtttaaatggaaaaaagctattgtgtcaataaaatgcaaatacaggaaaaacatacaaagaattgtttactctgatgaaaatgtttaaaattcactagctagaacttaagagcagtatatgagatagtcgtgttcctttttctacctctacattgtacacacacaaacacacacacacacacacagaaacctgccctcatttacatgcttaattgtagtggtttacaaatctggttgcacattagaaatacacaggaagcttaaaagactttttaaaaattctgataagcaggcttcccaagaacaattggatcagaatctctggaagtgaaccctccatcattagaattttgaaaaaaatctccagatgactaatacgcagtcacagttgtgcctcagtcccaattatgggagaagcagatggggaggaagctttatttttttttgttgaagtcatgggtagactaggacaaataaagagggttaagttgggtcttcactgaagaaatgtgaaaattaaagttaaaggccctttagattaaaatataaacaaacatttttgacattttttaaaataaaaatatttataaactcctaatagacttcactcacttaatacattaaaacctgcagacgtatttatatcaatatggtgaaatagcttacctaaataaaagatgttttctactgattaaattctccaattttcctaaagttacatgatatagatgcttagttactgggttccttaaaagtcgacaatacatacattttggaaatctgtatatccttaaattcatcaagagcataaaataagcattttatctgcaatgatgttataagtcattgattttagtatctataattataatttcactgcgaataaaagcagataagatagcaaagtataattcaacaatagaaagaatcattagtaactgaatgaaaacatactgagatttaagaaaagacacctttagagtcaccttggaatgctgagtaggtagtctaaggtgacactcagctcatccatatttgtctgttcgaggcataatggaattgtcaaaatgaggccactccgtctgtcttttcctcctattaaaaaagagatttaaatttaacatgtaatacatattaaggcataatctgaataatatacatttgaatccaatcttactaaaataatgataagtttaagatataatttggaaaatatctaatggctacttatagattgtaaatttttatgatagtatagaagaattacagaaaatttagaaaaaaggaaaaaaattcacccatgaaatcttcacccaaacatagcaaatatcactttatttaaatttcttccatttactgtccttaatgtaatcaattcatcaaacacctctcacgtgcccagcacagtaagtatttgcaagtaaaataaaataaatttccaatcaacctaggaagaaaatatttaggagataagaaatatgatagtttgttatgttctataagatatataaaattataaaaagggatttagaaaatgattaagagctgcagtaaatgtgaaaagtttcactgaaaagttaagacttgagaaaaacagagctgggggtattggcgtgtctgtagtctcatatcccagctactcaggaggctgagggcgagagtatcacttgaatccaggagtccagtactggccggggcaacatagcaagattgcatggaaagaaagaaaagaaaagaaaggagagagagagagagagagagaggaagagagacagagaggaaggaaggaagggaggaaacgaggaagggaggtagggagggagggagggaaaggaaaacgggtagaatttgtaaaccaagtcaaaagagtattctgtgatgaggaatgatctgagttaactcacaaaggtcagacaggcatatactgttcataagacaataaagataaaaccctgcccagctgagaagggtacatgggaactggatattgaagtctgaaatcccggtagtagaatacagttacattccatgtacgttcaagtccctttcagtgtgccaaaagtataatgtaacttttaaatacttttatgcccacatcatgtctttggaagtttcctacatgtttgaatttcatactgaagcccatcttctgaccaaactgacatttgaggtaatttgagaggcttaaaaagcagcaaatactgaaagaaacaattccacatgatcgctagacatctatcactaaaaactgaaaggtgtgaagaaaaagactcatattagtgacacaaatgcaattcataacatatgaaccataaatgaacctctgtcctccattaggtcaacgattactgccatccaaccactttgtttaatgtcaacaaattatcatctaaggtgattcaacttagtaatcaatcaatacgacttcaattgcctattttttgttcagaatatgtgtcatttctcaaaaaaaaaaaatggattaacacaagtggttttcaaactgcatcccctgaatgactctgttggtttgaaaaaattttctctattactaaaaaagtttgaaaattactggcttaaatcatcaatggtcaagagagggcgttaataggaacaggctaagaagtctttcatttactcctcaaaattgctaagctttatccacccattaagccaagccccaaaaaaggctcacacctggactatggcactctgactcactgtagaattgtctttagaagataaatttaacattcagggctatatttaaatccattccctcagctttcattcagggacaataaaataatcaccagtgtaaaagtaccagaggggtgaaagccaacaggaaaaagactttcaagatagttatggtcaaaagcatcaaatgctacacagagacaagcatcacaagatgcaaaaatgtcatggtaaagattataagagaataatagtgtctactattgaaaagagtgtgagaacacaggcattttcacacaccattggaaaaaataggaattgaaacaatcttcttggagggcaatctgacaaaacctaacacaaatataaatgcatattatccttataccacttctactcataaaaatgcatactgctgaacttgtacaaaatagacaaagctttccaggtatagaagagaaaaaactgcacaaagctatgaataagaatatttacaaaatcatcattcatatcagagtataatatataatatagcatatattaatattatacattgtattaatatagtattataaattcaatatatattacatattgtatatatagtatatgtaatgtatataatatagtatattctatattgtataatagtaatatatagtatatgatatactatatattacttatcatatatacaatatatattatatcgtatattgtatattatatattgtatatatgtaatatatgatatgtacatatgttatatatgtatataatatactatattatatattgtatattatatacatatataacactattatacaatatataatatagcatattatatacaatatagcatatacaatatataatatagcatattatatataatatagtatattatatacaatatataatatagcatattatatataatataatatagtatattatatacaatatataatatagcatatacaatatagtatacaatatataatatagcatatacaatatagtatattatatataatatataatatagcatgtacaatatagtatgttatatacaatatataatatagcatatacaatatagtatattatatacaatatataatatagcatatacaatatattatattatatacaatatataatatagcatatacaatatagtatattatatacaatatataatacagcatatacaatatagtatattacatacagtatataatatagcatatacaatatagtatattatatacaatatataatataatacatactaggaaaacatgtcaattatacagagacataacatactttgaaaaaaggacattagtattatcaaggcaattaggacaggacataaaaaagaataatagagaaagcaagataatgcagtccaaataactctgagttggcagagctacagtatctatactaaatcatgtagagatttactcaacgatctaaactccagaagatcactacacccaatgtaccatacatacatgctcccactcatagcttccccttgactcatcttagctgatacacacttcaagttgataactgaagataaattcaagtgtatataaacagttttgaacagcaaagagtgaaaacagaataatggatattaactcctccagtgtactgaaactttctcagaggaagatggaagaaaaaagctagaagacagttatcataaaaactaattattctgtatttcagaaacaattatttggatgccagttagtcaattattattacattttcatatcagaagtgagacatcatgacatctaccttgtagaggtcattttaatgaaattacagaacaggataagtatcagaagactgtattttcagggaatttttttttttttttttttttgagacggagtcttgctctgtcgcccaggctggagtgcagtggcgcgatcttggctcactgcaagctctgcctcccaggttcatgccattcagggattatttttacagttcattcctagagagctttctccaaatgtgtagagcatcaaaaatcttaaaggaggctagagaagagtcagatcacacacaatgggaaccctgtcaggctaacagtggacttctcaggagaaacattataagccaaaagagactggaggcttattttcagcattcttaaagaaaaagatttccaaccaagaatttcacatcccaccaaactaagctttataagtgaaggagaaataaaatcttttccatacaagtaattccaaagggaattcattaccactagaccaaagagatccttaagggagttctaaatatggtaacaaaagaacacctgctactacaaaaacacatttaattacatagcccacagaccctataaagcaactacgcaattgagactacaaagcaaccaggtaacaacttcaaaataggattataacctcacatatcaatattagccttgaatgtaaaaggtctaacaccccacttaaaagacaccaaatggcaagatggatccaaaaaaaagatttggccaagcacagtagctcatgcctataatctcagcaatttgggagactgaggtagaaggatcacttgagcccaggagtttgaaactagcctgggcaatatataaggacacctgtctctacaaaaaaattaaaaatgagaaaattagctgggcatgatggcacatgcctgtggtcccagctagtcgaaaggctgaggtgggaggactgcttgggcccaggaggtcaaggctacagtgagctatgatcgcaccactgcactccagcctgggtggcagaacgagatcctgtctcaaacaaacaaacaaaaaacaagacccatccatcttctgtcttcaagagacccatctcacatgtaatgacaatgacaggttcaaagaaaagggttggggaaagacctattacacatatacaaaacaaaaaaagagcagggatcactattctcatatcagaaaaaacagactttaaaccaacaataataaaataggacaaagaagagcattacataataataaagggttcaattcaacatgaatacttaatcattctaaatatatacacatgcacccaacattgaagtacccagattcataaaaaaagtaattctggacctacaagatgaattagacagccacacaataatagcaggggatttcaacactccaccgatagagttagacagatcatcggggagaaaacaaacatattctgaacttaaatttgacacttgaccaactggacctaatagacatctacagaacagtctacccatcaaccacagaatatacattcttctcatctgcatatgaaacatactctaagaccaaccacaggctcagccataatgcaagtcttgataaataaaaaaaacttgaaatcataccaaccatactctcagatcacagtgtaacagaaatagaaatcaataccaagaagatctctcaaaaccacacaattacatgaaaattaaacagcttgcatttgaatgaatgttgtgtaaacaaaattaaggcagaaatcaaaaaattgttttgagataaatgaaaacagtgatacaacgtatcaaagtgagcgagtcacttgagctcatgaatttgagatcagcctgtgcaacacagcaaaaccccatctttacaaaaaatacaaaaattggctgagtatggtggtacacacctgtagtctcagctaattgtcagggctgaggctggaggatcgcttaagctcaggaggtcaaagctgcagccagccttgtttgtactactgatctccaccctagactgagtgacaaagtgagatcctgtctcaaaaaaaggggtggggggctgacaacaccaaatgatacacaagatcaacagaccactagctagactaagaaagaaaaaaaagagaggagatccaaataaggacaattagaaatgacaaggtgacattacaactgatcctacagaaatacaaaagacttctgtgcacactaactagaaactctagagaaatggataacttcctagaaacacagaccctcccaaggttgaatcataaagaaactgaagccctcaacagcccaatattgagttctaaaactgaattggtaatttaaaaaaatctaccaatcaaaaaaagccctggactagatggattcacagccaaattctaccagacatacagagaagagctagtaccaatcctactgaaattattccaaaaaattaaagaggagggattccctcttctgtaaagccagcatcatcctgacaccaaaacctagtgaggtcacaacaacaaaaaaagcaaactaaaggccaatatccctgatgaacagagatgcaaatatcctcaacaaaatactagcaaacggaatctcacagcaaaccaaaaagttaatcctccacattcaattaggctttattcctgggatgcaagatcagttcaacatgcacaaatcaataaatgtgagtcaccacataaacagaattaaaaaccatatgatcatctcaatagatgcagaaaaagcctttgataaaatccaacatcctttcatgataaaaaccctcaataaactatgcattgaagaaatacatctcaaaataataaaagctatctatagacaaacccacagccaacattatgctgaacaggcaaatgctaaaagtattccccttaagaactggaaaaaaacaaggatagccactctcaccacttgtattcaacatagtactaaaagtcctagcaagaaccatcaggcaagaaaaagaaataaaaggcatagaattagaaaaaggaggagtcaaattattgctcttcgttgactttatgtttctatacctagacaaccctaaagcctccaccaaaaggcttctagaactgataaattacattagtaaaatgtcagggtaaaaaaatcaatatacaaaaataagttgcatttccaaacaccgatgacactcaaactgagagccaaaataaagaacatattcccatttataatggccataaaaaatacctaaaactacacctaagcaaaaaggtgaaagatacctacaaagagagctataaaacactgctgaaagaaataacagaagacataaagtaatggaaaaacattccatcgtcatatttaaaatgttaaaatggccatacagcccaaagcaatctacaaattcaatgctattcatatcaaactaccaatgtcaattttcacagaatagaaaaaaactaaagttcatatggaaacaaaaaaaagcccaattagctacagcaattctaagcaaaaagaaaaaatccagagatactacattacctgtcttcaaactacactacaaggctgcagtaaacaaaacagcatggtactagtacagaaacagacacatggaccaatggaacagaatagagattccagaaataaggtcacatacctatagccttctgatcttcaacaaaacacgcaatggggaaagaactacctatttaataaatgatgctaggataacttgctagccatatgcagaagaatgaaactgaaccatacctttcaccatatacaaaaattaactcaagatgaattaaagacttaaacctaaggcctaaaactataaaaatcctagaagaaaacctaggaaatacaattctgagtatcggcctcagaaaaaaaattatgactaagtcctcaaaagtaactgcaactaacacaaaaattgaaaagtaggacgtaattaaactaaagagcttctgcacaacaaaagaaactatcaataaacagacaacctacaaaatgggagaaaatattcacaaactatgcctccaacaaaggcctaataccaagaatccataatgaacttaatcaattcaacaaggaaaaaacaaataaccccattaaaaagtgggcaaaggacatgaacagacatttctcaaaagaagacacacaagtggccaacaagcatgcacatcacagataatcacaggaatgcaatcaaattgacaatgaaatatcatctcatactagtcagaatgtctattattaaaaagtcaaaaaaataacagatgctggtgaagctgcagagaaaaggaaatgcgtatacactgttggtggtcatgtaaattagttcagtaactggagaaagcagtttggagacttctcagagaacttaaaacaaagaatctacaaaacaatgtattttcctttgggtatatacccagtaatgggattgctaccattcaatccagcaatcccattactgtgtatatatccaacggaaaataaattgctctatcaaaaagacacatgcattcatacgttccttgcagcactatttataatagcaaagacacagaatcaacttaggtgcccatcaacagtggaatggataaagaaaacgtggtacatatacatcatagagtactatgcagctgtaaaaaaacagggaaatcatgccctttgccacaacatggatgcagccagaggccatcatcctaggtgaatattgacacagaaacagaaaaccaaatattgcacattctcatttgtaagagggagccaaacattgggcacacatggacataaagatgggagcaacagacactggagactactgcaggggagggagagaaggggaaaagggctgaaaaactacctactgggtattatggtcactacctgggtgaggagaatcaattataccccaaaccttagtatcatgtaatatacccatgcaacagacaggcacatgtaccccctgaatctaaaaaaatgaaattagaaaaataaattggcctgccaagaaccagtacagagttagctctcctagctcttcattctgatttaaagatgtcttagaaataccttttaaacaaaactttcattaaaaaaaaatgcatctgtcatacttaacaaagaagaaactattaaaaagtttgtatatcaaacacttcaaattttaagaagaaatcatacctgaaaggaaggctagttttttcttcagaatgggtaatattactgaggcctccattttactccagtgaacttccttaattctgaaaacacagaaagtcaaatgtcaactacaagacaacaattattccacgaaatatatcctaatgatggtttatcccagagtttctaaacctgagaactactgacattttgagcaagataattctttttttgtagggagttatcctgtgcattgtagaatagtttgcagcatccctggtctctctctactcactaaaaaccaataccacctccctttcccagctgtgacaaccagaatgtctctagacatggccaaatatcctctggtaggcaaaatcacaagtggttgagaatcactggcttaattctttctcagagcaatactcgggctaaaacactgcctggtacatactagtaactaaaaaattaatttgttgaataaacaaatgaatcaatcaaacaggcagtcaatcttcctttgtgttccttattaattacacagcttaatgccaaatatctgattctttccatttcactattaaatggctttttctgatttctcatatttttgctcccctataacacatggtaccacatcttatcctgtttatctcactacattttctaatacattgtttcaatttttgcccccattgttaactgcctccatctctctacattttacagtttttaattttccagggaaaaatttgattaggccagctcatctttttgtaccaggccacaattcactattctttgattcagttttccagggtctactcagccatagccaggggttatagctaaatacaaaaagggactacccttatagcaagggctaagggcaagatagtttcccttaaatggaggttttgccatggcaggcattcaggcttggccagcccagtataccatcaaattttgattttaaggagagcaggacctttcaaacaaaacaacaacaaaaatgaacaaaatcagattcaattctattatcctcttatactcatgtctgagagagtattctcaatcacattttatcccttcctcccctatcccatctcacacccacccaccatcacaacacagagcagttccttgaagtacactgtgaaattttattgtatttagtgaaagcatattctcttgaagacatttctagaacagcagaaaatatgactctttgtatgagtatattacttattcagcaaacacctgctattaacctatcccacctaaggctgtgctaccagctagagctaaaaactccagaaacagccctgctctagggggtgggaaaaaaaggcagtctttaaaaaacaaacaaaaaaatagatgttgaggaaaaaaaaagatggagttgtaacattggtcagataatggctaattaaacaagactaattaaaccagtatataattttatagcttttgagtttacaacttaaaaaacacaaccatttgcatctgtcttcaaagaaaacaagttgtccatctagatgatatattcaagttcccttgaatatttgcgatttgtttattcaagtttgttctatattagcccggcaaacagactagtaggaagtagaaggaaaaaagctcacaatttacatctttaatctaaaactagtagcacttcatgatgagttgttatccagttatacaagaacccagacagcttggattcacatcttaaatctcctgtcctgtgaccagcttgttgaagacctgatttgaaagtttgataaaggggtgataataattattataattaacattgactaagtgtttattataaactatgcactgttttaaacgatttctttttattatcttagtcttcacaacatttctacaaggtaggtactattattttattagccccaaacagcttgttgttttccagtcccatcatgggacaaaccccgtctattccttcagacttatctctgggttgcatcctaaaataatggataaatctgaccctcagactctcaaaaacaaagtttaattttcttgtgtaatacaacatggccaccttataaactttcagatcaggaatcctcccggccaccaggtgggacccttgccccagtactattttacagcttgaccttttctgttgcaactcttttaaatggtctgaagttcctattccaggctttcataactcactctctcgggatcctgatctccaccaaatctgctgaatgtgcatgactatattctctggccccactggctcttttgacattttggatggcctttcttttactctctcccattctccccaactagctggatgggttgaggccacaccttcttcccctaacaaaccaccttcacattcaattacacctactccatctgctccctctctctcaccttcccctcaacatcccaacctttgatgttgttttccagtgcctcctccttatcagggattctactccccttctcatactaggtcagaggccacctatgatctcattttggcctcagaaaaagttctgctgctccaggacgtggcaaatggggatctaggaaccatcagagtccatgttcccttcctaatgtctgatctttcccaaataaaaactaagctttggctctttcagtaggggccctcctcatttcatgaaggaatttacaggactattgcttccctctacctcacttggcaggacatgtatattattttttaccacatattgcacccatgaggaaaaatcccacatatggtctctggctcaaaggtgagcagatgaagtgcataccccaaacccccaggagtccggccctgggagaacggcaatgccttacactgatcttaggtggggttatcaagagggagaccacagaaggaaatatcataatcacatgatcacttgcctgattcagagcatgaaaaaggccacataaaacttgtaaattatgccaaactaagggaaataagacaggggtcaaattaaaacccagccctattttataccaagctggctgaggctatgagaaaatatactaatatgaacccccagagcccagaagacctcactgtcatagctgtttatcagccaggcatccccatacatcagacatgaactccaaaagccagatcagagaccacaaactactttcccaacattgctggacacagccttcaagttcttcagtaattgagaacagaataaggggaacagagctacagagaaagaaaaatgcaaggacaagagacaggcttaactgctggctgctttagaagcctccagcccattctagattgtcctaaggacacttctccaagtaagtgttcttgatgcagaaggacaggccaccggatatggtttgactctgtgtccccacccaaatctcatcgtcaatccccatgttttgaggaagagaattgtaatctccatatgtagagtgagggaagtgattagatcatgggggtggttcccccatgctgttcttgtgatagtgagttctcaagagatctaatggtttcataaatggcagtttcccctgccctccttacttctctctcctgccaccctgtgaagaaggtgtctgcttcctcttctaccatgactgttaagtttcctgaggtctccccagccatgcagaactgtgagtgaattaaacctcctttgtttacaaattacccagtctcaggtatttctttatagcagtgtgaaaacagactaaatagaaacttcaacttagatagtcatacttcaggggtttaaaatatagcccacacttattcaaacaagccctagcaagaaagctaattgaacaatctcttaagaggggataacttctacagtatgtaaattacctcctcatttgatcctccttcacagaactcacacagcaaatgaaacggaaaccttaacttcccaacaaaaggaaaataatttttccctaattcacaggttacgtaaaggttacatatgaaacaagttaaaaggaaccagggaataagagagacatgaagaaggttataaaggtaaaaaggcattttgggaaaggaaggttatttaaaaaaaaaaaaagacttcgtatgagaaaaaaaatctcgtatggtaaattcttgtcctaaaatagaataactggttgtttaagacagaggaatgtgggaggagccaagatggccgaataggaacagctccggtctacagcccccagcatgaacgacacagaatacgggtgatttctgcatttccatctgaggtaccgggttcatctcaccagggaaggccagacagtgggcgcaggtcagtgggtgcacgcaccatgtgcaaaacgaagcagggcgaggcattgcctcacgcaggaagcgcaaggggtcagggagttccctttcctagtcaaagaacggggtgacagatggcacctggaaaattgggtcactcccactcgaatcctgcgcttttccgacgggcttaaaaaacggcgcaccaggagattacatcccgcacctggctcggagggtcctacacccacggagtctcgctgactgctagcacagcagtctgagatcaaactgcaaggtggcagtgaggctgggagaggggcgccagccattgcccaggcttgcttaggtaaacaaagcagccaggaagctcaaactgggtggagcccaccacagctaaaggaggcctgcttgcctctgtaggctccacatcttgggggcagagcacagacaaacaaaaagacagcagtaacctctgcagacttaaatgtccctgtctgacagctttgaagacagcagtggttctcccagcatgcagctagagatctgagaatgggcagactgcctcctcaagtgggtccctgacccctgacccccgagcagcctaactgggaggcaccccccagaaggggcagactgacacctcacacggctgggtactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagaagaaaaacgggaaactctgaaaagcagagcgcctctcctcctccaaaggaacgcagttcctcaacaacaacggaacaaagctggacggagaatgattttgatgagctgagagaagaaggcttcagacgatcaaatttctctgtacctacgggaggacatgcaaaccaaaggcaaagaagttgaaaactttgaaaaaaatttagaagaatgtataactagaataaccaatacagagaagtacttaaaggagctgatggagctgaaaaccaaggctcgagaactacgtgaagaaagaagaagcctcaggagccgatgcaatcaactggaagaaagggtatcagctatggaaaatgaaatgaatgaaatgaagcgagaagggaaatttagagaaaaaaaaataaaaacaaatgagcaaagcctccaagaaatatgggactacgtgaaaagaccaaatctacatctcactggagtacctgaaagtgatggggagaatggaaccaagttggaaaacactctgcaggatattatccaggagaacttccccaatctagcaaggcaggccaacattcacattcaggaaatacagagaacaccacaaagatactcttcgagaagagcaaccccaagacacgtaattgtcagattcaccaaagttgaaatgaaggaaaaaatgttaagggcagccagagagaaaggtcgggttaccctcaaagggaagcccatcagactaacagcagatctctctgcagaaactctacaagccagaagagagtgggggccaatattcaacattcttaaagaaaagaattttcaacccagaatttcatatccagccaaactaagcttcataagtgaaggagaaataaaatcctttacagacaagcaaatgctgagagattttgtcaccaccaggcctgccctagaagagctcttgaaggaagcgctaaacatggaaaggaacaaccggtaccagccactgcaaaatcatgccaaattgtaaagaccatcgagactaggaaaaaactgcatcaactaacgagcaaaataaccagctaacatcataatgacaggatcaaattcacacataacaatattaactttaaatgtaaatggactaaatgctccaattaaaagacacacaatggcaaactggataaagagtcaagacccatcagtgtgctgtattcaggaaacccacctcacatgcagagacacacataggctcaaaataaaaggatggaggaagatctaccaagcaaatggaaaacaaagaaaggcaggggttgcaatcctagtctctgacaaaacagactttaaaccaacaaagatcaaaagagacaaggccattacataatggtaaagggatcaattcaacaagaagagctaagttcctaaatatatatgcacccaatacaggagcacccagattcataaagcaagtactgagtgacctacaaagagacttagactcccacacattaataatgggagactttaacaccccactgtcaacattagacagatcaatgacacagaaagccaacaaggatacccaggaattgaactcagctctgcatcaagtggacctaatagacatctgcagaactctccaccccaaatcaacagaatatacatttttttcagcaccacaccacacctattccaaaattgaccacatacttggaagtacagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaacgagaacacagacacaacataccagaatttctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcggagttaaactgaaggaaatagagacacaaaaaatccttcaaaaaattaaagaatccaggacctggttttttgacaggatcaacaaaattgatagagcgctagcaagactaataaagaaaaaagagagaagaatcaaatagacgcaataaaaaatgataaaggggaaatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggatctgaaattgtggcaatattcaatagcttaccaaccaaaaagagtccaggaccagatggattcacagctgaattctaccagaggtacaaggaggaactgggaccattccttctgaaactattccaatcaatagaaaaagagggaatcctccctaactcattttatgaggccagcatcatcctgataccaaagccaggcagagacaaaatcaaaaaagagaattttagaccaatatccttgatgaacattgatgcaaaaatcctcaataaaatactggcaaactgaatccagcagcacatcaaaaagcttatccaccatgatcaagtgggcttcatccctgggatgcaaggctggttcaatatacacaaatcaataaatgtaatccagcatataaacagaaccaaagacaaaaaccacatgattatttcaatagatgcagaaaaggcctttgacaaaattcaacaacccttcatgctaaaaactctcaataaattaggtattgatgggacatatttcaaaataataagagctatctatggcaaaaactggaagcattccctttgaaaactggcacaagacagagatgccctctctcaccactcctattcaacatagtgttggaagttctggccagggcaattaggcaggagaaggaaataaagggtattcaattaggaaaaggggaagtcaaattgtccctgtttgcagacgacatgattgtatacctagaaaaccccattgtctcagcccaaaatccgcttaagctgataagcaacttcagcaaagtctcacgatacaaaatgaatgtacaaaaatcacaagcattcttatacaccaacaacagacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggtagaatattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcatcaccaagtcaatcctaagccaaaagaacaaagctggaggcatcacattacctgactttaaactatactacaaggctacagtaaccaaaacagcatggtactggtaccaaaacagagatatagatcaatggaaccgaatagagctctcagaaataacgctggatatctacaactatctgatctttgacaaacctgagaaaaacaagaaatggggaaatgattcactatttaataaacggtgctgggaaaactggctagccatatgtagaaagctgaaactggatcccttccttacaccttatacaaaaatcaattcaagatggattaaagacttaaacattagactgaaaaccataaaaaccctagaagaaaacctaggcattaccattcaggacataggcatgggcaaggacttcatgtctaaaacaccaaaagcaatggcaacaaaagacaaaattgacaaatgggatctaattaaactcaagagcttctgcacagcaaaagaaactaccatcagagtgaacaggcaacctacagaatgggagaaaattttcgcaacctactcatttgacaaagggctaatatccagaatctacaatgaactccaacaaatttacaagaaaaaaacaaacaaccccatcaaaaagtgggcgaaggacatgaacagacacttctcaaaagaagacattaatgcagccaaaaaacacatgaaaaaatgctctccatcgctggccatcagagaaatgcaaatcaaaaccacaatgagataccatctcacaccagtcagaatggcaatcattaaaaagtcaggaaacaacaggtgctggagaggatgtggagaaataggaacacttttacactgttggtgggactgtgaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgtggcattatccacaatagcaaaggcttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaactgaacaatgagaacacatggacacaggaaggggaacatcacactctggggactgttgtggggtgggggtaggggggagggatagcattgggcaacatacctaatgctagatgatgagttagtgggtgcagcgcaccagcatggcacatgtatacatatgtaactaacctgcacattgtgcacatgtaccctaaaacttaaagtataataataataataataataataataataataataataaagaaagaggaatgcttaggacaagtcacaaagtccaagcatgtcaaaaatagtctgtgtaagtcataagaaggtttgtaaagggaaatttaggaaaggaattttgtatgtgattaagttggttataaatgaaagggaattatttaggatagtctttctaacattgcctctccccatgttaaaacaaggttttcttacggtattaatctgttcttaataaaactgcaagttttacttttcattttgtaacgtttatttttaaaacttctcagaatcatctcagtttaacttttgctgtgtcccgctactttctgctttttctcccctaaagaaggcctaataaaataacactccccagtttttgtcacctcctgtcacattttcctccaattctaactgttattatggcctaatgttaacattagcataatattttaatgtttcaactttaagtcaaaaaatttaagcaatgttttcctcgaacataatttaattcggacccttggcttttcttgatatgtctaaattctcaatgtaatcaaaaaaacaacttatgctgttcctaagagtcatgtactcccctgctgaacacatactttctgtgtctaattaaattcaaacactttttccttgagtttaattttcaggttacctaaatgggtttccaataaggaaaaacagtcacaaagcaagaggtttgtctccctttttggccaacggctttaaaaaacaaaactttatcttctagaattcaacagtttcacttttaaatgatactgtgaatggaatcattctctccccaaagatgcctgctaccttcacgaatctctcctggattcagctggtcaccagtttcatcttgacatgcttcccctctctgatgagtgccttcctccagaaagatccaatatcctaagtcccacaatctgggacaatgacccacagggtctcctgacaaaccaacaaccataggtagggcctactccatgccctaggcatgccagacagcagttggaagatgagacctccacctcattgccaaagatttgtcactgctgttctgtcagagggggtgggggagatgtggagtcctgataagtaagcaacaacaaggaaggggtgatcccagatgggaaacaatgaacaactcttctgacagatggttaatcacaaacaacctgcaggcacaatgacctttttccccttgcagatagcccccttgcagcatgactctatacaatttccctccagcccccacctcttggcagacaaccctttctctgctgtgctgcccattgcaaccttgcagcatatttttatactttcgctaataaatctgcctttctttacctacaactgtcttggtaaatccctttaaaaactgcaaagccggccccaggcagtaccacccatgacacccaggagttcaagaccaacctgggcaacatggcaagaaccccactctattttttaaaaaaggggaggggaacagttcagagagcttccaggtgggtgaacacatcaaggtgctgagacggtagcacacccagagaggccatggaaggtccccatgcctcctcccccgataccttgcattaaacatctcttctataggctgctcctgagttgtatcctttataatagtccagtaatcataaataaattgtcttactgaagtctgtgagctattttagtgaattatcgaacctgaaggggttgtgggtgatgagaaccttgatttgcagccaagtcagacagaagtgtgggtaacctgcggacccaatacttgtgcctggcatctaaagagagcacagcccagcaatggcacctaaagtgaagacagcctgagcctgcagtcccagctactaaggaggctgtggtgggaggattgcttggtccctagagttgagtccagcctgggcaacatagcaagatccctgtctataaaaaataaaaagaaacaaataaataaagtgaggacagtcttgtgggattgagcccttaaaccctggatctgataactccatgcacttactgctagaattgaactgggttgtaggacacccaggtggtatctggagagctggagaattgattggtgtgaagaaaaaactcacacatttgatgtgagaaatattgtcattgaaaagtttcatatatatatatacacacacatacacgtgtgtacagatgaaaaaagaaagaacttttatctgaggaatgcaagtccttttaattatcagaccaagagagacactaaaatgagaccacaatcatgccctactccacgtcttgagctgtgtattcatcttctgaaattgcttgctattgccataagtagctaaaaataaatctaataatgccccaccagacattataacccacaccctatagcttaacaatgtagagccaatcactaacaatgttatttctgtgaaccaatgagaatttctgacaacttttttgccataacccataccttatagcttaacaacgtagagccaatcactaatcaatgttatttctgtgaaccaatgagaattcctgacaaacaactttttttgtccttaaaaatctacttctaactgctactaatcaaagtgcatgttcaggacaatttgaatctatgctcccaggttgcagtccttgagcttagccaaaaaaacctctctacttatattaattttgcctcagcttcttccttttaggttgacatgcatacagacatgccactgccttgattcatgctaaggcaccagcactttttcccaccaatgcttttacaccatcagcacaaatgtcaacacagtaaacagggcaaataaaacctaagaattataaaaaacagttttgacctcagggactcctgaaagctagaaacaagagaactactgatctcagttgtctatgggatgttcccccagaaaaaaaaaaaattcaaccttgaggaagaaatgcagatacagagacaacagtcacagaaacggaactggcttcctaaccagattttccttatggtatatgagcagagacaaattctcagctgcctttaattccttcctatttttttgaacttatttctccatccttctcatcaattctgtaaattatacaaaataaatcccttttctccttaaggtggctaaaataggctcctcttttaatcagtggagaaagttggtagaagcagcaaaactaaaattgagagtttagtagacagtctccaaccacacttaaggcttttttttttttttactctgttgccatttaatttgaataaaaatgcacatcaatacattgagattttaacccttgccatagtcaaacctaattaaacagcatccaagaaacaggaacatctggaatccctacgacaaggcataagaaatgatagatgcaggtgactcatggataaaatctattaatattattgaagatttccaagtcaaattattgatcttacaccatcaaatgctaaaacttaatttttcacaactgcattctccacatctctaaaagggaaaaggaaaatggttttagtttctcggtctagatttactttggcaaactatgatatccagaagcaatcttccatttcatcactaactatctcctgagagatgggtgctttatccaacctttcctttacacaaccactttagcatggtaaaatgctgggttttaaaaaaattaaacagcttttaaaaattgttttaagaataacttgaaagtgataaaaatgcagcttaaatactaaagagaaatacagttttgtgggtgtataagccaagatcaaatgaactgatagataaaaagtaaagcagtcaagagatgaaaacaattgtatttactctgtatctcttcctcccttctagagtctcctttccatcaatctctttcactgttgtcacaaaagagatggctaataaaaaataattatcactgtaccactaggtcaaatttaatttaatttttcaaaagttatttgctccagtttttcaagtgtttagcacagtcattaaaaaaaacaaaaatctttctctttctggttatcttagtatctaatagaaaaatttaaatagataatgtacaaaataaacaacggaaaaatcttgcaaaatacaaccaacaccaccaccacctccacaataaaatgttaaataacatgaaggtggaaaatggcaaataggagacaggactaacgtgcagctcccacttggacagacagtacagcatctggagacgcatattgttaacttttgttccaagaatgaccacaggaacataacaggaaaactaaagagttcacagagccttcaaaagaagtggcttgctgctgcaaacaccacaaaacagctaaaaaactgtgaatcaatgaagtgtgagagggggaaaagtcagcctctgaacacacatccccactggggaacccaaaaatccagatcatgggagaagaatttaatcttacatagagctgaaatggatttagggagctgtgtgaaatataaaaggagaagcagcagctggaagagccctgtaggcactcctggtccccagcatgagcccagggaagccattcctgacctcatttcacagaggtcccttagggaaggtaaggcagctggtgaaattgggggaagggccacagggtgaaggatgctcctagctgaactctgtaataattgcaactgagcacaaactttcctaagcagaatccagggagtagggggcaaatgggaagtgcagatacaagcacagaagccacagctgaccatgcaggtgggcaggcagggaggtgagagacctgagagccctgcttgttttctcaatgtgaaggcttgtacctgagggcaagaccctagccctgctctctggctgtctggatacaaactcagtgtggttggtgggggcaaggtgggagtgagactggccttgctgactctatgggagctgggtgaggcctgtcactgctggcttttccacttccctggtgatctatatgatgcagcagaggcagccataatcaccctggaacataactccattggcctgagaaccacccaccatcccccaaagtgaccacagaaacccccacccaaagagagtcggagctcagactagtctaaccctgccgatggttttgctctatctgccctggtagccaaagacaaaagataaagctcttgggagctctatggccacaaccaaaccggagaaaccaaagtactcatcctggccaatgtggggcaagattatatccacctcctaccactgcagctggcactctcttgaaagtgccacctcctggctggacgccaaccaagtcaagccattacagtaactcaacagaataaccctgctccaaaaaaggagaaaacaacagctaattccaccacctgcaacactctggctaaaccgaggtcctgattctgtccacatgacaacttcactaccagcataaccagcattcaggaaaaccagcaccaaacaaaactaaaatcaaggactcccacagagtccaccttatttactcccctgccacctccacctgagcaggtgctgataaccacagaggggagacctaaagacagatgacatcacaggactctttgcagacattccccagcaccagcctggagcctggtaaccccaatgggtggctagacttagaagggcaataacaatcactgcagtctggctctcaggaagccccatccctagcaccacaccaagggatcaccctgtaggacaaaagaatctgaacagcagcccctgagttccagatctttccactgaaacagtctaacaaaatgagaatgaaccagaaaagtaattctggtaacatgacaaaatgaggttctataacacccccaaaagatcacactagctcctctctggcaaaagatccaaaccaacaagaaatctctgaattgccagataaagaatcagaaggttgattattaagctattcaaggaggcaccagagaaaggtgaaaaccaacttaaagaaattttaaaaaatacaggatattaacgaaaacgtctccagagaaatagatatcataaagaaaagacaatcacaacacctagaaataaaagacccacttagagaaatgcaaaatacactggaaagttccaacaatagaattgaacaagtagaagaaaggacttcagagctcaaagacaaggctttcgaattaatgaaatccaaaaacgacaaaaaagaatttttaaaaatgaacaagcctcaaaggaatttgagattatgttaaaacaaccaaacataaaaataattggtgttcctgaggaagaagagaattctaaaagcttggaaaacttatttgagggaataatcgaggaaaacttccctggtcttgctagagacctagacatccacttacaagaagtccaaagaacacccaggaaattctttgcaaaaagataatcacctaggcacatagttttcaggatatctaaagtcaagacaaaggaaagaatcttaaagctgtgaggcaaaagcatcaggtaacctataaaggaaaacctatcagattaacagcagatttctcagcagaaaccctgcaagccagaagggattggggtcctatctttagcctccttaatcaaaataattatcagccaataattctgtatccagcaaaactaagcttcataaatgaaggagagataaagtattttttagacaaacaaatgttgaatttgccaataccaagcaagcactacaagaactgctaaaaggacctctaaatcttgaaacaaatcctcgaaatacaccaaaatagaatctccttaaagcattcatctcacaggacctgtaaaacaataacacaatgaaaacaaaccaaggtatttggtcaacaaatagcttgatgaatagaatagtacctcacatctcaacactaatgttgaatataaatggcctaaatgctccacttaaaagatacagaatggcagaatgaatgagaattcaccaaccaagtatctgttgtcttcaagagattcaactgacacataaggactcacataaacttaaggtaaacaggtggaaaaagacagtccatgcaaatggacaccaaaagtgagcaggcgtggcgtagctattcttctatcagacaaaactaaagcatcagcactttaaaaagacaaagaggggcattatataatgatacaggactagttcaacaggaaaatatcaccatcctaaatatatatgcacctaacagtggtgctcccaaatttataaaacaattactactagaccgaagaaatgagacacatggcaacacaataatactggggaaatacaatactctcctgacagcactagacaggtcatcaaaatggaaaggcaacaaagaaacaatggacttaaactacaccctagaacaaatggacttaacagatatttacagaacattctacccaacaaatgaagaatatagattcttttcatcagcatatggaacattctccaagacagatcatacgataagccaaaaaacaagtctaatacatttaaacaaactgaaattatatcaagtactctctactacagtagaataaaattggaaattaattccaaaaggaatactcaaaactatacaaatacattaaaacaatctgctcctgaatgatcttttgggcaacaataaaatcaagatagaaaaaatttctttgaactgaacaataatagcgacacaacctatcaacacctctgggatacagcaacaatggtgctaagaggaaagctcatagcattaaatgcctattacatcaaaaagtcggaaagtgcacaaattgacaatctaagttcacacctcaaagaactagagaaacaagaacaaatgaaacccaaacccagcagaagaaaagaaataaagatcagagcagaactaaatgaaactgaaacaacaacaaaaaaagataaatgaaaaaaaagctggttctttgaagagataaacaaaaatcaatagaccattaatgaaattaaccacgaaaagtagagagaagatccaaataagctcaattagaaatgaaatgggagatattataaccgagatcattcaaggctgccatgaacaccattatgcacacaaactagaaaacccagaggagatgggtaaattcctggaaatatacaaccctcctagattaaaccaggaagaaagaaaaactctaaaaagaccaataacaagtagtaagattgaaacagtaatttaaaaattccaacgaaagaagttgaggactagatggattcacagctgaattctatcaaacattcaaagaagaattggtatcaatactactgaaagtattccaagataaacagggaatcctccctaaatcattctgtgaagccagtattcccctaataccaaaaccagaaaaggacataacaaaaaaagaaaactacagaccaatatccctgattaagatacatgcaaaaatcctcaacaaaatactaactaactgaacccaatagcatatcaaaaagataatacaccatgaccaagtgggtttcatactagggatgcagggttggtttaacatacaccagttgatatatgtgataaccacataaacaaaacaattaaaaacaaaaatcatataatcatctcaatagatgctgaaaaagcatttgacaaaatccagcatcactttatgattaaaaccctcagcaaaatcagcatagaacagacatatcttaaggtaataaaagccttctatgataaacccacagccaacattatactgaacagggaaaacttgaaagcattccccctgagaattggaacaagatgtggatgcccaatttaaccatttccattcaacataatactggaagtcctagccagagcaatcagacaagagaaagaaataaacggcatctaaatcggtaaagaagacaaactgtcactgtttgttgatgacatgattgtagaccaatacaacactaaaaaactcctagatctgatcaatgaattcaataaagtttcaggatacaaaatcaatgcacaaaaatcagtagcactgctacacaccaacagcaacgaagctgagaatcaaatcaagaactcagacccttttaacaacagctgcaaaaaaaaaaaaggaatatacctaaccaaggaagtgaaagatctctacaaggaaaactacaaaacactgctaaaagaaatcatagacacaaacaaatggaaacacatcccatgctcacggatggatagaatcaatattgtgaaaatgatcatactgccaaaagcaatctataaattcaatgcaattcccatcaaaataccatcatcattcttcacagaattagaaaaaaaatcctaaaattcatatggaacaacaaaaaaaagagcctgcatagccaaagaagactaagcaaaaagaacaaatctgggggcatcacattacccaactacaaactatactacaagactatagttaccaaaaccgcagggaactagtataaaaactggcacacagaccagtggaacaaaatagagaacccagaaatacggcaaatatttacagccaactgaactttgacaaagcaaacaaaaacataaaatggagaaaaggacaccctactaccctactaaacaaatggtgctgggataattggcaagaaacgtcacacacacatgcacacacacacacacaaacacatcatggaatactactcttcagccataaaaacgaatgaaataatggcatttacagcaacctggatgcagatggacaccattattccaagtgatgtaactcaggaatggaaaaccaaacaacatatgttctcacttataagtgggagctaagatatgaggatacgaaggcaggagaatgatataatggactctggggactcagggggaagggtgggagggggatgagaaataaaagactacacactgggttgagtgcacattgatcaagtgatggatgtaccaaagtctcagaaatcaccactgaagaacgtattcatgtaaccaaacaccacttgatccccaaaaactattgaaataattaaaaaatatcttccgttccaagatggctgaataggaacagctacagtctgcagcccccagtgtgattgatgcagaagacatgtgatttctgcatttccaactgaggtacctggttcatctcactgggactggctggacagtcagtgtagcacatggagggcaagccgaagcagggcggggagttgcttcacctaggaagcgcaaggggccgggggattttcctttcctagccaagggaagccatgacagactgtacctggaaaaacaagacactcccacccaaatacttcacttttcccaaggtcttagcaactggcagacaaggaaattctctcctatgcctggttcagcaggtcccatgcccacggagcttgctcactgctagcgcagcaatctgagatcaaactgtgaggcagcagcctggctgggggaggggtgtccaccattgctgaagcttaagtaggtaaacaaagcagctgggaagctgcagagcccaccacagctcaacaaggcctattgcctctatagactccacctctgtgggcagggcatagctgaacaagaggcagcagacaacttctgcagacttacaagtccctgtctgacagctctgaagagaacagttgttctcccaacatggcgtttgagctctgagaatggacagattgcctcttcaagtgggtccctgacccccgtgtacctaactgggagacacctcccagtagcagcccaaagacaccttgtacaggtgggtgctcctctgggacgaagcttccggaggaaggatcaggcagcaatatttgctgttctgcagcctccgctggtgatacccaggcaaacagggtctggagtggacctccagcaaactccaacagacctgcagctgagggacctgactgttagaaggaaaactaacaaacagaaaggaatagcatcaacatcaacaaaaaggacatctacaccaaaactccatctgtaggtcaccaacatcaaagaccaaaggtagataaaaccacaaagatggggaggaaccagagcagaaaagctgaaaattctaaaaaccagatcacctcttctcctacaaaggatcacagctcctagccagcaaaggaacaaagctggatggagaatgactgtaacaaattgacagaagtaggctttagaaggtcagtaataacaaagttctccgagctaaaggggcatgttctaacccatcgcaaggaagctaaaattcttgaaaaaacgttagacaaatggctaattagaataaacagtatagagaagaccttaagtgacctgatggagctgaaaaccatggcacaagaacttcaagacgcaggcacaagcttcaatagccgattcgatcaagtggaagaaaggatatcagtgattgaagatcaaattaatgaaataaaacagaaagacaagcttaaagaaaaaagagtaaaaagaaacgaacaaagcctccaagaaatatgggactatgtgaaaagaccaaatctacgtttgattggtgtacctgaaagtgagaaggagaatggaaccaagttggaaaacactcttcaggatattatccagaagaacttccccaacctggcaaggaggccaatattcaaatttaggaaatacaaagaataccacaaagatactactcaacaagagcaacccaaagacacataactgtcagattcaccaaggttgaaatgaaggaaaaaatgttaaagacaaccatagagaaaggttgggttacccacaaaggatggaatctcctggcagaaaccctacaagccagaaaagagtgggggacaatattcaccattcttaaagaaaagaattttcaacccagaatttcatatccagccaaactaagcttcataagtgaaggagaaataaaatccttcacagacaagcaaatgctgagacattttgtcaccaccaggcctgccccaaaagagctcctgaaggaagcactcaacatgggaaggaacaaccggtaccagccactgcaaaaacgtgccaatgtgtaaagaccattgatgctacaaagaaactgcatcaattaatgggcaaaataaccagctaacatcataatgacaggatcaaattcacacataacaatattaaccttaaatgtaaatgggctaaatgctccaattaaaagacacagactggcaaattggataaagagtcaagacccatcagtgtgctgtattcaggagacccatctcacatgtagaggcacacataggctcaaaataaagggatggaggaagatctactaagcaaatggaaagcaaaaaaaagcaaaggttgaaatcctagtctctgataaaacagactttaaaccaacaaagatcaaaacagacaaagaaggccactacgtaatggtaaaggaatggtaaagctcttcttcaacaagaagagctaactatcctaaatatatatgcacccaatacaggagcacccagattcataaagcaaatccttagagacctacaaagagacttagactcccacacaataatgggagaatttaacaccccactgtcaatactggacggatcaacgagacagaaagttaacaaggatatccaggacttgaactcagctctgcaccaagcagacctaatagatgtctacagaactctccatcccaaatcaacagaacacacattcttctcagcaccacatcacacttattctaaaattgaccacgtaattggaagtaaagcacttctgagcaaatgtaaaagaacagaaatcacaacaaactgtctctcagaccacagtgcaaacaaattagaattcaggattaagaaactcactcaaaaccactcaactacatggaaactgaacatcctgctcctgaatgactactgggtaaataaggaaatgaaggcagaaataaagatgttctttgaaaccaatgagaacaaagacacaatgtaccagaatctccgagacacatttaaagcagcatgtagatggaaatttatagcactaaatgcccacaagagaaagcaggaaagatccaaaatcgacaccctaacatcacaattaaaagaactagagatgcaagagcaaacacattcaaaagctagcagaaggcaagaaataagtaagatcagagcagaactgaaggagatagagacacaaaaaaaccttcaaaaaaatcaatgaatgcaggagctggttttttgaaaagatcaacaaaattgatagaccactagcaagattaataaataagaaaagagagaagaatcaaacagatgcaataaaaaatgataaacgggatatcaccactaatctaacagaaaaacaaaccaccatcagagaatactataaacacctctatgcaaataaactagaaaatctagaagaaatgaataaattccgggacacatacaccctcccaagattaaaccagggagaagttgaatctctgaatagaccaataacaggctctgaaattgaggcaataattaataccctaccaaccaaaaaaaagtccaggaccagacgattcacagccgaattctaacaggggtacaaagaggagctggtaccattccttctcaaaccagtccaatcaatagaaaaacagggaatcctccctaactcattttatgaggccagcatcatcctgattccaaagcctggcagagacacaataaaaaaaagagaattttagaccaatatccccgatgaacactgatgcgaaaatcctcaataaaatactggcaaaccaaatccagcagcacatcaatagctaatccaccactatcaagttggcttcatccctgagatgcaagtctggttcatcatatgcaaatcaataaacgtaatccatcacataaacagtaccaacaacaaaaaccacatgattatatcaacagatgcagaaaaggccttcaataaaattcagtagccctttatgctaaaaactctcaatactaggtattgatgaaacataactcaaaatagtaagaactatatgacaaatgcacagccaatatcatagtgaatgggcaaaaactggaagcatcccctttgaaaacctgcacaagacaaggatgccctctctcaccactcctattcaacacagcgttggaagttctggccagggcaattaggcaggagaaagaaataaagggtattcaactaggaaaagaggaagtcaaattgcccctgtctgcagatgacatgattgtgtatttagaaaaccccactgtctcagcccaaaatctccttaagctgataagcaacttcagcaaagtctcaggatacaaaatcaatgtgcaaaaccacaagcccttctatacaccaataacagacacagagccaaatcgtgagtgaactcccattcacaattgcttcagagaataaaatacctaggaatccaacttacaacggatgtgaaggacctcttcaaggagaactaccaaccactgctcaatgaaataaaagaggacacaaacaaatggaagaatattccatgctcatggataggaagaatcaatattgtgaaaatggccatactgcccaaggttaatttatagattcaatgccatccccatcaagctaccaatgactttcttcacagaattggaaaaaactactttaaagttcatatgcaaccaaaaaaggagtccacattgccaagacaatcctacgcaaaaagaacaaggctgtaggcatcatgttaccagacttcaaactatactacaagtctacagtaaccaaaacagcatggtactggtaccaaaacagacatacagaccagtggaacagaacagaggcctcagaaataacaccacacatctacaaccatctgatctttgacaaacctgacaaaaacaagaaatggggaaaggattccctatttaataaatggtgctgggaaaactgactagccatatgttgaaagctgaaactggatcccttccttaaaccttatataaaaattaattcaagatggattaaagacttaaatgttagatctaaaaccataaaaaccctagaagaaaacctaggcaataccattcaggacataggcatgggcaaggacttcatgactaaaacaccaaaagcaatggcaacaaaagccaaaattgacaaatgggatctaattaaactaaagagcttctgcatggcaaaagaaactaccatcagagtgaacaggcaaactacagaatgggagaaaatttctgcaatctacccatctgacaaagggctaatatccagaatctacaaagaacttaaacaaatttacaagaaaaaaacaaccccatcaaaaagtgggcaaaggatataaatagacacttctcaaaagaagacatttatgcagccaacagacacctgaaaatatgctcatcatcactggccatcagagaaatgcaaatcaaaaccacagtgagataccatctcacgccagttagaatggcgattattaaaaatcaggaaaaaacatgctggagaggatgtggagaaataaaaactgttttacactgttggtgggagtgtaaattagtttaactattgtggaagacagtgtggtgattcctcaaggatctagaactagaaataccatctgacccgtgatcctattatatcctggttatatacccaaaggattataaatcatggtactataaagacacatgcacacgtatgtttactgcggcactattcacaatagcaaagacttggaaccaacccaaatgtccatcaatgatagactggattaagaaaatgtggcacatatacaccatggaatactatgcagccataaaaaaggatgagttcatgtcctttgcagaaacatggatgaagctggaaaccatcattctcagcaaactaccacaaggacagaaaaccaaacaccacatgttctcactcataggtggaaactgaacaacgagaacacttggacacagggcggggaacgtcacacactggggcctgttgggggttgcggggctgggggagggatggcattaggagaaatacctaatgtaaatgacgagttgatgggtgcagcaaaccaatatggcacatgtatacctatgtaacaaacctgcacgttgtgcacatgtaccctagaacttaaagtataatttaaaaataaatttaaaaaataacataaacatactagtccacattcttctacaatgggatatctgacctaaatacatctgagtggattatactctcaaacaaggaatgaagccaataacagacattcacctaatatgaaataataaagagtagaaagaaaaataccttaaaaaaaaaacttgtcttgtaaagcaggctaagaaatgaaagaattaaggaattcacaacattcgtaacaaaaaaaatacacagcacttcacttatcctatttatatggtcatttaaagcagcacctattttaagtcatagttcattaaatagaaaagaggcggaaagccacacttcatgacaaattaaatgccttagagactggtaaatataaaggaaaatgcaaccatgattttgtgttaccttcaaccaaaagcaagaagcaccaaaaaaaactaatatcatttctaggtgcaaaataagtacttcttagaacaaagcccttctacagttagggacaatgaattctgagaactagaaatacagggagactaggtttccatggatatttgtatccatttcctagtttaactatctttcccagtattgtggagatttaaagaggaaaataaaggcaaccaaggtgtatttaagtttgtattttgtctccccaagggcagagaccacgtcatttatttttgtatttatttgctcactcaacaaatctatacttagaacctaacagattgacagaagtccaggcagtggacatttctggcattcccaaacatctgatgaattaatggataaatgaacaataaaatgaacaaatggtaaagcaaaacacttactctaagaatcctaacattgtcacaactacctgaatgccaacaccttgacgggaaatcacaggattcacatgtgcatgcttttccttccagctgtctatctactgggagagccacccaagatcccgcagctacataagttgctggatgccaagaacagcaagttcttggtggttaagatggacatcagtgggtgccatcaatgagctgccattagagggcagcagaggatgtattcagcagcagaaaacagaattgcaggccttttaatcaagactgggaaaactgcactttatgagagactgtaattgatgatgtgagtgggtacactagaactcccctctcaataaatataaatcaaccagtttatttggaaaatttagttaaattcttcaaggagcatttcttaacaaccagtgaaaacccattagggtagcgtaggggtaactaaatcatctctagtaagtctacatcacgtagacacaaaatggcaatgaacaaaattagaatgcaggccctttggccttgcatttccagaagaaatactatagttataactatccttaagttgagattagaaatattttcaactgttgttacaaagtaagagcaattttagaaattaacaaatacaagtactcagtgctctatcactccacatattcatatataaaattatacagaaataaacattattcaactttaggataataaattggtgaagcaagtcaacaatggaaattttatgtaatttgtgtgttattgcaggtgccagtgcatgattactaatctggttttgcaacaatattgacagttgtagaggaaacaacaacaatcctttgagtagacctaaaatgaaagttattttttaaaagggctttcaccaaaatacagatttatccaaatgtatagctcctctaaattaatttgaaagttaaagtttcaccgaataatatcatttttaccatatgaatcaagaactagtttattcagtaagaaatggagaaaaggaaaagaaagcctctgagatttcaagttttctataaaactactgctaatccaccttaagagacaaaaaaatctacattaagaagtctagtggaacattaaaagtcctatactatatttaaaattcaaaagtctactgaaaatggtaatgacagcccaccacttaaaaacccttttcaaaaactacaatataagccactacccctagaccatcctcctcactctgtcccttctccacccctctaggcattctaccaaacccttatcaacagcaaacctccatttttgaaggtccagatttaaagttccttaactttcatattaatatatgaaaaaattttaaaaatctttggctcttcttaatttacagataaatccttagtttgactgcttcttcaccaaaataggagcagcaaaaggaaaaaggaacattgcactagaggagcaaatcacacttgtggaattccaggagggtcaagatattcctggaacccccagctttagagtatcccctatggctaggacctcattatctactgccacagttcccttagatgagctctctacctgtacattttctgcatctaagccttgtgttgagctctagaaacctgaaccatttccttttccttttccaaggcatgcatgtgtccactaaattcacctagctgggtgaggtctccttccatcaccagaagaggaaatggatacagccacaataacttcacaaattccagcatctaatttccagattccaacccctcttcacctactgtaggtgtttcctctcctcttcttcaactcagaatttctctgggtcattacaaaacctcattctctcccaatcttcctcctagaaagaagtgttcttcctctctccttggttaaaaacacacatgccttccattgagttaagactaaatgtaatattccagatatataagatttaaatgcattcggaacagaggttcagatgtatttcagggcccctaattccacataattggcataacaaattaatttttagtgcccaaatgtttatatgttcactaccacaaatacataaaataatacttttgttcaaatgaaataatatacctgtatcatgaattgagattttggcactaaatttttttgtctgtataatgtaaatatttggtatgtaccaaacactacattggggaggggaggaaatgtaaaaatagtttttaaaaaaggttaaaaaagttttaacttaaaaaatggaatattgctttaaaatggaaattataatagtgttaccaaggcagaaaaaagccagtgagatgtatgagttgctttcatcagagtgaaagtcccattaaaaaaaaaaaaatggggctgggtgcagtggctcacacctgtaatcctagcactttgggaggccgaggcaggtggatcacctgaggtcaggcgttcaagaccagcctggccaacatagtgaaaccccatctctactaaaaatacaaaaattagccaggcgtggaggtgcatgcctgtaaccccagctactcgggaggctgaggcaggagaatcgcttgaagccaggaggcaaaggcagaggttgcagtgagccaagatggcgccactgcactccagcctgggtgacagagtgagactgttaaggaaaaaaaaaaaaaaatgccccaggcatggtggctcatgcctgtaatctcagcacttcggaagaccaaggtgagaggactgtatgagcctacgagtttgagaccagcctgggcaacacagtgtgaccccatctccacaaaaaataaaaaaattagccaggcatggtggtatgcacctgtgtggtcccagctactcaggagtctgaggtgagaggatcccttgagcccaggaggtcaaggctgcagtgagccatgattgtgctactgtactccagcctgggtgacggagttagaccctgtctcaaaaaaaaaaattaaaaaacaaaaaacaacatatattgtattttttgtagtaaaactactgaaacaatagaacattctgcaaattttcaatctggtcaactattaaacttgttcaattattaaaatgtcattttggaacaaacataggacacatggaaaaccaagtatttatagagtgaccacctcttttctctctcataaggactgtaagcgatattagctatctatcccaaaaaaagacttcccccaccaaagatctctctactatgggattctgttccaaagagttgttctccctgaaataaagtttagtgcagtggcaaaaaacatggccttggagccagggtgtgactcccggccagccacttactagctatgtggttttggcaattcctttaatttcttttatgagcaaatcactgaacctaactcacaggactgggacttaagtgagcaaatttgtatatatagtttagtatactcaggataagcacccaataaatggcatttattactagcagctaaatcttccttcctccactaattactggtttaccagtttactaccagtaactccactgaggccaccgtgaaagcattcccactaaggcattcttgatccagaaaaataacagtcccagccttatcctgatacttttttatattccaagaatattctttcatcctcatattaatacttatatatgattctattaataacccaatgttctcacatgaaaaagctgaggcacagagaagtaatctgctcaaaataatatagaaattaacagatttataaatcataagagatcatttagtctaacctttccatgttgtagataaggaaactaaaatctggagacacagatttgccatcctaaggccacaaaacaagaaagtagcctgtgaaacctaggctcctgcaactctgtccagtgcttctctccactatattacattgtcacataataaaatcaaaattaaaaacacttaaatagcagataactattattctattcattaattttaaataaacaaaaaatatatccacccaaagacttgtacacgaatgttcacagcagcactgttcatataacagccaagacatgaaagcaacccaaatgttcatcaattctatatggataaacaaaacatgacacatccatataataggataccattaggcaatacaaatgaatgaaaacgctgatatacgatataacgaggataaacttagaaaacatactaagtgaaaaaagccagacacaaacatatattgtatttttgtataaaaaaaattcagaataggcaaatccaaacagaaagaaagtagtaggccagtggctgcctagggctggagtgggtatggagagtgactggtaatagacactaagtttctttttggggtgatggaaatactgtaaaattaaattgtggtaatggctgcacagctctgaaatctactaaaaatcaatctgtataattaaaataggtgaaattcatgatacgtaaatttcaccttagtaaagccatcaaaaataatttaaaaaataaacaactgaattggtcattttgtaaatcaggataatctggatgaaaatgatgtacactttattaagatataaaaactaaaaaaaaaaaagtaagcaatattctctagaaagtctgtaaaatgaactgcatatggtaagcaatttatccccaagtggtactataatcagaacatattgccatgagaaacttcactttggcaaagacaaatttcttccaacattgtacatcctggatggtataaaacaatgacaataaaagactaaatggattaaatgaagggaagaaaggagagtataagcagtattgttgataacatttatgttcatagattgtccaaactatctattactctatattggaactacaaaaggaactaagatttgcattttatttttaatctcaagggaaaattataaaggtcttatatcttagggtatctcaaagttttcacatcaacacacataaagacatccaaggtttgagtaaaggttaaatttattcctttcaatgctattacatgttttaaaacaaatcaaatttgcttttgagaaaaggataaatgtgcctatggattaaaatgatattattttgtattccctaaaaataaactctgaagagcatgattaaacacaaatcactttgaaacatggcctaatctaaaaaatgggatctcaaattaattatgtgtatttcctcacacctccaaataaaaataacaataatgctaacattattgagcatgttttacatataaacacgatcctaatcgctttctgtgcattgtttcatttataactcacaactatcctacttagttaaaactattactgtcaccatttaacagcagaggaaaacagcagcctagtgagatggagagaggttaacctgcccaacgttatgcagcaaaactggcatttaaacctaaggctaagtccaaggatacaatattgtgacataagaaatatactctgtattttgtctctgctcctgattcttggcacaaagctcatacaactcttgcaatctctaaagtgctaagtgtcttttgtatgctaatgaaatgactgattgctgaaggctcttttgaaggatgggggccggttgccagggaaatcaaccctgtgaataaagagttggaactttcagtccaacctccccctacccccactaactctgagaaggaaagaagagctgaaggttgtgttgatcaccaatggccaatgatgtaatcaatcatgcttatataatggaacctccacaaaaaccctacaggactggattcagggatcctccatattgttgaacacatggaggtttctggagggtggaatgtcgaccagaggtcatagaagctctatgccccttcccatacaccttgccctgtgtatctcttccatgtggctcttcatctgtatgttttgtaatatcctctgtaataaatgggtaaatgtacatgtttccctgagttctgtgagccatcctagcaaatcaaaactgaggagggggtcacgggaaccccaatttatagccagtcagtcagtaacacaggtcacaacctggggcttgcaatcagtatctgaagtagaagggtagtcttgtgggactcaccctcaacctgagggatctgatgctgtctccaggtaggcagtgttagaactgagttaaattacaggatacccagttggtgtcagctggcaaattgattggttgctggtgggggaaaatttccacacattctggtgaccagaagtgaagcgttctatgttgactgtgtcagagatggaaaaaacaacttagggttttttttcccgtatctcctacagaagccctactcttaagctctaagttatataaattctcatgctcgtggtaattaatgtagtaacctttactgtaatataaataataaaagtctttgacatcccttaaatataattattcatttttttaaagatatgacattaaggttatattttttaaaaagagatctttatattttaaatgacatatactttaatgaaatatgtctgggtattttaatctgttcatgctactgtaacaaaaaaacctgagactgggtaatttataaataatagaaatttacttctcacaattctggaagttaagaagtccatgatcaaggcaccaccaggttcagtgcctggtgaagccctgttcctcatagatggtatcgtctaggtgtcctcacattgcagaaagatgggagggcaaaaagggtgcaaatactgtgtcttcatgtgacagaaaagtgggagagcaagagagcattcccttcaatcttgagcccttttataagggtgctagtcccattcacgagagcatagcccttctgactcaatcacctccgaaaggctatatacctcttaatgcaaccacagttggaactaagttccaacacatgaattttgggggacattcagaccataccattaagatttgcttcaataatggagaaggaagaatatgcataaaacaggattggccacttattgataattgttaaaaatggatgatgggtaaacagtggtaccttttattatttcctatgtttctgtatgtttgaaaaggtccataaaaatttaggaaaactaaatccttaaacatatcaaaaatgtataagagggagctataattcttaaaacagtttttcattttagcaatatttttatttcaaaatctcaagggaaggcagaaaataggctacacatactcttaaaatattctcatattcaccaacatattctaaagcccagtgtggggaaaaatctgagtatctggaccccatttaagactgctgagaagacaggagaccaattctgatcactgcaacagccgtaagataaaaagaggcaggcaggcatgccggcagaactccaacttctgccactctgttggcaatggagacatttattccttgtcttgttaggcctttctcacttttgtgaccgcagtcgttttcccagcagtctccttctcactatcactatcaccattattatactttttgttaagtgattaaattactatgaaaaacaacaatttatgtccacaatatccactcacgctgatatgtgcatagaagtggttggtcagaagaccaggcagatctccaggttaataatcaataaatgtcatattgcttgactcagaaaagaaacagattccaaagattttgggcatgatgcatattaacactaaagagcatacccaaatttaataacaatctattttacatatatagtcaataaaaccaaaatagttatttctgaaatctaaaatagatgttggctatgtcatttgaatgtgtctatttgtttgcctaggacagtgcctggcagatagccaatgcgcaataaatatttgttgaataatgatcctgccagctttctcagttaggtgccacttagcagaatacagaggaagcaggagaaaaaggaaggagaaaacaagcttagataattttcaacttgccaaagaactatgaatagagcattatctactttgagcagaatgttaaattacatagttcagggacatttactgaaatattctgagacctggcccattaggattatgaatgaagaggggcactttataaagccttctttatgctgagtcaactccaacttctggcttcagaaatggcttacttgactttactacttttacagcctaagtgagttttcattatctatatttcaaaacttggaaaaagtcactatttaacatgcagatgtttccattttataaaattacatcttaacttttattacaatattcactattaccccccacctcactttctcactttagttatctatgaaaccttttcagttcctagtacattctcaaaatatttagatggctcctgactgccactaacctctcacttggcagattatctgataccatccacaaaagaagcacagagaaaattttgggattcctctggacagtcaaaaataagagtttttgctagcaagtatttctaagaattgaggtaacaaaatttttgccatccactatcactatactctaaaacagctatttgaacaaatagtattttttgaaagaaaaagcacaacacaaaatctaatatttaaaaatacggaactatgataattgtttcctttacaaaaaatgatttaaggttaaaagagctttcttaaagtctcactgcttttagtacaaagcttaggtaggaggcaccgaagtagcaattcccggttttcaatgacttctgcactgcctgtggagctcttgacattactagaaattttggggggaaaatgagcagaggcagcagggtgtcatgattaaggctagcaccaggctgaactgggatcaaatgtgaactctgccgcttattaggtgtgtgaccttaagcaagctactttaccactcaccctggcttcagtaccttaagaggacctggctgccatttggtatggggtgatatgccaaaattattccactaaatcccccttttagcttaagcccactcacattggtctcactgcttaaagaactagaagtgagacaatcatccttcctgaacagcctccttatgatcccttccctcgtaggaatctaccatctatcaatcactgagacaataatctatgtatagtccccagaccctcacactgtgtaagtatagtgtcatttagtgtgttaccaggcggcctctataacatgacagacatcaaatatgtcacggatgtatgtgtctgtgtctgtgcacgcatgtgtgtatgtgtgtgtgttgcagatgaggaagttcctcaacactactcccggcctgaatattatacctcttacctcgattacacatttcacattttggggagttatatatctcctttttaacaaatatgtccatgtgtgtaatggaaggttaaaggagttccatcttagggcttgcaaatacagtggcagaaaagatgttgcaatgactttgccttaagatacaagcctgtggtgggaatggggtctgtctttaatgaaggcacatactgtagaactagggactcatcctacatcaggaaagaacacaggcttcatcttgaatgctaacccaggccgttggcattatacggacacactaagtaacctactctggtttcagtagggaaaaaattatcaactgaaatgaagtttcataactcatgggttaatcaaggtgttagtggccatgtaaatacaaatcctccaatataaccttcaaaagctaaaaagactaacaagaagaacaaataaaaccatacaaatttcacgcttttaatacaagacaaactaacttcaaattatgtaaagtagaaaacataaactccattctagtggagatattaatcaagctcttcccctaacctattagagaggacagatagatctagggggagaaaaattttgcaaacacaaagtgggggctggaggcaaggacagaaagcctaaaattaaactaaaatcatccacagaaaaagaaagcccagtctacgtgaaaaaatcctcaagaagaccactcatagatgagagaaaattatagggaagggatttaaaagtgcagggaggattcaaggaggtagtcttgataaggtaatgcatcaagggtgtgatggtaaatttcacgtgttaacttgactgggccatgagatgcccaaatatctggttaaacattatgtctggttatgtccattacagtgtttacggaaaagacgagcatttgaatttgtggaataggtaaagccattactttccccaatgtaagtgagcatcattcaacttgttaagagcccaaacagaacaaaaggagggaaaaaggccgaattctctctatctgccttatagcttgaaacatcagttttctcctacccttgggctggaacttacaccattgttgctcctagtcctcaggccttcagactgactggaatttacaccacaggtcttcccaggtctccagtttgcagatggtgggacttctcagcctccgtgattacatgagccagtttcttacaaaaaaatctcgttctagatatagatatacatatgtttttagatatatatctatgtaactctccatccttttgtttctatttctctggagagccctgagtaatacaaacaaggacggcggtaaaaagaaaataatgtgtgtttttggaaattagatgatgaaaaaagaaacgaaaaagaaagtttcagattctgtaaggttcttatatacataaagaaatttaagattttgtaagaacttatatatatatatatatatatatatactcaaatacacacacacacacacacacacacacacacacacaaccctacttgagaaacacaaaatcctctccctcaaaaggtgaaaaaaagccatccaacaaacaaaccaaactgtgctacactgacagaagaggacattcctgaattagtaatctcataaaaccccctaaaacaacagccctgctcatagtcacacatagttgttgcaatcttcatctatataaaatttctaaaataaaaaataacgttaggacaattaagctaatgaaaagcacccccaaaaaaccaacaacaaagtagaagattttaataaatattccaaactggattgtatctcttttttttttttttttttttttttttttttttttttttgagacagggtctcactctgtcacccagggtggaatgcggtagcgcgatctcagctcaccccaacctccacctcctgggctctcaagtgatcttcccacctcaacctcctcagtagctggggctacaggcacacaccaccatatccggctaatttttgtattttttgtagagaatgagttttgtcatgttgcccaggctggtctcaaacccctgggctcaagccatctgcccacctcagcctcccaaagttctggcattacagacatgagccactgcacccggcctgaattgtatctctttaaacaagcacttaggagtatgaaaaccatcataaatcagaaatataaacctgaaaatagaatgggcaaaaataaataaataaataagagaaaaggtgaggactaaattcctgctcaaaaatagagtaaaaccttaataaaaggcactgaggaaaacaggaaaagaaccaagagaatgaaaatgagataacgcggtaaaaaaaataatcacaggaacagttggtaaaatggaagctaaacagagaaggtataattatatgagtaactgaagtccctgcagaagaaaaagaaaatattagaacagaattaatatttaaaactataatccaaaaaaaaatttgcagaaacaaaaaaaatctgattctacatattaagagaacccactaatgtagcaaggaaaattgacctgttaaaatcaattctaaaatatattatagtaaaactattagactttaaaaatatgagaagggaaagatccaagaattccaaacaaaagattcaagcaacttacaggggcaagaaaattaagactggcatcagacttctcaaaacaacaaaacatatagaaagcaaggccacattataaaaagggaaagtgtgaaccaaggacttatttccacccaacctgtactaccaatattaaggctacaggagaacaatttttaatatgcaggaactcaaggaaaattgtggtcaccatgagttcttcttaagaaatccactaaaagctgagctatatctaaccaataggtaaacttcagcaaaagaactggtggtgaaattttaatatatttaattgtagatctaagagcaaaacgaagttgcagttaaggattgaggatgaaacagacataatgcaactgaagaaaatggaaaaagagaaaaagaaaaatgtaaaataaacttttgttgaaatagcaatagataagaattataggacaccattaaaaacaacataatagatagtataaacttaaataagaaaacaaagaaatgaggacatttaaaaaaggcataaacatacaagtagctgctacaacaacaaacagcaaagcctaaatatccaaaaaaaaagaaatttaaagatgaaaaggcaaagaaagcacatcatagagaaataaagaaaaatagaacaatgtacacagtatttataacataagagttgaaatcaaacataagtcattaaaaattttttcatttggctattaaaaaatacctaataaatgcttattcaagagataacctaaaacagtatagaccaaaaagctaaaaaaaaaaaaaaatttaaaaaatttaaaaaaaaagggataagcaaaggcatacaaagcaaatagaaacagtaaggaagcaagagtaatgatcttgatactaaagaagactcaaatcaaaaagccttaaatatgacacagagaaacactgtttaacgttagaagctgcaattcacatgaagacataaccatcgtgtatgcctatcatcacatagcaactacttttaaaaagcagaaactacagggatgtacagacataggaacataactttaataatacgtaagactgaaaacacttataaactgaactgaaaactacataccctgataataaaaactgtacctccttctcaaatggacatcaatattgaccaaaaaaagtgcacacatattaggtaatttaaaaagcaacagtatattttatgaagtagtaataatgcaaacactctgatcataattctaacaaaaccagatattaacaaaactaaaaacaaaaatggcattctacctcaaaattatacattttccaaaaaaagatacaaaattatatatttaataacctgaacagaggaaaatctgtagctttgaacatttatatcaatagtaaattcataattcaaaaagaacaaactaaactaaaacagagactagaaataataaagacaaaataaatcagctgggtggagaattttaaaaatcacatcataaatcaaaatcctggaatttttttaagtaaatgaacaaggttaatccagaaaaaaaagagaaagcacaaattcaaagtaagaagcgacaagggagacgacacatttcaacaatataaaaacacgtattacaaagattatttattgcagtgtcatttataattggaaaatacaatcagaaataacctgaatgtccacaaatgggaaagtgattgaataaacaagctgtagatccacacaatggagtactatgcagctctaaaaattaataaagagatctctatatcattataaaatatagatatccagtatatactgttaagtcggaaaaacaaaatacaaaagaatatatgcagtgttctactttttgtataggaaagaagatatacatttatctgtccattttgtgtacagagaaccaaaagaactatatacatgagaaactaatcaggataatcgcctaggaagcagaggataagggatggagaagatgagtggagaagtggtagaaaagatgggaggtatgatcaacacttttctgtgtatagctttctgtatggttctgacttttggaaccatgttaatgcttaatatactcaaagaaatatggagatccacaaagatgagaaagcaaaaaaattctaagatggaaatcaaacaaaacaaatgtctctattggtatttcaaatgactcagggaaaatttaggaagaaaggaagacctaaccaccaaagtaacttttgaacacagtatttttactacgtattctcaggatgtaaacaaaagagaaccgtaagtaaacactgagttccagtaagtgggtttgctttttatagtgttaaggattagcaattctaaattactttttgtatattctaagattgagcaaataagtaaatatactgtgaacaacagaaaccagacttcctactgttaaaggtagttacaaatacggaaagtgcagaaggaggctagaatgaaaccggtaatgatggctggcacaggaatatgtcttcatagtttttttttgcttttgcttttgtttttttaagatggagtctcgctctgtcacccaggctggagtgcagtggcaggatctcagctcacggcaacctctgcctcctgggttcaagcaattctcttgcctcagtctcccaagtagctggggttagaggcgcataccacagtgcccagctaatttttgtatttttagtagagacagggtttcaccatgttggccaggcttgtctcaaaatcttgacctcaactactccacctgcctcagcatctgaaagtgctgggatcacaggcatgagccaccacatccatcgtattcatagtttttatacagagatagatacagggatacatgcatgcatgcatgcgtgtgtgtgcacatggcctggcatgtgtgcatgtgtgtatgtgtatgcatgccctggtgtgtgtgcatgtgtgtatgcttaccctggctctgtacacttggggggctctgatggttaatttcagtaatttcaggtgttgacttgactgggccacagtgtgtccaggtatttggttaaacattttcttgttttctgtaagggtgttctggataagatttacattttaactggtagagtaaatcagtttgccctccgtaatgcaggtgggcctcatcaaatcagttgaaagcatgagtagaacaaaaagactgactctcagtaagaggcattcctccagcaggactgccttcagacttcatttacaacatcagctcttccacaacatcagctcttcctgcctgatggccttcaaactagaacatcggctctctctgggtctccagcctgcttgctgactctgcagattagacttaccagcctccatgatcatgtaagcaaatccctttaaataaataaataaataaatagacatctctcagtaacatgagtgcccagatcttgatttctaaataacattcacactaaaaagaattagggctgcttgaaaatatgacagatttcaaggctggataaggtaagtacaagatgactctgaaacacttattgccagaatataagaaaaggctcaggccggacgcagtggctcacacctgcaatcccagcactttgtggggctgaggcgggtagatcacttggggtcaggagtttgagaccagcctggccaacatggtgaaaccccgtctctactaaaaatagtacgagtatacatcaccagtaaaggaacaaaacaatagtatgggtgtcctgacaagagattctgaagacacatcacttctgtagtattccagccagaaacgcataacctgaatctaatcatgaggaaatagcagacaaactcaaatggcaaaaatatttctaaaaaataactgactggaattctttaaaaaatgtcatttatcagctgggcacagtggcttttgtctgtaatcccagtactttggaaggctgaggtgggaggattgcttgaggccaggagttcaaggccagcctgggcaacatagtgagatctcatctctttaaaaaaaaaaaaaaaaagtcatattatgaaacacaaaggaagactgaggaagtgttctgtattaaggaacctaaagagacatgaaaaaccaaaagtaacacatataatcctgaactggaacctaaaccaggggaaacagtttctctttcacttaaaaggaaattaggaaatactgcaaaatttaaataaagtctatagagtactgcatcaatgttaacttcctgatactgacgattatattgtggttatatattttttaaaaatccttatttagggagacatacttaggaataaagggacataagtatttaggggctaaggggcataatgtctacaaattactcccaaatggttcagaaacaaatactgtctcatgaaaatatgaaaccaaatatggtaaaaagttaatattaggagaatgtggagtgaaacctatacagtaattctttgaattatctttgcaatttttctataagtctgaaattatttcaaaataaaataaatttaggtaaaattacagtcatctgtgacaagcttttctacgttatttctcaacatatgtccaaacccacatacgtattataaaaaccaaaggcaaacacttaagaaaaccctcaagttattcttttcctgtaccctctacatgcaatggcacatagcctgctgattctaccctcttctcaacagcactattgcctcaattaccatattaccttggaaacatttcctgactccactcacccgcctttacgcacttgcaaaattaattctttcactccatttgaaaatcccgaatggtactccacagccaattcttttacaagacttaagtcttttccagatcatcctcctgcctctctctccacttcatgtttttctcattagcaagaaaccaagtgcaactctctgaacttgcaatactgtttcacggtttgagccctggcctatgatgtcatcttcgctgaaataacattactacaatcctttgtccatgaaattcctactcatgctttaaccctatcttagattcaccttctctgtgaaaccttccctgacacaacactcaaggtgaggatgagtacccattctctccctcctcagtgctaccatttaccttccactctattatgattatcattcatcattatccatctccccttctaacaagagctcactgacagaaggaaccatgtcatttttacttgttgaattacttaatatgaactcaaatagcgtttattacaatgagtaattatatgtagccaggtgtggtggctcacacctgtaatcccagcactttgggaagctaagacaggaggattgcttgaccccaagagttcaagaccagcctgggcaacatagtgagacctcatctcttaaaaaaaaaaaaaaaaaaaaaaaaaaagctgggcatggtagcacatgtctacagccctagctacttgcgaggctgaggtgggaggaccacttgagcccaggagtttgaggttacaatgagctacaatcgtgccactgcactctaacccgggcaacacagagagatcctgtatctaaaaagtaatttttttaaattatatgtacatatacatacacatgacctgagcatatagcaaagggtagatgttaagaaagcctcaatctgtatgttgacaagtaaaatctaagaaaatgaaaaaataaatttcagtctgaaaaatatttaaataggggagatgacccgtgctcttacttgtaatttaatatgtaagaacaagtcctagacttaattattttacactcatgtttgaaaaaaaatctgatgtagttttttttttttttttttaatttttatttgctatcgtttgatgatccagaacactttgtggttcacaggctttacaatcatgagttgggaccaaaataaatgtatgtaaatagaataatataaaaccatattttaccaagtagttttacttggtaatatttaattacaaggatcatctttttggtcaaagcgttttaaaagcagtaattactgatttaaaatcaagtctataaaaatatctaattaggtcttaatcgtattttcttgatctaaaaccaaactgattatataatcttctatcagaaaaatgtttaaaagaaaacattgcaaatgttgcacttgccctcctttctaagggacaaatgaaattattttctaataatgtacattattacagggacaaatgaaattattttctaatcctaaaacagagatccttaaatcagtaaagacatgataatctatatgaaagcttctgtgaaaaaaaaaataccatgacacacaaatatccataaccatacttacagaaattagcactgcttttcctgtcttcttgtgttttaataccccattctcctggtttttccgatgaccttctgatgttcactttgtgttagtctttttgggggacttggcgtaatttgatccttgtttacctggcccttcccacatttccatcgtagcctacatttccaggcataaaatttagcatctattaaaaacatgtgctttacaaagtcaggcactgagccagtttttatttaccattgtgtgtgtgtcccttccctacaagtcccaagcatactgtcagtgaacataagacaaatggctaagtttggagataattttaagggctaatttttaaaaagatttattttcttttgaaataaggaaagtgatttttttccatggtcccttctgtcagtaagctcattttccaaacttgtaatatgacacatatgccaaatatagaagcataaagggtaacttcaaaatctgccctcaatgtttgagtacagagacttgccccacccctgctcatcagagactccatgggagtcagtatctttatctcttgccagaataacagagatccagtcatggcatacaaatttggaaatgaaactgtaagtattaattgtaagtggacctttgagcaatacagggattatgggcacctgccctccacatagtcaaaaatccacatgtaacttcagactccccaaaaactcagctactaagagcctactgctgaccagagccttaccaataacataaaagcaattaacatatattttgtatatgtactatatacaatattcttacaataaagctagagaaaataaaatcttattaagaaaatcaaaagaagagaacatatatttactattcattaactggaagtggatcatcaaaaatgtcatcatccttgttgtctttacattgagtcagttgagaaagtggaggaagaggataggttggccttgctgtctcaggggtgacagatatagaagaaaagccacataaagtgaacccatctggttcaaacctattgttcaaggatcaactgtacaatcatactagtaagtccacagaaaactgttggcataataaaattaacgccttctcatggccttagaaatcctgtcatgatcaaatttcttcaaaattcttagattccataaaaatatatattaaataaaagttacagcttatacatttagaaaaacaaaatttgacaaatactttgacaattatctaataatgttcttattaccattcctagagattaacctaatatgaagcatcagcccctttgaagtagtcccctcagtcatgccagtttctgtaagaaactagaaacttattgctcaataaattactatgtgtagggaaaaaggtcagtgttattttataattctttctgtgctttggagtcataatataataaaccaaattgagtatatggccctaaaataaataatgaactagagcacctaatttcttcttcctcagaggaaaggctttgttgtcacaaagttaattgaattcttatctttgagtctattttttctctatgttctttattaactgacctcttttctccttcttttcttcctctgccttgccctcgttttcttatccctaactgcttttattattagaaactaaaagtctgtcagtctcttaaattaaatacattaactacttacatgccaaatgtttacaccagttttatcataagaaattcaagagtgtctcatttattaatcacgactaatgtttgatttctctgctgtagcagtaaattatttattatctatatttgtgccaactatgtatcttagtatctgacaaaagtaaacacttgaagtgagattaagactattaattcaacaaaagtctacagtatcaatggattatataggatgctataagctctgtactgttcctgcaaccaccttttaaaaaaatgaatagagaatttttttttaaatctttgagagaataatcctgaattctgttatttcatattgtctacagaaatttaattactgccacaaaatgttttcttccttttgcaaaccagctcatagttcatataatgactctcctggatgagtcatctgcaggaagtacaaggttttttttttgaatctgctaaggtaaagactttgaagtataaagttaaaagctgcacagctggaagcattctgggaaagaactttaaaagtgactgaaaccactggtattcacttatattttaacccagctacacattagaatcatgtggggagcttttaaaaaatataaatgtgagagccccagttcaaatcaactgaatgacaatctctgggtttagacctaggcacaggaattatttcagagccccccaggtaaacaacatatgcagctaggattcaaaaccactggccaagtctttatcattattaagatagattaaaacaataaggcatcatttagcactactaacgctttattcttaaagaaatgccatttaactacatgcaaaccttaaattatctactattccaatgtttaagtccaatactcaacaaagagtagatgctccacaatcagtgactggtgatactgatatattaacaaccaatttacaatcattaccttactttagaaggacaatcaaactattctggtgcagaacatattattttgacatttttcaatagttccagcttcacatcttctgaaacaactgatgatccagtcaaatacctaacagcttgcagattacaaggtgatgagacacatggccttgagatgaacgattggtgcatttcagacagaagaacaaattgatcaaggtcatggtatacagacagtagaaacgcagaatcctatagaatagaattctatagaacatcaaatggtgtaacagagacacacaggagtagttggaagaggagagaaaagctaagattcttcacagattaagaagctctctgaataacagacgaagaaacttagatgatgatctacaggcaacagagagtcactggaggttttctaaaaggagtgacttggtgttctacttcctggaagatggagtagatacaatttttcctattcctctcactaagtacaaataaaagtgctacacattacatataaaacaagcctaagaagtctgtgaacggtagagaaaggaacacagactgactaggggcctcaggacctaagattaagtttcccttgagttttctttttgcctaattacatctcagacttgcagctgtaaaaccggcaacctggaaataacaataggagaagacaaaaataaagccccaacaaaagccgccagtcaaaagaccaggaaggagcagtccagcaagaaaaaaaactttagacaaaaaaagtgctactctagcccaaaatacacaaaacactggcctcaccctcacccatgccagaaggtcaagtggagggcctagactttcattcttgaaagtctgtaaggaggcatataacacccctcaggagtgtgaagtgagagaaagccaagtagggatccaacacattcatctagtaatgatctcccacctccaacatcccccatccctgttgtgtgagtggagcccagtggagcccacaaggggcgctgttagaatgatctgacaatgattttaaagcagccatgatgaaaatgcttccacaaggaattatgaacatgtttaaaacaaaaaaaaagaaaccctcactaagaaaacagacaatcttggcaaacaaacagaaaatataagtgaaccaaatggaaactttagaaccaaaaaatacaataattaaataaaagtgcagtaaatgggataaaaagcagaatgagggcacaaacaaaggaaatcaataaaatagaatatagtagaagttgcatgataatatcaagaacacaggtggaagaacaaatgaacagatcctcaaggaccagtgagactatatgaaagatcaaacatttgtttcactggagtcccagaagcagaggagaaagggaggggaggactgaaaaagtacttgaagaaattaagggctaaaaacttccccaatttggcaaagaacccaaacataaagaaggtgaatgaagcggaaagaggagggacacacacaaaaaaaatctgtgccaagttacaccctaattaaacttttgaaaactaaggacaaagaaagcattcagaaaataaatggaatcttatctacaagagaaaacaaaaataattcaaatgaaagcagattgctcatcaaaagccaccaaatgaagtggctcatgatgggggctcaagcaggaagattgctcgggccagttcaacaccagtcttggcaatatagcaagactctcatctttaaaaaaaaaatttagggccgggcacagtggctcacgcatgtaatcccagcactttgggaggccaaggcaggcagatcacgaggtcaggagatcgagaccatcctggctaacacggtgaaaccctgtctctactaaaaatacaaaaaattagtcaggcatggtggcgggtacctgtagtcccagctactggagaggctgaggcaggagaatggcatgaacccaggaggcggagcctgcagtgagctgagatcatgccattgcactccagcctgggtgaaagagcgagacattgtctcataaaaaaaaaaaaaaaaaaattaagaacaggcaggaaggcctagagggagcaattgagcaagaggaagaaataagaggcatatatgtaagaaaagaagtcaaattatctgttttcattataatatgattgtatacctagaaaacactaaagccttcatcaaaaggctcctagaactgataaatgggctcagtagagtctcaggatacaaaatcaatgtacaaaaatcagtagcacttctatatgccaataacattccaggtgagagccacatcaaaaatactatcccatttacaatagccacacacacacaaataaaatacctaggaatacatctaaccaaggaggtaaaagatccctacaaaaagaactacaaaacactacttaaacaagttatagagaactaatggaaaaacattacatgttcatgaattggaagaatcaacatcattaaaatggccatactgcccaaagcaatctacagatttaatgcaattcctatcaaacaaccaatgtcatttttcacagaattagaaaaaactattctaaaattcatctggaaccaaaaaacgacccaagtacccaaagcaattctaagcaaaaagaacaaagccagaggtattacattactcaacttcaaacaatactataaggctacagtaaccaacacagcatggtactggtacaaaaacagacacatggacaaatggaacagaaaagtgaaccccaaaataaagacaaacctcagccatctgctcttcaacaatacaagcaatgggaaaggactccctattcaaataaatggtgctgggataattggctagccacgtgcagaagaatgaaaccggacagtaccttttaccacatacaaaaattaactcaagatgaattaaagacttaaatgtaagacctaaaagcatagaaatcctaaaagaaaacctaggaaataccattctagacatcagccttggcaaacaattcatgactaagtcctaaaaagcaagtgcaacaaaaacaaaaattgacaagtggtacctaattaaactaaagagcttctgcacagcaaaagaaactatcaacacagtaaacagacaacctacaaaatggaagaaaacattcacaaattatgtatctgacaaaggtctaatatccagaatctataaggaacttaatcaattcaacaagcaaaaaacaaccctattaaaaagtgggcaatagacatgaacagacatacaagcagccaacaaacttgaaaaaaatgctcaatatcactagtcatcagagaaatgcaaacatacctgtcagaatggctattattaaaaagtcaaaaaaaatgacagatgctggcaaggctgcagagaaagggaaacatttatatactgttagtgggaatgtaaactggttcagccagtggggaaagcagtttggagatttctcaaataacttaaaacaggactaccattcgacccagcaatcccattactgggtatatatccaaaagaaaataaattgttctaccaaaaagacacatgcacttttatgttcattgcaacactattcacaatagcaaagacatggaatcaatctaggcacccatcaatggtggactggataaagaaaatgtggtacaaatgtaccatggaatactatgtagccataaaaaagaaggaaatcaagtcctttgcagcaatatggatgcagctagaggacatcatcgtaagtgaattaacaaagaaacagaaaaccaaataccgcatgttctcacttgtaagtgggagctaaactacgggtacacatggacataaagataacaagagacactggggctactagaggggagagggtgggtgggggctaagggctgaaaaacaacctattgggtactttactcactacctgggtgacaggaccattcataccctaacttcagcatcatgcactacacccatgtaacaaactacatatgtaccccatgaatctaaaataaaagtttaaattattaaaaatatatatatatgtgtgtgtatatatatatatatatacacacacacacacacacacaaatgaggtggtgtacacttgtatcctagctacttgggaggctccagcaggagcctcactaagcccaggaccttggggctgcagtgagctatgatcttgccactacattacagcctgggtgacagtacaagattctgtctctaaatctctaaaaaactgaatgaattaattaatttttaaataaaacaaaaccagctggatgtagtggctcacacctgtaatcccagcactttgtgaggccaaggcaggtgaattgcttgagatcaggagttcaaaaccagcctggccaacatggtgaaaccccgtctcttactaaaaatacaaaaaattagccaggcatgatggcccacgcctgtagtcctagctactcgggaggctgagacaggagaatcacttgaacccaagaggtggaggctgcagtgagccgagatcacaccactgcactacagcctgggagatacagtgagactctgtctcaaaaaaaacaaaccaacaaaaaaaaaaaacatggaggccagaagggagtggtacaatatttttcaagtgatgaagcaagactatcaacccagaatcctctactcagtaaaaatatattataggctagagggagaaatcaaaacattctcaaatgaagaaaaactaagcaaaactttttccaacatacatacctcaaaagaatggctaaaagaaattttctaaatagaaagataatggtaaaagaggaaaccacagaaaagcgggaacaaacaaaaaaaggtagttaagcaaaaatatgggaaaatacaataggcttcctttgtcttgagttgtctaaattatgtttgacacctgaagcaaggatatagctgtctgacatgattctaaatgtgtgtacaggaaacactgtaagatgattatattacaaatggggtaaagagccataaaggaggtaagacttctacacttcactcaaactggttaaatgatgacaacagtagactgtaataaattatgtatatacaattaatagctagagcaaccaccaaaaaagatacacaaagagatacactcaaaaacgaaacacatgaatcaaaatagaattctaacatcgcttgctgggtatggtggctcatgcctgtaatccagcattttgggaggttaaggcaggagtattgcttccgtccaggagtttgagaccagcctgggcaacacagcatgttggcaacatagcaagaccctgtctctacaaaatatttttaaaaattagccagatgagctgggcacgttggctcacgcctgtaatcccagcactttaggaggctgaggcggacggatcatgaggttaggagttccgagaccagcctggccaatatggtgaaaccctgtctctattgaaaatacaaaaattagccaggtgtggtggcacatgcctgtagtcccagctactcaggaggctaaggcagaagaatcacttgaacccgggagagggaggttgcagtgagccgagattgtgccacagcactttagcctgggcgacagagtgagactctgtctcaaaaaaaaaaaaaaaaaaaaaaaaaaagtagccagatatggtggcacacacctatggtcctagctacttagggggagctgaggtgggaggatcactcaagcccagaggctgcagtgagctgtgatggcaccagtgcactccagcctgggcaacagagtgagaccctgtctcaaaaaaataaaatatgctcaaataacccataaaaagggaggaaaaagaaaacagacaaaagagaaacagggatgaacagaaaataaaatggcagacgtaagccctaacatagcaacaactacagtaaatatattactctaaatatattcattaaaaaacatgttaatagagtagattaaaaaacatcacccaactaattgctccctacaagaaactcacttcaaatatactaaaaaggcaacctcaaagtaaaaggatggaaaaaataaatcatgtaaacattaaccaggctgggcacagtggctcacgcctataatcgcaacactttgggtggccaaggcgggcggaccacaaggtcaggagttcgagaccagcctggtcaatgtgtcgaaaccccgtctctactaaaaacacaaaaattagctgggtgtggtggcgtgcgcctgtaatcccagatactcaggaggctgaggcaggagaattgcttgaacacaagaggcagaggttgcagtgagccaagatcatgccactgcactgcggcctgggtgatagagtgagactccatctcaaaaaaaaaaaaaaaaaaaaaaaattaaccaaagaaaagtgagaatggctataccagagatagagatgtacattttataatgataaaagggccaattcatcaagaagacatagcaatcctaaatgtgtacgcaccaaataacaaagctgaaaaatatgtgaagcaaaaactaaagaactaaaaagacaaatgcacagttataactgcagatatctcttcagtatctctcgctctctttctctctctctcaagtgtttatcacacaagtgtctatcgaacaactacacagaaaatcaacaaggatacagaagaactcaacactacatcaaccaaccagatctaatcaacatttataaaacagtctaccacaaaacaggagaatataaatttctccccaaatgcacatggatcacagactaagatagatcaaaccaagatagacctgagcaataaagcaaatctcaacaaatttaaaataacaaaatcatacagaatctcttctccgaccaatatggactcaaactagaaatcaataacagaaagataaaagaacaatcttcaaccacttagtaaccaagtaacatttctaaaaaatctcatgagaaggtggcagagtgaaagtaggttaatggtaaaaacttgttggaaagatctactcagcagtctgaccaaatccaactttgaggagtttatgaaataggaattattctcccattatatatattttttatttttttctctgctttgtccatgttgaggatggtctcccactttcagattccacttgggcacatattcttttattacctacccaggtaatatttataactacaatagtggtgaaggctgggcacatatttttaaagtattaattttactgatttttctaattgacaaataattgtacatattcacgtagtacatagtaatgttttgatatataatgcatgctgatcagatcagggtagttttttttttttaattccaactttgtttacattatataagaccattttatctaataaaagcctaagtctagatgctgtatgagggataagcatattaaaaaataaataaatgaagcataagttcttataacatttacaaaaatctagaaaactcagctttagaagatggaagctgcccaaatattttgtttgtttttgtttttgtttttgttttaagagacagggtctttcttgctctgtcacccaggcaggaatgcagtggcaccttcttagttaactgcagcctagaactctttgtctcacacaatccctcccacatcagctcctaagtagctaggactacaggcatgtaccaccacacctggctaatttgttaaattttttttttttctttttttgtagagacaagatctcgttatgttgcctaggcaggtcttgaagtcctaggctcaagggatcctcctgccttggtctcccaaagggctagggttataggcatgaaccaccgtgcctgattaaaggatgttatttctgacaatattatttaggatggtaaataattagcaatgacttaaatgtacagcagatacaggaataaacagaaatttacactacctaagagccaaacaggaagtctcaaggaaaataaaaaaatacattgaactgaatgaaaaatgaaactacaatatatccaaatatatggaacatagctaaggcaatgctgaagggaaatttatagcactaaatgcatacattagaaaagagaaaaaatctcaaaccaataatttaagctcccatctcaagagcaaaataaacccaaagcaagcagaagggggaaaaaaggcaaagaaaaacagagacgacacagattaccagtatctggaatgcaacagagatctcatggcagactctgcagacagcaaaatagagtactatgaacacctctacacatttttagactaaatgggccacttcctcaaactatcacaacccatctaatataaaatagataatttgaatagttctttagttatcaagtaaaataaattcacagtttataaaactcaaaaagaaaaaagaaaaaaagaaatctccaagcccaggtggagaagtcaacaaaatactttaaaaggaattaacaccaattctacaccagatacagaagaggaggaaacactttccatttcattttaagttagtattaccctgatgccaaaactaggcaaagacatgaatataaacctaagaatcctaaactaaatattagcaaatagtattcagcaatatacagcaagattatacaaagtaatcaaggggggtttattgcagggatggcaagttgattgaatattagaaaatcatgtcaacaagctaaaggaggtaacaatcacataatcatgaactcttgcaaaaaaaaaagcaataggcaaaattcagtacctaagaaacctcttagaaaaatatgaataaaggagacttcatcaacttgatgaagagtttgcattaaaaacttaaagctaatattatactcaattgtgaaagactgaatactttttcctaagataaagaatatggcagccaggcacagtggctcagacttataatctcagcactttgggaggccaaggtaggaaaattgctttagcccaggagttcaagaccaacctggtcaacgtagggaaaccctgtctgtacaaaaaaaaaaaaagaacaaaaaaattagctgggtgtggtggtgcccacctgtggtcctagctactcaggaggctgaggtggaaggatcacttgagcccaggaggtcaaggctgcactgagccatgatcgcatcactgcactccagcctgggtgacagagtgagatcccgtctttaagaaaaaaaaaaaaaaaaaaagcatggcaagtatgtctactttcaccaatcttttcagtacagttttggaagttctaatcagtgcaataacaaggaaaggaaataaaaggcatacagattaaaaaaaaaaaaaaaaagaagactacccctatttgcaaataattgcctatgtaggaaatcccaagaaatctagcaaaaattcctagaactagtgagttctgtatggctgcaggatataagacaaacatataaaaccctattgtatttctacatactagcaacgaacatatgaacaatgaaatttaaaaaacaataccatttataatcactccaaaaaattaaatacttagttataaatctaacaaaacatgtataatacttgtatgctggaaactacaaaatactgatgagagaaatcaaagagctataaaacattgagagacataacatgttcatggatttgcagactcactatagaaacgtgtcaattctctctgaatttatatgagttaaatgcaattcctagcataattctatcaaaattctttgtaaatacagaaaaaaattatcctaaaagttacgtacagaggcaaaaaaagaatacctaaaacaattttggaaaataatgcagtagaaggaatcagttaacccaataaatgaataaaacagaagagagaactcagaaatagaaacacacaaatatgcccaactgctttttgacaaaggtacaaaaacaactcgatggagaaagactgcctttcctacaaatggtggtagagcaactgaatatccacaggcaaaaaaaaaaaaaaagaaccttgacctaagtctcacaccttacacaaaatcgatcatggacttaaatgaaaagtgaaaaactgtaaaacttttagaataaaagtcttctaaaattttcaggatctagagctgaaatttcatcaaaattaaaaatatttgctctgtgaacaacatgttaaaacaatgaaaagacaagctacagagtggaataaattacttaacaaaccacatattcaataaagaactagtttctagaatacatagagaaggcttgaaacccaacagttaaaaaaaaaatccaaatagaaaatgggcagaagggcagaagtcacaaacagacaactcatcaaagaggatataccgatgacaagcacatgaaaagatgttcaacatcatcagccaccaggaaaatgcaaattaaaaccacggtgagacatcactacaaacttatcacaatggctaaaataaaaacagtgaagaaccaaattgcaaaaacactggatcactcattgtattattctcctagagcaatcataacaaaatactacagactgggtagtttaaacagcaaaatgtcttttcttacagttccggaggttagaagtccacgattaaggtgtcagcaggtttggtttcttctgaggcctcttactttggcttgcaggtactgccttttctctgtgccctttcatggtctttcctttgtgtgcacatatccctggtgtctgtgtgtccaaatttcttcttttaaggacaccagtcagatggattaggggccactctaaagacccaatttcaactaaaatcactttttaaaagacctgtttccaaatacaatcacactctgaggtactaggggttagagcttcacacaacctatgaaatttgtggggatataattccacctttaacattcatatagttagtggcaatttaaaatattaacagtacagacactatgggagacagtttggtaatctctttaaaaacctaaacattcaactaccatacatcttggcaactgcacacttaggcattcattccagagaaatgaagactcatgttcacacaaaaacctatacatgaacatttacagcagctttactcctaagagtcaaaagctagaaacagcctagatatccttcaatgggtgaataaactgtggtacatccataccacagaatactactcagtaattaaaaaggaactatggaaacagagtaacctgtgtatgaatctccagtgaattatgctgaattaaaaaaaccaatcccaaaaatatatatacaataagatcccatttatatagcactcttgaaatgacaaaactatagaaattggagaataatggctgccaggtattaaggaggaagcagtgggtgagaaggaactgggtgtggccacagaaagaaactctttatatcttgctacacatgggtgggaaacttacccgaaacctcttttgtactttctaatatttgaatgctgtgttctaaaataaagtacaagaataacaatggtcacataggggtggatgaagatttattagttaccatatgtggaatgattaaggagggccaggttctgtctaatccagacctgtccttgctccaacaccagtgcttccaatcaccagtctatgctcaatgtttaaatgtcacccaaagcaacaactgcagtgtccagcatgatcctgcacaagagatgcactatagactgaatgtttgtgtcctcccccacaaaatcatacgttaaaattctaacatctaatgtgaaggtattaggagatgaagcctttggtaggtgattagttcatcagggcagagacctaatcaatgagattagtatccttataaaagaaatctggagagttcccttgccctttttcccatatgaagacacagcaagaagatggtcaactacaaaccaagaagctggccctcaccagatacaaaatctgccgtgcttggatcctagatttcccagcctccaaaactgtaagaaataaatttttgttgctcataagccacccagaatatggtattctgttatagcaccctgaatggactaagaccagatgtaaattataaaattctctgtcctatcaacattcttatttccacagtatctgatgtcagcaaagtattacagagaagagcaataatttgcttaaatgattcacactaaggtatgagtaactgataggcttaaatattctctcaaggttcaaaagcagtttagctcaaatgacattttaacagaaactgttatgttcagaacagaattaaactgtagtccaagtgctatcacctgcttaattcagaggccctaatgcatccactcactctatttctaatcttggagttcttaggtattttgaaagtaaatgggatataaatcctaaattataaagtagtagtggcttacgcctcaccataactcaagaagcattatctggttagctgcctgtcctactaggagaaatctgtggtattgagctttcatctggctgtgagtaaaggtaattcaagatctagtaaaaactataaaaatcgctgtttgtcttctgagctgcctgtaagctctcttttctcttgtcttaagttctctatagtatccttcctatctgctgcctcaggagtccaccatcttccaccttcctctatcaaaacagaaaaagatttaaacaaggactgaactgtctttttaaatgcttgtcttgcacttcgaggcagctaagaggtatttttaccttttggtttgacttggttaaattgaggaagtaggggctttgctttttattttgctgggtccactagaaaaattgttttagtacagataccacacctgggagaatctggcccaaaaagttaataggtgacttgacctctcttttgtccctgccaccttttaaacttaattattcagaacccaagactcaagctgcaaagatccagatgttattttcatagtgtctcctttcctctcctggtttgatacccctttctttctttcagtgtggtgaccatttttgcatatcttcctcccttccaacccccaggaatctgttctccatcccaaagttcatacagcctccatcctgtgagaagtaaatgaattataaaagtctggggagaagagaggcataaaatacataggtggctaggctgacctcacagacttccaaacataaaactcaaacatgggaaaagagcaaaggaccaccaccactactacccccatccagctgacaaaaagtaaggttcaacacttttgttttttagtgtttgtgtcttaaaataaatcaccagtacttcttaaaactatcatttaaaacaaacaaacaaaaaaaaaacacctctgagaaactgtcagaggagactaaggagaaatgacaactaaatgcaatcttgttttctagatggttcctgaaacagaaaagaactttaatggaaaccctggtgatatccaaagcaagtctccagttaacagtaacatactgatgctggtttcttagttttgacaaatgaaccacagtaggatactgttagtggaaactgaaactgggtgaggtgtatattgggacgttgtactatttggcaactgttctgcaaatccaaaattattctaaaacaaaaagtatatttaaaaatagaaaagatgaaagcttttaatgtaattttccaagaagtaaaaaaagtaaggtacagaacactatgtgatacagaagcagcaatataggaataggtactgaagtatcgtttgtataaaaaggatgggaaatcatatgcatatatataaaatatttctgaaagaatacataagaatctgatgacactgactttgtggaggagagaactcagcagctgagtaggaatgaaaggaagaatttgtaatgtgtcctcttacaccttttaaattttgaggccaggcacagtggctcacacctgtaaccccagcactttagaaggctgaagcaagcggatctgcttgagctcaggagtttgagaccagcctgggcaacatggcataaaccctgagtctataaaaaatacaaaaattaaccaggtgtggtggcatgcacctatagtcccagctactcaggaggctgaggcaggaggatcacctgagcccagaaggttgaggctgcagagaaccctgactgtaccactgcacttcagcctgggtggcagagtgagaccttgtctcgaaaaaaaaataaaataataaaaaataaaatttgaaacatattaatgtattatctattcaaaaaataattaacttttaaaataaaaaggatgaccaggaactgaactaagacaaagactatggaaataatgtagaggattaatgagaaaaaaaatttaggagctaaaaaagaaaacctaatctactccatctatccattaaggctttctacaaccccttcctcactttttccaccaacctcctttctccttaacgcactacagactttttattctagctgaaccaatctgactgctaattccaaagagtcaccagccatttttcctcaaatccacatctctccctgcaaaacctaactttaaacttaaaagccacccacctatgtgctatttagcattctgaatattctgtctacaccagggacagcaaatacaggcactaacgccatcactactcctactcataacaataaacactgctcaatgatcacagtatcctttcccactaatccagaagctgcgtccaactaacttctcaatgcagtcttccaggcagtcttcactatcaatcaaagctagcccatgaaataaaacctacttgccatatctagtccccactatattaatctgtttgcctcgatatatttgccatgaattttaggtatatttacatgcatatctcactttaatacactttattgtgctttgcagatattgtatttttcatagattgaaggttggtgataatcctaagtggagcaagtttgtcagctcatttttccaacagcatgtgttcattttgtgtttctgtgtcacattttggtaattctcacaacatttcaagctttttcattattattatatctgttatggtgatctgtgatcagtgatctttgatgttactactgtaattgtttgggggcaccatgaatcaaacccatataagatggcgaacttaatcaatacatattgtgtgtattctgactgctccgctgactggggcttctcctgtctctctccttctcctcaggcctctctatcccaggagacacaataatactgaaattaggccaatcaataatcctacaatggcctctaaatattaaagtgaaaggaggagtcacatttctcactttaaatgaaaagctagaaatgattaagcttactcaggaaggtatgtctaaagacaacagaggtcaaaagctaggtctcttgtgacagttagtcaagctgtaaatgcaaaggaaaagttattgaaggaaagtaaaagtgccactccagaaaacatacgaatgataagaaagtgaaacagccacattgttaatatggagaaaggtccagtggtctggatagaagaccaaaccagccataacattcccttaagccaaagcctaattcagagcaagacactagttctagtccattctatgaaggctgagaggtgaggaagctccagaaggcaagtttgaagctagtaggagttggttcatgaggtttaacgaaagaagccatctccataacataaatgtgcaagatgaagcagcaagtgctgatgtagaagctgcagtatgttatcaaaaaaatctagctaagataattgatgaaggtggctacattaaacaacagattttcaatgtagatgaaacagccttctattagacaaagatgtcatctaggactttcatagcaagagagaagtaaatggcttcaaaatttcaaaggacaggctaactctcttgttaggggctaatgcagctggtgaccttaagtgaaagccgatgctcgtttaccattctgaactgactgaaatctactcagtctgttctctataaatggaataacaaagcctggataacagcatatgtgcttacagcatggtttactgaatcttttaagcctactattaagacctgctgctcagacaaaaaaaaaaaaagattcctttcaaaatattgctgctcattggcaatgcacctggtcatccaagaactctgatggagatgtacaaggagattaatgtttccatacctgctgacacaaaagtcattctgtagcccacagatcaaggagtaagtttgactttcaagtcttattattttagaaatacatttcaaaggctatagctgccatagatagtgatttctctgatggatttgggcaaagtaaattgagaacattctagaaaagattcatcaatctagactccattaagaacatttgtgattcatgggaggaggtcaaaatatactgacatgaataggagtttggaagaagttgatcccaacttccatagataactttaaggggttcaaaatttcagtgtaggaagtaactgcagatgtggtagaaataacaacagaactagaattagaagtggagcctgaagatgtgactgaattgctgcaatctcaagataaaactttaacagatggggccgggcacggtgtcttacgcctgtaatcccagcactttgggaggccaaggcaggcagatcacgaggtcaggagatcgagaccaacctggctaacacggtgaaaccccatctctactcaaaatacaaaaaatgagccgggcatggtggcaggagcctgtagtcccagctactcgggaagctgagacaggagaatcacttgaacccgggaggcagaggttgcagtgagctgagatcctgccactgaactccagcctaggcgacagagcgagactccacctcaaaaaaaaaaaaaaaaaaactgacagatgagcagtcacttcttacagaggagcaaagcaagtagtttcttgagatggaatctactcctagtgaacgtgccataaacattgttcaaatgacaacaaaggatttagaatgttacataaacttagttgataaagcagtggcagggtttgagaggactgactcaaattgtgaaagttctactatggctcaaacgctaccacccagcatctcatgccacagagaaatctttcatgagaagaagagtccatcaatgtggcatacttcactggtgggttgttgtttttttttcaattttatttaaaatcaggacacatctcattctatgtcatagaatgagggagtctatcttgaacctattctggttcagggggctgcccttatgaaaaaaaaagaaaaaggcaagaaagtaattaccatagctaccccaaacttcaagcaacaaccatcctgatcagtagctataaacactaaggtaagaccttccaccagcaaaaagattacaactcacttaggctcagaggatccgtagcactgttaagcaataaagtatttttaaatgaagatatacgtagatcattttttagacataattctatcacacattttgtaaactacagtgtgaacataacttttatatgcactgagaaacagaaaatcgtgtgacttgctttattgagatatttgctttactgtggtggtctgaaactgaactggcaatatcttagaggtatgcctacatttgtatataccccattttgttctgcaaaggattaaagacacaataaatgaactataacaagttaacaaactaaagataaaggcaaagaatagagaaaagaaccaaaaatggtgccaagaaaaaggctaaaaattgtataatataaaaacctatttacggtatggagtgggccacaaatctagttctggctttctagtagccataacaaaaaggaaaacccaggcaatctaagagatacacagagaagtactcagaaggggagctaccttggtagttaaaccaaacagtaatttcgtatagcaaaaagaaccccatagaatgatcaaaatataggagacacataaccaccagtcttcaaagggttagatgtttctcatattgtccctcaggagagacctatgacaccttaccaaagcccaatgtggcaaaattgattttacaaagacaagacacaagctttaagagctctttattcttttactcagtttcttccttcattgcctccctaatcagattataaactccttgaaaacagaaccatgttttctaattcttatatatagctccaaagtattttgtattctgcagaaaagatgcaacgtcagtgagaatttacacagtgcaattcaagacttttctgataaaaattatctaacctaaactcagtaattcccacttctactacaaaaacatgctaactgaagccccaatagatagaattcctaaactttctaaactattactgaatcacaattcatgacctctcaaaagcattttgtttcatacatccctagcacaaagcatgcaaggataccaaatcaatatcactgaacctgatcaaataaaatgaaactcataagcaaaagctctggcaatacccactaaaggaaagacaatattactatctttcaagaatataatcaataggtctttacaaaccaattgacaaaggcaggttcattttctaaatgattctgcaaatctactagaaggcaattaaattataacgcagattacttctttccaagaatgtgcagtttctgcatatgccaagctgctgaagaactgtacttctcagctctcacacacacatgcacacgcacgtgcatgcatgcacacacacacacaccactatcaaaccagctctgaccactaacttacaatttacttctgtgctttacctggtcaaactgaaaatgaaattaggagtaggtaataaattatttagataaggtgattatgggaaaatgaagtatcatcttaaattactactcttaagcactggcattgggacacattaacaatcctctatttgtattttattaatggaagtcattaataaataagtagtctcatccaacactggcttagttcattcatacacttagtatttcagtttatagtaggttccccccttggtattccctgtacataggggcatgccctatcatcccaggagtgaatacttgtaatgagccaaagaatattcccaggactgggggagtccaccaagtagaccttggaaaatccaattcctgcacctttgtttctttatctattagaaagggaaatggaaatcatctctatctgataggattattggaaagattaaatgagataaggttgtaaagtgcctagtgttagttctctagctttttgtttgtttgtttttgagacagagtctcactctgtcgcccaggctggagtgcagtggcgcgatctcggctcactgcaacctccacctcccgggttcaagcaattctctgcctcagcctcctgagtagctgggattacaggtgcccccacgacacccgactaatttttgtatttttagtagagacggggtttcaccatcttggccaggctggtcttgaactcctgacctcgtgatccacctgcctcagcctctcaaagtgctgggattacaggtgtgagccaccgcacccagccttagttctctagcttttttataggtaaggaaaacagaaggatctaagcacttaggcgactcatccacagccaatggctaataaacataggacagaacaaaacttctgacttagggcttaatgttctttccacctcaccaagcagccttaaattaatagaactcaacatctcaggtttgtcactgttgggtattcactacatgcaaagaaaaaaaaaattgactattttgaacatctattacatgctagaaactaatgtctttcttcataactgccctataagtgttatctcatgttactaagaaattaacttgtccacagtcacaaggctaacaagtgacaacacaagattcatccagatctgtttagtcaatgattttacctaccatccttcttaaagagtgtatttagataccattgtctaccagaatcaaatcccaaatggcctgtgaatttttatagatacttgtgatttattagtggaaactgtccctagctccaccatcctatctacttaaaaatttgttcctattaggttaaaacataattataataactgtagtaacaaatttacatttgtatagcatgttacagttcattacatttttttcatttttgttagatgcaactactgagccttttcatatattagctcacatatcatttaatatttcaagactcttatgaggtaggagttattgtcatttgacaaataagaaaacgggccaggtgcaatggctcatgttaagaaggccaacgtaggcagattgcttgagctcaggagtttgagaccagccttggcaacattgagaaacttcatctctacaaaaaatgcaaaaattagctgggcatggtggcacatgcctgtactctcagccacctgggaggctgaggtgggtgaatgacttgagcccaggcagttgaggttgcagtgaggtgtgatcacaccactgcacttcagcctgggccacagagtgagaccctgtctcaaaagaaaaaaaaaaattagaaaggtcatctcagatctctctctgcccccacagttgtcagatgatttctagtaaacgtttaaagggcagatattttaaactgttccagagcacagaaaaaagtgaaaagtttcctaatcattcttaatcctgacttcatcttgacaccgaagccaggcatggatagcaaacttaaatgaaaacataatattagatttatcctttgtaattacagatggaaaagtttaacatatttaagtgaaaaacaaaggaatatgtgtagtataatcccatttgtaaaagaaaaaacattatgaaaagaaacatgtctgtatgtatggtaaaatatggaaatgtgtatttatagataaatacacacataaatgcaaagatacaggtttggaaatataaacctcaaactgtcaacagcagtttctccaagatggaagtggtcttaggagtgaagaaggggaaaaagacaaaaagtgaagggagattttcagcttttactctctctatatatatacacatacatactattcaaattctgaaacagtgggttctaggatcggctatgctattaagaagctgttactaggttgaatcactctgactctgtttccccattggaaatgtggaaagcagacctaccttattatgacagaagaaaaggaatttatttgaaaatgcgtaataaaatctgatgaatatgtggcagtgttgccacaacaccttatggtttgttattgtttggtttgattttttttatttttccctcactttgtcactaatcaaccagacattcacaaacacaatttaatttctgtatgcctcattgagtgcaggaagtagagtcagaagacctgagtttacactcagaccttgcctcttattaactgtaaggttaaaaaaacaagcaaatgattaaacaactttgcactttagtttcctggcagtaaaataggaataaacctaccttacagcatcatttaaaacattaaatgagaaaattatatacaaatggccaataaaaacatgataagatgaaatacaaatgaaaatcacaatgcgatatcacttcacagccactaggatggctatcatcaaaaagacaaacattaacaagtgttggcaaggatgtggagaaaatggaaccctcattgctacattgctataaccctacattgctagaaggaatgtaacccttctagcaatgtagaagggttaccctagaaaatggaaccctacattgctagaaggaatgtaaaacagtgcagcagctatggaaaacagtcaagcagttcctcagaaagtaaacagaattaccatataacccagcaattacacatctaggtatacatccaagaaaattgaaagcatatataccatacaaaaacttgtaaatgagtatccacaacattatttattatggccaaaaagtagaaacaacccaaatgcccatcagttgaagattggataaacaaaatgtggcatagccatataacaaaataatattctgccataaaaggaatgaaatattgatacatggtataatatgaataaaccctgaaagcattatgttaagtgaaagacactaaaggccacatattatgattctattcacatgcaatgtccaaaataggcaaatccatagagacataaagtaaattagtggttgtcaaatatggggaagggggaatagtaacaaaagctaccaggtacaaggttctttttagggtaataacgttcttggattagtgccgacatttgcataattttgtgaatatattaaaactactgaattgcatactttaaaaaagtgaattctatggcatatgaattatatctcaaagaaaactattataaaaatttaagtctctgcttttttttcttttgagacaaagtctggctgtcacccaggatggaatgcagtggtccaatcatggctcacttctctgcttgctactttttattagtaaatattctactttcctcaagaggttgctcatgttgcttgtaacagctttaaaagatctttgaagttagctactatacagatgaatggtatttttagtaaagtaaaactactataacagagaaactttctaaaaatcggattagtttggtacaatttcattttttcaaaagaaatgtcattaataccaagttcatttttagagagtggaaaagcttcaacaagtccttataaaaatacattttttaaaaaggtcaaaatgcaatactttgttttcttaattattggacatttcattttcagatatatcattagtagattacctgtttaaaatgtcattaaatgcctagcaatgaattaaaacccaagtagatgcaactttgtgacctctacttacaactttctacattctgcattctgttgtcagattcctagtccatcactagctcctaatctcttacatcaattattccattcaattcttattcacaggggctaaaatgtttggtaaatgcaatcaattcatttttctaatgctggggaaaaactagagtgggcccaatttttaaggttaaatttagtccagaatgtttgaataaatattcaacaaaacgatttcctggaatttggaacataaaaacagcctatagagttgtgaaatgctttctaggtccttggggaattttttcacgtatttagtcatggggcaaagtattacgtataaaagcttcctggtcctagaacaaagacgtattttactgctcaaagctaaaggaattagtattgttaaactaaaatagcataccaatgaaaccagctaggtattggcataacttaaccaaggtatgtaaccaaagataaattgtaccttattatgcattcttccttgggaggaaaaattctcacattaataagatttagccagccaaaacagaaaaagtatatagatatatgtgtgtctgtgtatgtaggtatgtataaggattaggattttgagtggcaatttaaatttgacggtttgccaagctatgctgggatacatagtgggcatgcttgacacaagcaaaacgtgaagtaagagacgacctgtcaaacagctgctatctagttactccctcggcagcactcccaacttctcccgcgatgtctgtgtgtaagagaaagatgtcaaagcaccaagaaaaccacgggggctgtcagagcaacagccaagtccaaaccgtgcatcccagggtgaaatcccacccgtaccctcaagagctggtcagactgcggctcttttctaatatgagtctacctaaaatagaaaaataaacacaaccacagaccctggccaaccctctctctcctcccctttgtgactctcccaaacgctggagggatgttaacctctggcaggcccgtggaagccaagccccgcgacctgaggaggcgtccaggagcctcggcgcagccctggggcctcgagcccgtgtcctccacccacccgacagggccggtcaccggtcacacaaaggagccagtcgcgggcgctggacgcgggactcgcccgagagcagggagccacatctggttcctgcacgctggcaaaagagacccgctggaaaataaggactaacgcccaaacctgttgcacaattcgggtccctttcacccagaaatgaacaagggcgctcaggaacggaaaagcgcgcggcccggtctctgcgggccgcggccgcacccggcagacggcgcggaggcaaaggcggcccgcagggctcccacctccggcgctttgtctgtggcggcaaggcggtgggggcggtcggggcgttgggagcagaggcggtggcggggcgggggcgcccctccttcactgcgtagcccctccgccccgcggcccgcgcaggggaagaaagccgggcccgctaccgccgccgccgccgactgcaccggcccaagccggccacccggccgcggggcctgcgcgcttctcccgcccgggccgagcggcggccacactcacctggctggcgctgacgctagcggccggcggctccggggcgttggggaagacaggggaacgctagcgaggtgcgggcggaggcggagggcgcggcgggaggaaggcgggctgggggcggagcgggc

SEQ ID NO: 1595 - DNA, 48979 bp, Homo sapiens
gtcagtggctgtgataggtttattcagaggaagcactagactctggggtagctcacatgggtaagaaagacttccaggagcaggcattgaagggttggcaccctgggtgagtgtccaaggtcagcgagagtcacttgtggaggggacggaagatgacctggctgatctggccagggatggtgtagaagaccaggaggaggaagacggtgagcagcaccagtagcagcagcaccagggtgcgccagtaccggcgccagatgaagaagacaaaggtcttcagcgggttcacaaaccagttgaaggaagttttggggcggctgttgaggagaagagtggtgtcaggatgaggaggaagccccttgaccacccccacctccccatcggcccaggctgtggccccagccccggtgcctgactcacctgggtttctccagaggctctggctgcttccgccccttccccactggccgtttctcggcctcctccacagtcagcagctcaaactctgcctccaccttgccctaaaaaagacattcctgcatcactgggagcagggggcgggctcaggccccagctcagcctggcctctgcccacgggcacccaccgtgaggatgtacacattgccacccatgtctgtgaactccaggtcttctggccggcccttcctcctcctctgctttcgcttcttcttgccagcctgagcctcctgcgcctcccgctccacgtcctctgcctccttcagcttcactaccggccaccagcccctcaggcggcggcagcgaaacagattgcacctcggcccggccccattgcgggccagctgcacagagcagagctcggggccccgggccccacgcaccatgtctggtagctgcaactccagggatcctgcaagtccagagcacaccagattaggcatgggatcaaagtctcattgtgccaggggtgaggaggcaacacaccaaggttgtaaattggggcattgaaagttgttgcagtgtgcggtcaggccacagctatagaccacccagaccacagcccagcggtccacccattgctacttcccagtggaagagggccaagggtcgggatcagagtgccaaggaccaaaggctgtggagtcggtgtcagggtgacaagctagggtcaaatcagagttgaatcagagactctgggtgggaatggaggttactgtggtctaggcctaattaactcagtaattaggccagaaagcaaaggtttcacacctcgggtccaaaatcccaagattcaaggttgggtcagagtagggaactgggggacggaagtgagggctggaggcaggggcggaggtgagggctggaggcaggggctgagggtggggaaggctaagcattgtaataccaaggaagtcattggcagagatgcggtcatagtcccagacctgcaggaccagcactgcaggctgccggaactccgcctcctccagggcaaagggtccagacctgcgccagacgctcacctcccgctccgtgggcaggtagtcaaagcggaacacaaagcgccaattgaagttcccctccccagtcagggagttgaagtgaacgtctgtctcctgcttgtcatgctccaaccccttcacccagctggggccggggtgggtgagcgtcagggctggagctacatggagaacccactcctcaccccgctctcagcaccacggagggcctggggtcggggctctggactcagcccgagggcccacacccatttgcaatccccctagtgcaccgccgttgccccgcccggccagcagcctacctcttcacatagatgtcactcgacatctctccggtgagtggattctcgtcatccagaaccacatcctccgtgttccagatgacaactctgagctcatagctggggggcacattagggggtggcttcagactctcgagtggggccctaaaaggggctgcaggaagcaggagggacctgggccggggccactgacattcactggacacctgtgtgcccagcaggggaatccaatgcctgtggtcccatgaagggaagccccaggtgtcactgaccaccctggccacagcagatggccccaggaatggtctgtggggccagcgaggttctccttcccgtgaatttagaatcagggcgctgcactgttgcatggtgtggcatcagatgcaaagctggagctaccacaagccagagtttggggatgtagaaaagtgagtgaacagaaagccagtctgcagggagaagagggaggatgagagatgggggacaggagcatacagcgcctgagggacaggagggctgcgacactctggaccctacccgcatatagccctgtctttgggggccatggggttgcctggatagctgttttctccagcccagcatcaatttcccctcatttgttgacagcaccgtgattttctgctggtgacccacccccaccccaaccacccctccccaccaccactgtcaatctatggaattctggtggggcaggcccctccctccctggctggacggggtcggggagacatcactggactggccaattcgagtattacagccccctaaccacaatgattggttcttcagggcacagcatttgacccaagctggtcggctgagtcagccctgaggcttttgctgtaactgggaaagaggtgtttgtttctgctcaagtggcctggctgagatgtaagcctcgcactgttagatgccactttgcccccagccctgcagagggctccctgagagcgacaccaaggaaagcagagcccagaggcagaaagtgacaggctgctgatatccgagcatctgcattcagccctgtgtgaagtggctgtgacccacacacaactccactcagatgagcttaggtgggaagggggcttaccaaaaggtacttggactcaatttacaagagacactcaacttgcaatgcttttgaataacagggaatttaatgacacctaactgaaaagcctgtgatgagcaacctctgcctgcttcactggggacccgggttttcagaggagccttgtacaggtagaccaggatgtgcacccgccttgggaggaggcgacagaactctcacctgattggctgccgaggcttgatgtcaactgggggtggagcaggcacatcttgaggaaagatgtcaatccacatgtgaagagatccctggggggacaggaccaggctggagggtcttgccaggctcccaaccttccctgacagccctatggccacaggctgtgccttgtccccaagtggagaaaagagctagggtcaaaatgacagggtcgggtagatcctgggggatgaggatgaaggtggagtctgaagtgtgggttccaggatcaaggttagattaggggttcaaggatgaggtccaggctgggcgcggtggctcacgcctgtaatcccagcactttgggagtccatggagggtagatcacttgagctcaggagtttgagaccagcctgggcaatatgacggaaccctgtctctacaaaaaatataagaactagccgagtgtggtggcagacgcctgtaatcccagctactcccgaggatgaggtgggaggatcacttgagcctgggaggtggaggctgcagtaagccgagatcatgcacctgcactccagcttgggcaacagagtgagaccccatgtcaaaaaggaaaaaaaaaaaaaatgaggttccagaaggggaagttgagattaaaagtaatatctggtgttccaaggtccagatcttagggatctggggggaggtcaggttaggaaccccacatctgagtcttggggcccgggggtggggatcctgtaggactagggtcagggtgaaggtgtggtccaggatggaggtccaagatgagcagggacacagggaccagcaacaggagctgcagtcaggagctgcaggtggcacccaggtggacatcttggggaaaggctgtcctgggggcccagggtccaggatcaggtgggtgtcctgggattctaagagtcttgtgattctgggcctgggtgctgagccctcccacacctgtagcagccctgggctgtggggatggtagagaggcctggtttctacatgctcgggtaccagctggatcccaaaacccggcatttcctgccagcgccgcagcacaagcaatgcctgggcctcttcagggtccccgctcgccactgtggggctgctgctgcctgaagcaagaggtgtgtgagcttagggctccacacagtttccatctctcctcccgccctccccccccccccgcccccccaacagaagctctaagctggggaagccactgtgttggataaagccctgtggactaggagagcagctctgtaatgcacaaaaagtgggagacgctgctataactttgcccagtgaaaagccagcagtcagtgggacagtgggattggaggtactgccacctttgcctagaccctatttagagaataagccaccagagcaggcacactggctcatgcctgtaatccgagcacttttggaggccaagatgagaggattgcttgagtccaggagtttgagaccagtctgagcaacatggcgaaacctcatctctaccaaaaaaaaaaaaaaaaaaaaaaagaaagaaacttaggtgggcgtgatggtacgtgcctgtaatcccagctactcagggggctgagatgggaggatcacttgagcctgggaggtccaggctccagtgagctgagatggcaccactgcactccagcctgggtgacagagcaagaccctgtctcaaaaaaaataaataaataaaaaataagcctccagccatttaattctgcagccacattctgttatatggggcgctctatgggacctctgtgttccgggaacttgattagttatgggtccactttggctctttgggggaatctcacactcaccaataaagactgttttctccctaatacccaagaacctcgtccttactcaaccaaattcacatctacttgctgaagaaatgggttattttggggagcacacaagactgggccccctgtaccttgttctaccgacatcttgcttgaacagaaaggggctgatacctgggggcagggtctccggtggtgtcaggaagactttgctgcccaccttgacagcaccggctcggtattcaggggcagggaggccacagcgttggcacagccccgccaggatctgcgaaggccagaatgcatcacgccaggcattgtaaccatctctacaggcagaaaaagaagatgcgtcagctggggctggtgtagggacacagctgggcctggggcagtgatgacgtcatgaagacatgaggtctaggttcaaaactcccaacgggagacaggttagtcctcatttatgataacaatgaatgaaaaaaatgtagtccaggtgcttccattaagaagatactgatcttattacctctgttttgcagatgagaaaacagacttgaagaggttaagagggcctggcatggtggctcacacctgtaatcccagcactttgggaggcagaggtgggtggatcacttgaggtcaggggttcaagaccagcctggacaacatggtgaaaccctgtctctactaaaaatataaaaattagctggacatgggggcccacgcctgtaatcccagctactggggaggctgaggcaggagaatcgcttgaacccaggaggtggaggttgcagtcagccgagatcgtgccactgcactccaacctgggagacagagcgaaaatataaaaattagctggacatgggggcccacgcctgtaatcccagctactggggaggctgaggcaggagaatcgcttgaacccaggaggtggaggttgcagtcagccgagatcgtgccactgcactccaacctgggagacagagcgagactgtttcataaaaaaagaaagcggtcaagtgacattcgttacaggatcccgactcccaagcccaagtcttgaccactgagctatgtcttggttggcagtggcggtgggtgggagggtccccttccatgaaatcataggatctggagacacaaaagggaatgtgagcttgaatgtgtttggccagaaactcagaatggctcctgtgggccctgctggacccacacttcatactgggaggccagcccacagtttgctctgtggtggctatagaatcggttttccagatcaatgtgggtctccccgatgaggtcgtcagaacccacgaggtcatgatcaaatacggcgaccgtcagctccgtctcagctgggagagagatgcttagctccaggatcctggcaaggagggagagggactgaggtcacttccatgctccaggaggtggtctggggaggaggcgggtgtgtcagcatcccctgtccattcccttgccattcctaggccagctgccacaaggccacagggctggatgctcctgcagctaccccgtttccaccccacagggcccagcctcactctccaaagatggggttgagctgcttggggatgtagcgttccttggtgtcctgccgctcccggccagcgctcaccaccacgtaagggtctgctttgccattggggtctgcaggagccaggttggtagcctaggggaacagcatggagtggaactgagagaaatgtcattatgataacccaaggttacctttgtaggacctaatttcccattgggtgaaagcaggaagttatcaaggagagatctcccactgtgaggagctaatggagaggttggacaagatgacttttattttcaattagttatgaaatagttaagtcatacaaacaggtataacaaaaagtgtaatgaaacaaaatattttgaaagatgtataacggacttactattcaactcataactttctatatggtttgacttattttttaatttatgaatttttttaatagagatgagggtctcactatgttgcccaggctggtctcaaactcctgggccgggcgcagtggctcacacctgtaatcccagcactttggaaggccaaggcaggtggattatttgcagtgaggagtttgagaccagcctagccatcatggaaaaccccatctctactaaaaatacaaaacttagccaggcgtggtggcgcacacctgtagtcccagctactcaggaggctgaggcaggagaatggcgtgaacccgggaggcggagcttgcagtgagccgagattgcgccactgcactccagcctgggcgacagagcgagactccgtctcaaaaaaaaaaaaaaaagaaagaaagaaagaaagaaagaaattacatcctgtgtagttttttccccccactttttatagagacaggggtctcacactacattgccaaggctggtgttgaactcccggcctcaaatgattttcccacctcagcctcccaaagtcctgggattacacagtgtgagcctctgcacctccagccctgtgtagtttcttgactgaaagttgttgggtgattttttcaattgttgtttgcctaaagaggtctttcatttttttctctcttgaatgagtgtttcctaggacacacaattcaagggtgatagttatttttctcttagtgctttgaagatattattctatttttcttccagcacttttggttgctgtagagaagttgatgggctgactgtcattccattgtggtaatctgtactttctctatgatgatctttacatctttttaatttagagattgggtcttgttctgttgcccaggctggtctcgagaactcctggcatcaagcagtcctcccacctcagccttctgagtagctggggttacaggcatgagccactgtgccaccttgattatttttttggtatttatattttccatagcacttatgctttcttcttttttttttttttttttttccctgagacagagtctcgctctgttgcccaggttggaatgcaatggcatgatctcggctcactgcaacctctacctcccaggttcaagggattctcctgcctcagcctcccgagtagctgggattacaggcacatgccaccacacctggctaatttttgtattattagtagagaacggatttcaccatgctggccaggctggtctcaaactcctgacctcaggtgatccgcctggctcagcctcccaaagtgctgggattacaggcgtgagttatcacgcctggccacacttatgcctctctaacgcactgaaacatttacttattttgttaatgtttgtttctcctactagaatgcagtcttcataaaggcaaagctttttttctccttgtgattacatattaattttattctttgaaatctctttcttctcttgtcctgtccaaatcctacttagagatactcagtcaagccttaatttcctgtgctggctcggctcagtggttcatggctataatcctagtactttgggaggctaagacaggcaggagctcaggagttcgagaccagcttgggcaacatggtgaaatcctgtctctactaaaaaatagaaaaaattagctgggtgtggtggcatgcgcctgtagtcccagctacttgtgggggctgaggtgggaggatcgcttgagcctgggaggtcaaggctgcagggagccgtgatcatgccactgcaccccaccctgggcaacagagtgagaccctgtctcaaaaaaaaaaaaaacccgcgaatttactgcagagacagtaataaaggagtatggtagtggcataaacatagatcagtagaatagaactgagagtccagaaagaaatccacatatctatggtcaattgatcttcaacaagggtacctagaccattcaatgggaaaagaaccatctctccaacagatggagctgagacaactggacagtcacatacaaaagtatgaggtcagaccctcacctcacactagatacaaaaactaaccccaaatggatcacagacttaaacatgagagtcaaaactcaaactcacagcagaaaacaggcaaaagtcttcatgaccttggattttgcaaaggtttcttagctataaccaaaaagcacagtcaataaaagaaataaaaatagacttcatcaaaattaaaatctcttttgctttaaaggacactatcaatagagtgaaaagacaacgtagaaagtgagaaaatatttgcaagccatataaaaatctagtagccagaatatacaaagaactcctacaactcaacaacaaaacaacaatctaattttaaaacggacaaaggactttagacatgtctccaagatatacaaagttctaaaaaccacatgaagactgttcagtgtcattaggaaacaaatcaaaaccacaattagataccactttatacccactaagatgatcttaattttttctttttcttttttttttttttttgagtcagagactcgctctgtcacccaggctggagcgcagtggcgcggtctcggctcactgcaacctctgactccagggttcaagcgattctcctgcctcagcctcctgagtagctgagattacaggcgcctgccaccacgcccggctaattttttgtatttttagtagagactgggtttcaccatgttggccaggctggtctcgaactcctgacctcgtgatccgcccacctcagcctcccaaggtgctgggattacaagcatgagccactgcgcctggcctgacattcatttttttaaaaggacaataaaggctaggagcagtggctcatgcctgtaatccctgcactttaggaggcctaggcgggtggatcacctgaggtcaggagtttgagaccagcctggccaacatggcgaaaccctgtctctactaaaaatataaaaatcagccaggcgtggtggcgagcgcctgtaattccagctacttgggaggctggggcaggagaatcgcttgagcccaggaggaaagggttgcagtgagccaagatagcaccactacactccagcctgggtgacagagcgagactctgtctcaaaaaaaaaaaaaaaaaaaaagaaaatgtaagttatattctggcactcctttgctcagaaccttcctatggcttcccatgtaattcagaataaagtgaataacaaaacccaacatgatctgctttctctgcccatcactgctccatttcctctgaagccttaattcctaaaacctgttcatttatcctgcctgctacggccacaaggggccccttgttgtttgtcacacacgagtcatggttctacctgatggcctctgtaccagctgttctgcctggaatgctttctccctcaggtagccacctggataactccttggccccctcctagtgtgtatttaagagacagggtctctctctgtcacccaggctgaactgcagtggtggcatcacagctcactatagcctcaacctcccaagctcaaacaatcctcccatctcagccttcctagtagctgggactacaggtggaagccactgtgcccaactctagtatttgtttaaataacactttctcagccgggcatggtggctcattcctgtaatccagcattttgtagttcgagaccagcctgggcaacatagcaagacctcgtctctaccaaaaaaaaaaaaaaaaaaaaaaaaaagtcttattgaggtctatcaactccgaccatccatttgcaacccacccccagcactcccccatccctttatcctgacatattttctccacagcacttataattttctaacatataaataagatatataacttttttttgttttgagatggagtttcgctcttgtcgcccaggctggagtgcagtggtgtggtctcagctcactgcaacctctgcctcctgggttaaagcaattctccttcctcagcctcttgagtagctgggactacaggcatgtgccaccaggcctggctaatttttgtatttttagtagagacgggttttgtatgtttagtagagacaggagttcgggctgatctcgaactcctgacctcaggtgatctgccccctcctcagactcccaaagtgctgggattacaggcgtgagccaccatgcccagcccgtaagctatataatttacttattgattatggttattgttcatctcttttcactagaatgtaaagttcacgagggcactgattttcatctgttttactcactgctttttatcaccagtacccagaacactgcctagtacctcataaaaaatgcaagaaaggccgggcacggtggctcacacctctaatcccagcactttgggaggccaaggcgggcagatcacctgaggtcgggagtttgagaccagcctgaccaacatggagaaaccctgtctctactaaaaatacaaaattagctgggtgtggtggtgcatgcctgtaaaccccagcttgaggcaggagaatcgcttgaacccaggaggcggaggttgcagtgagccgaaattgcgccattgcactccagcctgggcaacaagagcgaaactccgtctcaaaaaaaaaaaaaaaagaaaaaaaaatgcaagaaatacctgtggaataaatgtttgtgagtgaaactggcctagaattatactttctcatgtcattcttctcaggttttgcatcaacattatgccaccctcatggaattaactggggtatttctttttatattctctgaaatggtttgtgtaagattaaaattgtttcatccataactggtggaaactgctgctgagaccatttggtctggagtttctgacacaatttcttttaatacttatagtactattcaggttttctggccaggtatggtggctcatggctgtaatcccagcactttgggaagccgaggtgggtggatcacttgagaccaggagttcaagaccagcctggccaacatggcaaaaccctgtctctactaaaaaatagaaaaatcagccaggcgtggatgcaggcacctgtaatcccagctactcaggtagctgaggcaggagaattgcttgaacctaggaggtggaggatgcagtaagccaagattgcaccactgcactccagcctgggcgacagagcaagactatctcaaaaataagtaagttttcttcctttttttctggcacactgcatcctcagtggctcaagcaatcctcccacctcagcctcctgagtagctgggacaacaagcaggaaccaccacgtccaggtaatttttattttgtttttattttttatttttttttttgagacagagtctagctctgtcgcccaggttggagtgcagtggcatgatctcagctcactgcaacttctgcctcccaggttcaagcaattctcgtgcctcagcctccctagtagctgggactacgcacatgccaccatgccctgctaatttctgtatttttagtagagcattggggtcttaccatggtggccaggctggtctcaaactcctgacctcaggtaatctgcccaccttggcctcccaaagtgctgggattacagaggtgagccactgcacctggcctaacttttaaatttttttgtagagatagggtctcagccgggcacagtggctcatgcccgtaatcccagcactttggggggccaaggggggggcgcggatcatgaggtcaagagttcaagaccagcctgaccaacatggagaaaccctgtctctactaaaaatacaaaaaattagctggatgtggtggcaggtgcctgtaatcccagccactcgggaggctgaggcaagagaattgcttgaacccaggaggcggaggttgcagtgagccgagactgtgccacagcactccagctggggcaacagagtgagactgtgtctaaagaagaaaaaaaaagtggacgttgtagtgaagggattgggaggagattcgtggatgtaatgaagatacagcttagactacacgctgtatctattttacaggggagagccaaaggataagacagctgggaggagctctcctggggttaaaacaaatatcaaacactaacctcagaaagtattcattggaaagagccaccatttgattagatttatttgtagaggattttatgctcccaggatactactgcaaatgacagagcaataagtagagcttaactgggtgtggtcagggaaaagaatgcaagagggccctaccagtaccactgtcatcctagggtgacagtggtatatccaaagctgcacctgccagagtagcaacatcagtgatctaacacaggggatgggaaatagactttgctaaaataatccagccagtcactaaacaaataaacaagcaaataacaagaaacctcagtacccagagttgctatcatatattatctaaatgctgtttccaacaaaaaattatgaggcctgcaaagaaatagaaaaattatttttccatccaccccccaaaaaatgcccgtgagagcaacacaatgttgaacttaacaggaaagtatgtatgtgtgtgtgtgtgtatgtatgtatgtatgtatgtatgtatgtatgtatctatctatatatatatatatatattttttttttttttttttttttttttgagacggagtcttgctctgtcgcccaggccggagtgcagtggcacaatctcggctcactacaagctccgcctcccgggttcaggccattctcccgcctcagcctcccgagtagctgggactacagtgcccaccagcatgcccagctaattttttgtatttttagtagagatggggtttcaccatgttagccaggatggtctcgatctcctgacctcatgatctgcctgcctcggcctcccaagtgctgggattacaggcgtgagccactgcgcccggccgactggaaagtatttcaaagtagccagtgtaaacatgttcacagaactgaaggaaagcttgattagagaagtaaaggaaggtatgatgataacgttgcatcaaatagagaatatcaataaagagatatacattttttttgttgtttttgagagaatctcactctgtcacccaggctcgagtgcagtggtgtgatctcagctcactgcaacttctgcctcccaggttcaagcaattctcctgcctcagcctcccaagtagctgggactactggcacatgccaccacacccagctaattttttgtattttttttagtagagacggggtttcaccgtgttagccaggatggtctcgtctcctgacctcatgatccacccgcctcagccccccaaagtgctgggattataggcatgagccaccacacccagccaagccatacatttttttaaaaagaaccaaatgaaaattctggagttgaaaagtacaataactaaaatttaaaattcactagagaggctcaatagtagatttgaacagaagaaagaattggcaaacttgaagctagatcaaaagcgattatgtaagctgaagaacagagagaaaagagaaaaaagaaaaatgaaatagagcctcaaacaaatgtggaacaccattaagtacaccaacacacgtataatgggagcattaggaggagacagagagctgggtgcagtggctcacgcctgtaatgaggcaggcggatcatttgaggtcaaaactttgagaccagcctggccaacatggtgaatgaaaccccatctctaaaattagccaggcatggtggtgtgtgcctatagtcccagctattccggaggctgaggtgggagaatcacttgaacccaggaggtggaggttgcagtgagctgagattgtgccattgcagtccagcctgggcaacaagagtaagactccatctcaaaacaacaacaaaaaaagaaggcaggctgggcacggtggctcacacctgtaatcccagcactttgggaggcccaggcgggcggatcaccggaggtcgggagtttgagaccagcctgaccaacatggagaaactctgtctctactaaaaatacaaaattagcaggatatggtggcacatgcctgcagtcccagctgcttgggaagctgaggcaggagaatcctttgaacctgggaggcagaggttgcagtgagccaagacagtgccattgcactccaacctgggcaacaagagcgaaactccgtctcaaaaaaaaaaaaaaaaaagagctagagagagagaaaagaagaaaaaagaaagtctgaatatccaatactatcattacttttgttgttgttgagacagaatcttgctcttgttgcccaggctggagtgcaatggcacaatcctggctcactgcaacccccacctcccaggttcaagcaattctcctgcctcagcctcccaagtagctgggattacaggtgcctgacaccacacccagctaatttttgtatttttaatagagacagggtttcaccatgttggccaggctggtcttggacccctggcctcagactcccaaagtgctgggattacaggcgaaagccactgtgcccagcctcattacttattctgttgccccaatttttcaagtcttaaccattaggagctccttcaggttggctcctgtgttcattctttcatcaagcccccatccttttttgagcacttccttactcctgccccacaagatgctccagatttgacttatattttcccagtcctagtcctggaatcaactccaaggagtccttaatccttttattaaataatggtttttagaaaccaaaatctgggcacctggtttgctcactgctactaggatgttgttgattctaggccttctcagcaaacggagatagcaaacatgaataacataatccacatatatatacacatatctatatttctgtatctttccatctgtgtatatttaaaaacatgagtttatacagatacttctgtttctgatctaataccacagcattcatttaatcccctttccttatctgtaacttctttctccaacagtaagaaacctggttctcattatctacaatatagtttacttattcatgtataccagtatacacataatatagtttcagaattgctaacacatacttctaactagatgacagcatttatgttcagctctctttatctttagtttagttggttttttgttttgtttttgttttttgtgacaagctctctccctgtcatccaagctggagtgcagtggcacaagcttggctcactgcaacctcctcctcccagcttcaaacaatgctcctgcctcagcctccaaaacagctgggactacaggcacgtgccaccatgcccagctaatttttgtatttttagtagagacggggttcaccctgttagccaggctggtctcaaactcctgaccctcaggcgatccacccaatttaggcaatccacctgcctcagcctcctgaagtgctggcattacaggcatgagccaccacacccagccacatccagctagttttttaatcttttgtagagatggagtctcactttgttgcccaggctggtcttgacctcctgggctaaagtgatcctcctgtcttggcctcccaaagtgctgggattacaggtgtgagccactgcaccaggcccatctagagttttatagagccctgtcaaattactgttttccagagttacttggttttgttcttcacttccttcagtgtggttatattgttcatttgtaatacagtgagggtcatttgttagtgtttgtattccatgttaggtttcctcaacactgtgattgcttttaattttctgtctattgtaggggcatgtgaaacactgctacagttctaagagtcagaggtatacaaaaagatctactttgagaagtgtcatttttgtcctcattctcgcaaccctgacccctttccccctttcgttccatccctttgccactcactttcttttttgttttttttttttggagacggagtctcgctccgtcacccaggctggagcgtggtggcgcaatcttggcttactgcaacctccgcctcctgggttcaagtgattctcctgcctcagcctcccgagtagctgggactacaagcatgagccactatgctcagctaatttttgtatttttagtagagatggggtttcaccatgttggttggccagaatggtctcgatctcttgacctcgtgatccacccgcctcggcctcccaaagtgctgggattacaggcgtgagccaccacaaccggctccgagatatctttaagaatacttcaaggccctgctgaactcagtatgaaaactgcaccaatggacaaagttggacaaaggtatttggtaacaagccttctgaagcctgagattcagccctgttctcatcctagaattatacgtgccattctacaggactagaactacaaacaggggtcaggagaccaactcccaattctggttctgccatgaacatgctttataaccctaggggatctcctaaatttgtggattcaatttctcacctgaaaaatgaagaacttgaactctgtgatcacgaggttcctcccaaagccttccttctgtaggttttgtgtacattaccttagctatagttggaggcgtgccagggctatggagactcacctttacaacatacactctgaccaggagcttgatgggccggttctgtgggatcccccgggagatctggggctcagagaacaacactgcctctgattcagggtaaatgaggaaggagccctgagttggggggagacagaaaaagctctggtaagataattgtcctcctgaatccccacctgggctccctggttccgctttccttccccaaatgtaccttgaacttgcccacaaggtgtccagatccttcctcttctccacctccatcctggcccccttgccctcggtacagaggaaacacattcagccagtcttcaaagtggttaaattcttccttcagggacctgttgtagatctaaaaggcaaggacttcagcaacagcccgatgtccagaatccaaaggagactttcctcttcccagtacccagtcaccttcagggtggcaactgctttttttggggacacagtgcctttgacttcagcctcaccctggtcttggatctccccaaccatagaaatgaggttgaccccatctggaaacagcaaaaatgccccagtcagaaatatctgggtgggtaggggatgggcagatggaaccagagcaaaaagcccaatctgttacctgaatctccaggatcatccatttcatcttcatcaaagttgtgctgaaattaaagagcagatccagagattcttccccatccccttcaaccccttagtctacccccttttccaggagagttgggaaaccttcactcaagttcccactgtgtatgccacttgcatttttaaagctccaatttatcatccagcctgccctgtctagggcagtcaccaccagccacacgtggctactgagcagtcaaaacgtggctagtctgaattgcaatgtgctgtaagtggccaggcttggtggctcatgcctggaatcccaacactttgggagactgaggtgactacttgaggccaggagttcgagatcaggctgaacaacacagtgagaacctgtctctatgaaataaatgctttttaatttttatttatttatttttgagacagactcttgctgtgtagcccaggttggagtgtattggtgtgaacatggctcactgtagcctcaacctccgaggctcaagtgatcctcccacctcaacctcttgagtcgctggggccaccggcgtgtaccaccatgcacagctacttgttttcatttttagtagagatggtgtctcaccatgttccccagactgttctcaaactcctggcttcgagtgatcctcccacctcagactcccaaagtgctgggattaccggcatgaaacaccacacccaggaaaaaaaaagtttgtaattagctgagtgtagtggtatgtacttatggtcctagctactggggaggctgaggtgggaagatcacttgaacccaggagtttgagaccagtctggataacagataaagaccccatctctaaaaataaaaagaaaagaaagaaaaagatgtgcgataagtataaaataaaaaccggatttttaaatacttagtacaaaaaacaagaatgtaaaatatctcagaaattttatgattacttgttgaagttttttttttttttttttttttttttgagagacagagtttcactctgtcacccaggctggagcacagtctcggctcactgtaacctccacctcccaggttcaagcgattctcctgcctcagcctccagaatagctgggattaacaggtgcccagcaccacgcccggctaatttttgtatttttagtagagacggggtttcgccatgttggccaggctggtctcgaactcctgacctcaagtgatctgcctgcctcagcctcccaaagtgctgggattacaggcatgagccactgtgcccagccttgaaatggtattttgaatatattactaaaattaatttcacctgtttcgttttacttttttttttttttttttttttgagagggagtctcgttctgtcgcccaggctggagtgcagtggcgcaatctcggctcactgcaaggtccgcctcccaggttcacaccattctcctgcctcagcctcctgagtaggtgggactacaggcacccgccaccatgccccgctaatattttttgtatttttagtagagacggggtttcaccatgttagccaggatggtctcaatctcctgacctcgtgatccacccgccttggcctcccaaagcgctgggattacaggcgtgagccaccgcgcctggccccttctactttaatgtggctactacaaaagttaaaattacgtatgtggctcgtgttatgtcttttggacaacacagctctagataatggagttaataatccccagcttctagaattgtgaagaaaagaggactataatgaagagctctgaaaaactgtagagctccaccttcaatgagatcattcttgttttttgtttgttttttgagacggagtctcactgtcacccaggctgttgtgcaatggcatgatctcagctcacaggagcctctgcctctgggttcaagtgattctcctgcgtcagcctcctgagtagctgggactacaggtgcgcgccgccatgcctagctaagatatcattctttttaccatttacaccccagccccctccctgggacccttctctgcccccacctgcccctggagctcctgcagcgacgcatagtacttggacccccagtcgagctcctctggatctgggatgtcttcctccagcccagggccttgatttaggaggcctcctagtgggagcttcttcagaggaggctgaggaagagcagactttgtccctctaacccagcaccatcccaagtactgccagccccttcaccatctatctcctctaccccatcaccttcaggagctgtctggatatacccgcttcagccaagaagggatccagggacttctgtcctgggagggggaaaatggcagcatgaggagagtgggtaagtagaagtcagattccacaccccatcggagggccctctggagccacgtccaccaggaatcagaggggcttctgtctggtgtccctgaaggagaaggttcctaaccttgaggtcccttgggcatcatatcccctgtctcctccatctctccttcctcctcaggaggatcctcatgaccccgaaatgtgaatcgcagcatgtgggggacaatgtgggaacccacaaggactgtgtggccaaaggcccggcgctcaatcaccaagatgctgagtggaggctgcaagtaaggctgctccggcaagtcctgggggtggaagagaggagctgtgtctttgaagacctggggaacagggaaaggtagccacagagacaggtaggaaaaaaaatacatctaaacctgcattctaagcccagctctgccatagcctcactgtgtaatctctggtaaaccattgccttctcatcctgtttcctagctaaaaaagggacacaggccgggcgcagtgtctcatgcctgtaatcccagcacttggagaggccaaggtgggcagatcacaagttcaggagttcgagaccagcctggccaacgtagtgaaaccccatatctactaaaaatacaaaaattagctgggcgtggtggtgagcacctgtaatctcagctactcgggagactgaggcaggagaatcgcttgaaaacagaaggtggaggttgcagtgagccaaggtcacaccactgtactgcagtctgggcaacaacagcaaaactccatctcaaaaaaaaaaaaaaaaaaaaagggacacaatcctggattcaaaagactgttgtaaatatcaaatgacataatagaaacataagtactttggagcctacaaagtgctgtcagaagctgggcatggtggctcatgcctgtaaccccagcactttgggaggctgaggcaggcagactgctcaaactcaggagttcgagaccagcctgggcaacatggcaagacaccatctgtaccaaaaatacaaaaaaatagccgggcatagtggtgcgcacctgtggtcccagctactcaggaggttgaggtgggaggatcacttgagcccagggggcggaggttacagtgagccaagatttgcactccagccttggtgacagagcaagagaccctgtctaaaatatatatgtgtatatacacacacacacacacaaatatattttttggctgggcatggtggctgacacctgtaatcccagcactttgggaggccaaggcaggcagatcacttgaggtcaggagtttgagaccagcctggccaagatgatgaaatcctgtctctactaaaaatacaaaaaaattagctgggtgtggtaacgggtggctgtaatcccagctacttgggaagctgaggcagaagaatagcttgaacctgggaggcacaggttgcagtgagccgagatcgcgccactgcagcctaggcagcagagtgagactctgtcttaaaatatatattatggtttattttattttatggttaaaggccatatatatatatatataaaatatatatatataaaatatatataaaatatatatatataaaatatatatataatatatatatataaaatatatatatataatatatatatataaaatatatatatataaaatatatatatatataaaatatatatatatataaaatatatatatggaattccatatctatcaatggatcctaagggaaacaattttactactgtattggtgggtttattttatgtatttgtagatatatacatatatacacatatatatgacaattttagcacaaaagagaggaaaaatagagctataccacagaaaagtttgtatattttactggaattaaattagtattaatctgaagtagactgtgaaacagtagtatgtatattgtaatccctagagcaactactaagtaaaaatcagcaaattaaaatagtacactaataaatatcaaaatataataaatatctatttaacacaaaagaaagcagtaaaagaggaataataagtccacaagacatagaaaacagacagcaaaatggcagatgtaaattcagccaataatatcaacagcatcaaatgtgatcatattaaataccaatcaaaagtcagagattgttaactgcattaaaaaaaagagatgcgactccatgctgtctaagagatactctagattcaaagacacataaaggatgaagtataggaaaaaaatatatcatgcaaatagtaaccacagagagctggagtagttataccaccagagaaaatagactttaatacaaaaaatattactagagacaaacagatactttataatggtaaacaggtcaattcatctagaagatataacaattataaacatatatgcacctaacaacagagcctcaaaatacaaaaactaaaaagttatagaattaaagagagagatacacaattcattagtaatagctggagatttcaataccctattctcaataatggatagacagaaaataatcaaagaggcttgttcaagaggtctgaataacagtaacacctagagagcaccacaagtccatgaattaatccaggaatcagcaaactacagcccatagacagagtctggcctgctgtcagtttttgtaaatattcatttacatattatctatggctgttttcatgctacgatggcagagttgagtagttgcaacagactggatggctctcaaagcctaaaatatttactatttggcccattatagagagtttgctgacccttggatcatctaagataaccaggtagaaagtcaccatccactgccctctttcactattctgccccccttttcccctagcccgtggcctcaccactgtcagatgcctgacaagctcagtgaaattggggctctcacggtagctggccaggacctcagactccacaccttgcccagccacctccagtacaacctggggctgctccacctcgagcagatgcacacgaccaagtcccctaagaccccagaacagcacctggggtcagaaaatgggagattcaggggcctgcaccagacaaatgggcacccggatgttggggaacaagggggctttgagtgcctggtgatacctcaacacggaactccctgagcactgggcacacgttgggtggaagggacaggcgtccagagtggggctcaaccaggggtgccagatcctggggctccacctcactgggcactgagggctgtaggagggaaacagtcagagggcgaagaggaatcaggccaaaggaggaaaagcctaggtgtggggaggggatatggagaggtactggtgaaatgtaaatgcacaggaaccaaccaaggctggattggtggaagggagggggtctcgggaagcagcttcgtgcaggaagggagcagggtgtctgaggcatgcaggatggcccaacaaggtgaacctagcacatgaatacttgcaatgttccttggggtcaagtggtccaatgaggtgacctcaggacaaacctgcagtctttattctctggggaaaagagacctggaggctggtcctgggacatatccatgttttatattccctagggctggatggcctgatggactaacaagttgggctcacagcctgtgctagccacgccagggcatgctgacctcaagtcggccactgtagtctagttcaatgagttgaaaggcggcaatgagctctccggctgcccagggtcccttcctcagggggaagaactgcaactctgggcgttggtatgggtcctccatcagctttacccttggggcggccagtgccctgcccaggaacacgggggggccctagggggagcagggcagtgaagacaaaggggaagaggctcaggagccagggaaggtgggcatcaagggggaaactcctggccaggaacccagggagggcccaggccacactcacaaacttattgtggtcaaatacattgatgatcactaatggaggctcctcctgcaggtgctccctcctcccatccacgatcaactgctcaaataccaggagttcatcccacagagggctcagcgtctgctccaggaccttgggggccatacagagaagcgggtagcagcagatatcaggagaaggctcccaacatgcatgccatgcgaacacccctgctctgaaggaatactttaagtaaatgctcatcacaagaagagtgagatgtgaggaagacgaaagcatcttcagttggtgttgcagccagcccctcacagccctgcctccccattgcaattggcccctcagagtccaggcctaaagtcaaccccagaaaatgactcctcgccgctaagacctccagttctacatcacctgctaagttagggccatctagtaccccatcctgataccctgctctgcaaacccagagtgcgaggagaggggccttggggaaaagctcagacccaccctaacttgtctcctgggtcccttccacccacatgtcatcccagccctcacccgtgtggtctgacactgggtagagatgaggactcgagcaaaggggtccgagaggccactgtcatctgcagccaacacaccccgggcctggtacaagtgagcccggagttggaagtagctaaagtctggggtgaggggcaaggaaggtgtcatgtttgcccaggggaaccactgaagtcccctgactgagccccacaccttgggcagagagccaggtgggccttatacctgccctgcccaccctctgcactcaccgtcccggtgtaggctggagggcagcccggctgagggctcgggcagcaaatccgggggcagctcagaggtgcaggccttggcttgcttgcccaggcccagccgcaggaagagctccagcttggcacagacctcaccaggggctgccccgggtgcctgtgtgtgaagaaggcatgtcagggccccgatgcctcttctcatgaccccagctagacctagcaatcctgcttccccagggcacacctctactgcacatcgccacaccatgccaaactcccagtccactccctacctgcccagccttaccctcttcctaccctccaccctacgccatgaccctcacactcttactccctatacctcttgccctaacactgccacttcccgtaccccactccccagacccctaactacactctgagctctgctctcccacctttgtcccctccaccccctacacgtttacattccccatccccaaccccaagggtcacggcttctccctcctagggacccttttcagttatcttttccagggacacctcatttagaaatctttggcccacaaaccagctacacttttttttttttttttttttttttttaagatggagtctccctctgttgccagtctggagtgcagtggcgtgatctctgctcactgcaaactctacctcctgtgttcaagagattctcctgcctcagcctccctagtcgctggaattacaggtatacaccaccacacctggctaatttttgtatttttagtagagacggggtttcaccatgttggccaggctgctctccaactcctgacctcaggtgatccgcgtgcctcagcctccccaagtgctgggattacaggcatgagccaccactcccggccagaccagccacacttgtaaggggtgagtcacactctctcgtttttggtaccctgcctatctgtcagggcctagtcagcaaaatggcccatgcagtcccagagctagggaagatttggggtttatctgatttcaaagctgccccaggcaaaggcacaatccctttctggtgttttggacaattggaaagtgttcaggggcccctagctgggaagcacaggcctctacccaaggcctatcctacccttgccctataagctccactccacttctcccggcccctcacccgtgggtcccctcaccgtgagcattagactctggatcttcccacagtctcggccccgttcctcctcaaccacagagaacagcacatcctgggcagggatccgggcccaggccacacggcgctgcccgctgagcatccagaccagcacatcggggaggggtggctggggctgcgggtggataactggtcacggaggtggatctggagccgacctctcctgctctcacagcttgaactgaacggaccaaatagccactccagcttctatctccccgagacagggtctcactctgtcgcccaggcatgagtgcagtgacactatcatggctcactgcagcttgaccacccaggttcaagcattcctcccacctcagcctctcaaggagctaggactacaggcacgtgtcaccatgcctggctaattttttactttttgtagagatggggtttggccacgttgcgcaggctggtctcgaactcctgggcttaagagatcctcctgccttggcctcccaaagtgctgggatcacaggcatgagctaccacacttggcttcttttttttaattgtggaaaaatacttataaaattgaccatcatcctaaccatttttaaatgtacggttcaggggcatgaaatatattcacaatgccaggcacggtggctcacgcctgtaatcccagcacttttggaggctgaggtgggcggatcatgaggtcaggagatcgagaccatcctggctaacatggtgaaaccccctctctactaaaaatacaaaaaattagcctggcgtggtggcggacgcctgtagtcccagctacttgggaggctgaggcaggagaatggcatgacccgggaggcggagcttgcagtgagccgagatcgctccactgcactccagactgggtgacagagaaagactccgtctcaaaaaaaaaaaaaggaaagaaaaaaaaaagaaatatattcacgttattatgcaaccatccccatcattcatccccagaacatttttcatcttgcagaacagaaactctgctcattaaaccatacctctccattcactgctctccatcccagcccctggcagccaccattcttctttctgtgtttggatttgactacaacaagccctccatatgagtggaatcatatagtgcgtgcccttgtgcctggcccagttcactaggcataatgtcctcaaggctcatgcacgtggtagctggtgccaaccttgtctcttcacctttccctcctccccagtcttatcttccccaatgtgcacagtgtgcacatgtggtgcccatcacatcagccaaatacctgggctggtgacactcttctccaacatccaatcacccattcctggcagtttcccccttctctccctttctccctgccccacttcaagaccatctgctttttttttctgttgccgaggctggaatgcagtggcacaatcatagcttactgcaggctcaacatcctgggcccaagtgatcctcccacctcagcctcctgagtctctggggactataggcacacaccaccatgccttgcgatgttttcatttttaaatttttttgtagagatagggtctcactatgttgtccaggctggtctcaaactactggacttaagcaatcctcccacctcagcctcccaaagtggtgggattacaggtgcgagccaccatgcccagccaaaagaccacccactcttggctagacaattgtgacaggctcctaagcagtcttcctgccttgagtcctcccttcctacccactctgccatggctggctggcttctccccatcctctgggtgtcagctgcaatgttgtctttgcagataagacttgcctgaccaccttacccaagcaggttctcctccaccccctcagcctctgtaacctctttcttaccaattcctatagatcataattatttttcatattcatttacagatgtatagtctgtcttcctaggacattagcctcaaaagggcaaggaatatggcaggggctgacccccagggcctaatacagagcctggcacacaggaggacttgaaatatcattgagaggccaggcgtggtggctgaggctgggcatagtggctcatgcctgtaatctcagcactttgggaggctgaggcgggtggatcacctgagatcaggagtttgagaccagcctggccaacatggtgaaccccatctttactaaaaatacagaagagtaggcaggcaaggtggcacgcgcctgtaatcccagctacttgggaggctgaggcaggggaatcacttgaactcaggaggcgaaagttgtagtgagttgagatcacaccattgcattccagcccaggcagcaagggcaaaactccatctcaaaacaaaaaaaaacaaaaaaaaaaccaagaatattcatagcagctttattcatactagctaaaaacatgaaacagcacagctgtccatcaatatgagaatgaataaacaaactgtgatatatttatacaatgggaaattgctcaacaataaaaagaaagaaactagatatctgcaacaacttggacgcatcttacaacagcctctcacaagagaatacagtccttcctcattatttgtgaattctgtatttgcaaatttgcgtactagctaaaatttgtaacccccaaatcaatacccctggtgcttttgtaatcacatgagtatgggcaaagagtcaaaaactttgaacaggtcaggcatggtggctcgtacctgtaaccccagcactttgggaggccaaggtgggaggatcacttgagcttaggggtccaagagcagcctgggcgacaaagtgagacctcatctttattaaaaaaaaaaaaattaaaaaaaattttttttgagactaagtctcgctctgtcacccaggctggagtgcaatggtgcaatctcggctcactgcaacctctgcctcctaggttcaagcaattctcctgcctcagcctcctgagtagctgggactataggcatgtgccactatgcccaactaatttttgtatttttagtagagatggggtttcaccatgctggccaggctggtctcaaactcctcacctcgggtgatcctcctgcctcagcctcccaaagtgctgggattacaggcatgagctaccgcacccatcctctactaaaaatttttaacccttctttggttgaagccgcagaaacaagatgacaaaggaaacgtcatcgtttggaaagcatcgcgataagacacacactttgtgccgccactgtggctctatggcctgccaacttcagaagtcgacctgtggcaaacgtggctaccccgccaagcactagaggaagtataactggctaaaagacaaaataccactgggactgatcgaatgaggcacctaaaaattgtatactgcagattcaggcatggattctgtgaaggaacaacacctaaacccaagagggtacctgttgcagcatccagttcatcttaagaatttcaacaattggccgggtgcggtggctcatgcctgtaatcctagcactttaggagcccgaggtgagtggatcacgaggtcaggagttcgagaatagcttgatcaacatggtaaaaccccgtctctactaaaaatacaaaaataagccgggcgtggtggcgctcgcctgtaatcccagctactcaggtggctgaggcaggagaatcacttgaacctgggaggcggaggttagagtgagccgagatcgagccactacactccagcctgggcgacagagcaagactctgtctcaaaaaaaaaaaaaaagaaaagaaaaaaaaaaaattcaacgagtcatgcaaaaagtgttctggtttattaaaatacaaaaagaaattttttaacctatttcctgtttgccttgagaatactcttgcctgtaatcctaatgtaacatcatatatacttctgttacattaggattagagacaagttctgtttagaaataactccaagtaaggtttttatattttattttcatattgaaaatcagtcataatttcttcagcctcaaagaatgagtttatgtaaaattaaatgagtgctggcagtgagctgcactttttttctctaaacgggaaatgggtttaaattttttttttttttttttttttttttttttttttttttttgagatggaatcttgcagtcacccaggctggaggaatgcagcggcacaatctcagctcactgaaacctccatctcctgcattcaagcaattctctggcttcggcttcctgagtagctgggattacagatgcataccaccacacacacccagctttttgtgtttttaatagagagggggtttcaccttgttggccaggctggtcttgaattcctgacctcaagtgacccgcctgcctcggcctcccaaagtgctgggattacaggcgtgagccaccacacttgagacttagatttaaaaaaaaagtttgaagggccctgagttggaataaagcaatactctgcctttgtgagctctgatactgtaagcattttgtttttgtttttgttttttgagacagagtctcattctgtcacccaggctgaagtgcagtggcacaatctcagctcactgcaacctctgccttctgggttcaagtgattctcctgcctcagcttccagagaagctgggactgcaggcactggccaccacacctggctaattttttatatttttagtagagatggggtttcgccgtgctggccagcctggtctcaaactcctgacctcaggtgattccacccacctcggcctcccaaagtgctgggattacaggcgtgagccactgcaatggccaacaatatattatattaaagaaagtatctttaaacaaacacacataaaacaaggttttgtactgatcagttgacaaaaaaaatgtgaccatcgcccactagaaacctaaccctgtatttctctgggggcagtgattcagtatttgctaattcagtgtttgcagcaactttatagaccaccaataacaagaactgactatacatatggcatgattgcattgtattaaaatctagtacaggcaaaactataatgaaaaaaatcaaaatatattgaaaaaatcagtagttatctctatgggggtggatggagactgactgggaaggaacataaaggaacaactctggggtgaaagtcatattctagatcttgatagggacttgggttacacagatatatgtatttgccaaaattcagcaaatgtgtgttaagatttgtacacttggccagacatggtgactcatgcctgtaatcccagcactttgggaggccgaggtggccagatcgcttgagtccaggagttcaagactagcctggccaacatggcgcaaccccatctctactaaaaatacaaaaattagcaggcatggtggcgcatgcctatactcccagctactcaggaggctgaggcagaagaatcacttgagcctggaggcagaagttgcagtgagctgagatcttgccactgcactccagcctaagtgacagagtgagactctgtcttaaaaatatatatgtatttgtacacttcattatatgtaaattgtacatcagaggaaaacactgtaatttttttttttaaatcagtggagggccgggcgtggtggctctcgcttgtaagcccagcactttgggaggccaaggcaggtagatcacgaggtcaggagttcgagacaagcctggccaacaaaatgaaaccccgtctttactgaaaccccgtctttactaaaatacttaaattatctgggcatggtggcaggcacctgtaatcccagctactcaggaagctgaggcaggagaatctcttgaacccaggaggcagaggttgcagtgagccgagattgcgccactgcactccagcctgggcgacagagctagactctatctcaaaaaaataaaaaataataaaaaaataaaaatcagtggaggggtccactattagtttggatgtagaaagactcactcccggcctggcacagtggctcacatctgtaatcccagcactttgggaggccgaggtgggcagatcacctgaggtcaggagtttgagaccaacctgaccaacatggtgaaactccatctctactaaaaatacaaaaattaaccaggtatggtggcacatgcccgtaatcccagctactagtgaaactgaggcaggagaatcgcttgaacctgggaggcagtgagccaagattgcgccaccacactccagcctgggcgacagagccagactgtgtctcaacaacaacaaaaagacttataccctaacaaccaaaataatccaaataaattgtaaaattatacacacccacaattatttttttggatataggatctcgctttcacccaggctggagtgcagtggcacaattatggcttactgtagcctcgaaccctgaggcccaagcagtcctcccgcctcagcctcccaagtagttgggactacaggagcttgccaccacgcctcgttagttttattttttgtacagatgggggtctccctatgttgcccagactaaaaatcgtattttaaaaaacacatcagagaagtggggattcaaagaaacctatatcaactaaactccagaaaatgatgagttcttcataatcaaggagagacctccagctgctactcccacctctggcagaacagcagtagtaaaaaggaacatcagaagtggggacaaggagaaagtatccacttttaagagacttttaatgactatgtgtgaggtagcataccagatgagaatcccagggaccacagccacaaaatatgtctttccgtacctccgaactctttcctatggatcctcgcctagagctaaggggcggtatgcaaaaagctgggaacagggaaggagagctgagatctttctgaggtatgtaaagtttcttgaaagtgcagagtaggccgggcactgtggctgacacttctaatcccagcactttgggaggccgaggcaggtggatctcttgagatcaagagttcgagaccagcctgacgaacatggtgaaactccatctctagtaaaaaaaaaaaaaaaaaaaaatacaaaattagccaggcatagtggcacatgcctgtaatcccagctacttgggaggctgaggcaggagaattgcttgaacccaggaagtggagattgcagtgagctgagatcatgccattccactccagcctgggcaacaagaacaaaactctgtctcaaaaaaaaaaaaaaaaaaaaaaagcacaaagtaactgcccttagaaggaggtggtagggaagagaatttaaaaacccagaagtggtcctctgggatttcatcttttgaaggctgagggttaggtaggagggctgagagaaacctcccccactaggctttcagctatcagatgctacaggctcagctggagagccaagagaacccttctgatgcattctagacttttacaacgtaaagtggagaccctccaaaggccagaggagggaaagcaggactaacaaggcacagaggaaaggaagcagactcaaaaagcacagagaatgccccagcaacccaaacacctggttggtggtttgtaaagcagggagagcttacccagagttggagaattggcagtttgggtgtgaacaagaaacagatttctggaatcttgccagttctcagttctaagcctggatgaaaggacaatcgtgatccttcaaaaaaacatttgaagcccaaagtgaactgaaccaaaccaaattcacaactaagcccatttcaaatacaaagcataatgacttggtcctcactctctagagtaaggcctagtgtaagaagagaaatgccatttcctggacatatatattattttagtcactaatgttttatacaaatatccaggcatatgataaaaaaaattacaggacggagttaaagcaaaactcatggtcaagaggaaataatcaatagaagtagatgcatagataacccagatgttggaattattagataagcatattaaaataactgtgatagaaatctaaatgatctagtgaggaaagtacacaagaattaaaagatgggtgatttcagcaaacagttgaaaactggaaccaaaaggaaataatagaaattttaaatatatcaggcaaacagttctacaatagttggagtcttcagtacaccacttacaatagcagatggaacatctatacagaatattattaaggaaatagacttaaaacaacactaaccaactatacctagaagacacatacaaaatactccatcataacagcagagtacacattcttctcaagcactcacggaacattcttcaggatacatcatatgttagatcacaaaacagtaaatttaaaaagactaggctggccgggcatggtggcttacacctgtaatcaggcagagattgcagtgagccaagattgtgccactgcactccagcctggtgacagagagagactgcgtctcaaaaaaataaaaaaaataaaataaaaaataaaaaaagacacaaatacctaaaatcagaaatgaaaggaaggacattactagcaaccttatggaaataaaaagattgtaagagaataccatgaacaagtataaaataacaaattggattatctaagatgaagttataaaattcctggaaatacaaattatctaaactgactcaagaagaaatagaaaatctgaacaaatctataacaattaaagagattgactcagcagtcaaaaacttcccaaaaaaagtcaagaccagatgccttcactggtgaattctaccaaacacttgaagaagaattaacgccaatccttttcaaactcttccaaaaaatagaagagggaggaacacttcgtaactcattctatgaggccagctttaccttgatatcaaagatagataaatcacaagaaaagacatcaaatcattacatgccgggcgtggtgacttaggcctgtaatcccagcgttttgggaggccgaggcatggaggatcccttgagccccaggagttcacgaccagcctgggtaacacaggaagaccccatctctactttttaagtactttttttttaaatcaaaaaagaaaaaagaaaattacaaaacaatatcccttataaatacacagatgcaaaagtcctgaagaaaatccaatgacgtatttaaaaaatggatatacaccattgataaaaggaattcatctcatgaatgcaaggatagtacaacctaaggaaatcaatcagtgtaatacatcacagtaacagaacaaaaaagaaaaaaacatgatcatcttaatagacacagaaaaaaagttcgataaaatctaacaccctttcacaataaaaacgcaaaactaggaatggaagagaacttcctcaacctgataaagggcatttatgaaaaacactgctaacatcaaacttaataaataatgaaagctttccccctagaatcagaaacaaagcaagtgaaaattacaactttggctagttgtggtggctcacacctgtaatcccagcactttgggatgctgaggcaggagaatcacttgaacccaggaggcagaataaaattacaatttcagaaaaagtatgtgtcttgtatctgccattgtgagcttgacagcttgccaacactcgaagatttttgtgactggacatggcagctcacacctgtaatcccaacactttggaaggccaaggcaggaggactgcttgagctcaggagtttgagaccagcctggtcaacacagcaagaccccatctccatttttttttttttttttttttttgagatagagtctctgtcacccaggctggagtgcagtggtgtaatctgagacctgtcccgagaccaaaaagtttgagaaccactgccatagaaaagcaccaggacatgtaccaaaatggtctcggaagcattgtttctaatcacaacccattgggaacatctcacatacccatcagcagcacaatatgttatatatatatatatatatatatatatatatatgtatgtatatatttagtgcttcagacaagggaggtcatgctcaaggcagcctactctcaaatcttcatccaaagaaatcctgaatgttccctgggtctctgctggattctagaactcttgtcctcacccttagctactgcaaatgaatcttggtcctatgcccacagcaattagtcccagccctggcatcattccaaaggaaaaatgttaaatcacacctgcccgaggcctctggaatggttcaaaagcttagggaaaagggtgtacagggtaggaaagtggggtgagtgaggcattacctcctcagccagaaagcgcagttttgccaggagcttcttggccagtgccaccttcttttgcacattgcgccgtctcaggccgcgtagaagtcgcagtccttgcttagccaaaaggttctgggagggcaaaaagacagcatgagcggaaggccccagctaggcgcccctgagtcccttcccgaggccgtaccaggctgtgcaccaggagtttccctcggcatcgatccagggcattgggccgggtcatcgtcctgcgctcggcaccgtggcaaaactgtctgcagtgagcagggatgtgcacagcagacaggaatcaaaggaaaggagaaggacagtgaccttggggccacttgctctgagctgacctcccacccccagcctccctcatagccctctcagtcttgggctctgaagaggcaccctttctcctgcaaagctggcctatctctatttggaccactcccaaaaatcattaaggccagccttgctcttgagctccagagctcgctaatacttaaccacctactaccctggctaccccaggtgtggcccatggaccaacagcactggtatcacctgcaggctatttaaaactgtaggacctcagccccaccccaggccctgctgaatcagaagctgcgtttatgccctcggggattcctaagcacattgaagcctcagacgtctccaccagcttggctaacgtatagcttgaacattacatgcccaagccaaatgcatactttccaatgatcccccccgcaaaacaaaacaaaacaaaacaaaaaccctatttcacctcagaactttcgagtcatctctcactgctctttctctcttattccacatcaattcatcagcaaattctttatgctctaccttcaaaaaatatccagaatctggccaggtgtggtggctcaggcctgtaatccccgcactttgggaggccgaggcggtgaatcacttgaggtcaggagttcgagaccagcctggccaaaatggtgaaacaactgtgtctactgacgctgaaaggttgagcatggtgagaacagaaaagtgaccacctacagcctcctacctcactgcctctcctgatcagggtccttggctgagtccctgcttcctccctgcctctaaatgctggaacgctccaggttctcagatttctcttttctgtgctctgttaatgctgttatccagctccatctacataatgatagttcccaaattgacatttccagcctagaattctccccagaactcaactcatatagctaactgcctaccacacatgtccacttacaattcaataagaatttcacagttaacatgtccaaaactgagctcctactatctgccttccctcagatcccacctcatccctgcttccatcagaccttctcctttgttttctgttgaaaacagatttttttcttttttccaaaaaaagaagattttggcttgcataactatgcagttggtgcagccttaaactcctggactcaagccatcctcccatctcagcctcctgagtagctgggactacaggtgtgcaccaccacacccagctaacttttgtatttttcatagagacaaggtcttcctatattgttcaggttggtttcaaacccctgggctcaattgatcctcccaccttggcctcccaaagtgctgggattccaggtgtgagccaccatgcccagcccacaagccaaaatcttagcaagtcctgaggtatcacccccaattccaaattttctctggaatccattcacagcactccatctccactgcaaccatcccctagatcagttcatcgccacctgtcacgtggattatcacaatagcccctttactaatctccctgcttcctcccccactgatcccttttaaggatctatgtgttagagtgtatctttttccttttcaaaacattcactgcccctccccccccatttcactcagagaagaagccaaagtcattaaaatggcttgtgaggctcccacaggatctgtccctccccaccatcatcctccttcccctggcctcctccagcctcttctactatgtcacactgctgcagtcacactggttctgtgctcctcctcaaacactccaggcatgctgtcccctccacctggaacaccattacaggcaggctttctcctccagcttcatgtcaccttcacggtggcctcccctccacaccctttctgaaattgcagtacctctttctaatgcttccttgcttcgcgttctttcttaacacttatcctacttagtatttttctatctgtttacatgcttatttcacatgtctccacccttccccaacctctacacccaaatgtaagcttcagggtttttttttaaagtcagggtcccattctgtcacccagactggagtgcagtggcgcaatcatggttcactgcagccttgaactcctgggctcaagatcttcccacttcagcctcccacaagtagctgggactacaggcatcagccattgtgcctggccaacttcagggatttttgtgggcaggaatgctttttcactgatattcctgtgcctaaaacagtgtctggcatagtaagtgccataaatagttatcaaataaagaacccttttgagaagaggatctgaaaatcacttaagtacctggagcaggtaatggaattcagggcagtagtgaaggtcaaagatggaagtaactagaacatgttttttttttgttttcttgtttgtttgtttttgagacgtagtcttgctcagtcacccaggctggagtgcagtggcgcaatcttggctcactgcaacctccacctgccaggttcaagtgactctcctgcctcagcctcccaagtagctgggaggtacccaccattatgcccggctaatttttgtatttttttggtagagactgggtttcgccatgttggccagtctggtcttgaactcctgacctcaaatgatctgcccgcctcagactccaaaagtgctgggattacgggtgtgagccaccgcacctggccgaacatgtttatgtggttacagcaatgacctggtaactagggaccaatcaatgatgaaggggagaaaattgacaattacagaactaattcctccagtgatgaaatccagatcacagctgtggtcactggagcaggaaaggaggagagcagatggatgcagaagccggcaaggaggtagactgggtgtgggaaggtgattagcaggaacaagtgtgaaagaaaggaggcgaggtttgaagagacacgggataagcctctaggagcgtgggaaagggaactcatggagatggaaaacagctgaggtgccagagaatcaggggaagcctaacccccaataatctcatcagctccctggataggaataattgtcttctcatttttctgtaaggtgctgagcaaatgcagctgcaagctgcccttgggtccagacagccaccgagagtctcccttgccctggagttggcccaagtacaggcagcagtaggagtggctctcagctcacctgctcccagccaccagtacttccagtgcctgcttgagctgtgcacaggcgccaggccccggcttgcgctgcagtctctcaacctcctgcagcccctggtcctgtgcaacgtgggagagggtcagagtcttgagggtccctgactcagacctcttgtagaccacacccccacccaaggccccacccactcacgaccacacctcttggcctgcccttctttggctccatcaggttgatggctccatctttctagcccgctactggctccaccaaatgtgcggccccaccatccgtacctctacccatctccttcatccagtcccttcctgggtccaccaattctgaaactctgtcctcccacaactcctggcatcctcggttcgcccagaagctgtgctctttggcccttgcccccctggccttgcaccagcaaggtgctggctctctagtgcctgcccattagccccactgcagagcttccttcaaaggctgcagtgtcctaggcgtccctacggcccggtctctccctgtgggcgccagccttgcccttaccagcctctcggccactttgcgcacgcagttgctgctctgcaggcgccaggtgtggtcctcccagcaactccacacatgcatgcatggcttgcagtgacagaggggcaagcagaagtatggcctggcagatggagaggaggcttcgcgggcattctgggttcctggagacctcccaaacccccccttccagccaccggcagcactcacccactgccgtccatgggctcaggccgctgagcatgggtccccagttcttcctcctctttctcctcctctggcctggctcccagcagaggctgagcctccacggctgcaccctcagttccctccccagccctggaccctcggcccaattgctcctccagacggcctgcgcgacctgccccagagcagcaagggtcagtgggcgccaggctgagggctggaaccccccctcaaccacctctgcctcaacagaagtcagaacctgccccttactgaaagtcaacaccccttccagggttctaaggtctgaaatggcactcaggggttcggctaggccacacaccaatggagatctcgaagctgatgggctgggaggccacggtggggtcgatcatggtggcctcgaagagcacaccgaaaagcaggaaatcttcacagggcgccaggacattctgggggaggccatcaggctggagtcagcacctactctcccagggaacagcctggactatgcttggccgcattgcccacagaaagaagtgcgaccaaggcttggaagtcactgcaggtttcttactccctctccctcctcccggccccagcattggccctgggtatgggtcctctctcccacaacatgtgtgcatataccagagcccatgtgggcacacacctcactcttcgcccaggcccccaaattgagacccctgtcgtggtgtttaatgcctgagagtggattccaccttccagagctgaggtgaccccgccccctttgctaccccccagcccccacctctggcagcggcagcagctcctccacctccacctccatggcacgggggatctcaggcccctcggcaccggggctggcgtccaagtgctgcggaaccgcctttggggtctgatcccttctggctttctttttcttctttcgggtgagccgggacaacgtggacccctgctgggcctggggaggctcaggttcagctctcccttccaacacctgcatggacacagccagcagaaggcggccgcggaaccaaatgccttggccaacgccttcgttgagaccttgaagactatcccggagccccgcgccggggggcgagccatagaggggcacccaggccgggccgaaggtagggttaaaccccgctgtggggaacaagagaagcgtgttggaggggagcgtggggagggcgagtgctggtaaatctctgcacctcaccctgatctcctccaagtattcgggggtgagggcaggggaggggggctaagccgctctgaaacggaagaagttggccagcagctgcggacgcgccgctgtggaacacgacctggggcgcctccaaaacagctcagcgccccaaggagctggaaatcgcgggagcccggcctcgggggacgcagcctgagccctgggggcggggtcgggattggggcggagctacgggcgatcggccaggcctgggggtcggggaaaggagtggaccggcagtgtcagcgtgtgcacagctgtagaagggtgggactgggctggttactggacaggcggttgtggtcagaattttgccaacggagccaaaccgatggtggggttcacagtctgggggcggcttgaagcagtttgttttgcgggcggaccagccctcctaggcggagcggggtcgcgaggatggggcttgcggttgggaatgggccctatggagccctatggaccgaggcgagtgaggccagatttgccgcggccagaagcgctcacccgcgcggcccggatgggagatccgcctcaggtccggcacgtgcgtagcgagtgccgcgtcgaccaggggcgcgtcgtcccgcagctgcaggcggaggctgcgcgtcagcggcgggaagagctccacgaagctcagctgctcgttccattcgggcgccgccgcctcggcgctcaccgacgtctcgccctgaaggtggcgttaaagacaggagaagggagatcagcgcggagtcggggccggagccgcggcgccgtgggccccggagggacttacctcctgccccaggaaagacacccgcacatagggctccaccaggacgcgctggtcgtgcagggcgcggaccaggctgcccagcagccccaggcgcagcgcgggaagcccctcggcgcggtacaggcgcacgcggagccgcgcccatggcctctcggcgggcaccccgcgcggcaggagcaggttcctaggggagggggcaccgagcggggggggagaaactgggatctcggcccctccccttatccgcgccccacggccacccccggatccatgtcctcctccccacctcaccccggctcacttctcgatgtccgaacagtgccctggggccgggggtagcattggagggggcaggtccccgcgcgccctcacggacaaggtgaccttaatgaaacccttggtcccggcgcgggtgtctcggggatcatgcagcggaacccatctttggtagaactggccatctaagggcgaaggggcgagccaggggtaaggggcgaccggcgggacgcacagggtggccgtgaggctatcggagtgacggacaatggccagggcttctctggctcagcagggaggggcggaagtgccaagagttcagcctccgccagagatggccctctccgaagtgagtgtataggggtccatgcggagtcactgcagggtcaatctctagggcccttgtccgtgcagagtctcaataaggggacgattccatacctggctggtccaagatgatgcccaggtccatcctgaaggtgcctatccgggtggccataaaggggagggtctgcgaatggaaagccttgggggaaggtggtgttagtcctgcagctttctcatccccccttctctgaaggacactggtcacccctaccccactcaccgtgatctccagcagcaagtcttggagacgaagccgcgtgtcatgaaattcgaacaagaagtactgaattgaagtggggatgagaggtcagatgtgaagggctcctgccagcttacccaggtctcttgctcagaagaccctccttcccccacccccaaccctctcactgcaagcttttcctggatcagcaaccccccaaccccaacccataggcccagcatctggctccatttccacctaggcctcacccgctccgggaatagttctcacatcaacccctcccattctgtcaggctcgccctcttctgtggtggcacccacctcattgtagaaggggcaactggtcccacgctgtgtggcggtcacacggcgctgcccccccacttgcacggccacataggggttaatgttgactcccaccagtttctgggcttccagcacagtgactcccacctgagaggtacagaaggatgaggaaaggaagccagacctgcctgggtggagggaaagaacatgcgtgccagaagaggtagtacttccaagggttaggccctggaaaaagagtagtacctggaagtcttgagctctggacacctggaagggatccccatgggccagggccctggcgcggctggagagaagcttaaggttagcactcacttggtccctcccctgcacacgcacacgcgcgcacacacacacacacacttgcttggtgctgggaatgatgttttctctccctctgaatttttggattccaggtccttcaggtcatgtcttgctgcctccatctcaaccctgcacccacaatttgactcattcctggagcccgaaaccattcattcatgcaacagaggtttattgagtacctactatgagctaacactgtcccaagcactgggacgctgtagtgaagagacaaatcttgccctcatcaagctttcatcccctgcatgtgtgtgagccactgtaactatgtgtatgaacatggcagtgtctatgcctatgagcaagtgactggagaatccacccttcccacaccccctgggactgtgtgtttgtgagggcagatgggtgtgggagcaggtgtgccgtgggtacaagttacctcttgagggggctgaacataacaccagaaagttccacgtcaggctcatcatccaggtcctgctccagctcaagctccagctcattctcttcatcgtcctgctggcctagacttcgagctagcctgcggcctagagccactgcccgccgctccagctgggcctccccaggcctgataggaaagaccctcaagggacatgcctggaacccatcacccatctccaggcaatcccttgacttcctggagccttggactgacccctgacccttgaactgatcccactgatcctaggaccagttattgaccttgtggctgacttcactgatcccaggacagactcttaaccctgggacatttctaattccagaactgacctctgattctaggactgacctctgaccctggaactgattcagttctgacccaagaccctggggctgcccccatatcactggctcctaactccaagactgactcagtgactccaggtcatccccacatacttactccagttcctggaagcccacattggggatgattaactcgaagctggggaataataaatgaaaggactaagaggaacattcctaactacagagcggcacctgctcagcacacgtccaagggtcactgaatcggcagatccagagtggaaccgggcactacttctccctttccagggtctgcctgggctgggaccaccaggtcttgcttcagttgctgaggggattacctgtcctggatgggtgccccaaagtcctcctctgaccaggctccagtagcgccctctgggggctggtacttcaggtcaagctccacctggatctgaaaccagatacagtatcccctagggccccccatctaactgccctgggtctaagagaggcccaaggacaatgccagtgccttttactacaggcggcagagatctttctggccagcatccgtggtgccttgtggttcctctctgatcattaataatgtagactactcataacctattaagaactaagtaactaggcaagtttcctcgttatttttttctttctttttttttttttttttttttttttttttagtattgatgaggtcttattatgtaccttgcccaggttggtcttgagctcctgagctcaaatgatccttctgctttagcttcccaaagtgctgggattacaggcatgagccattgtgcccagccgcaagttacctcttgaggcccaacaggattccaaaattgtctcatttttgttggaaatcccttacggtggccttcactactctgcctggtctggccccaccaacctttccagctccatctcactccaggcaccccagctgtgctccttcaaggcgctggacttttgcatatgccttttcctctgcctggaacattctctcctcccagttaacatctgttatccttcaagtctaagttcaggtactatttcctcagggaaccttctctggcccccaagtagatcatactcccctgtggtaccctctcccagcccctaccagctttcttctaacacctgccagttccagtttcacacttacttgtgtgaatatttgtttaatgtttgcctcccttccaagggtgtgaatctttatctggttttgctcaccacggaatcctcattgctcagctcagcatttggcttatcataagagctcaacaaatgatgacggactgaacaaaagaactccacattatataaatgagaaaatagcttccaggccaggtgcggtggctcatgcctgtaatcccagcactttgggaggccgagggtagatcacaaggttaggagttcgagaccaacctggccaagatggtgaaacccagtttctcctgaaaataaaaaaattagctgggtgtggtggcgggcgcctgtagtcccagctacttgggaggctgaggcaggagaatcacttaaacctgggaggtggaggttgcactgagccgagattgagccactgcattccagcctgggtgacagagcaagattccgtctcaaaacaacaacaaaaaaagaaaacagctaccaaatgctaaagaacgtgtacaagttcccagacgggaaatggcagatctgagatttgaagttaggtccatgtctactaggctatgagcccttccatgaaacaccaggaaaatccagccaggttcatctttgtctcccaaaagaattgattgctgaaaggaatcctggctggaggccttgttaccactcctctctgggtcttaggttttcccctgtgagaaatggaaccctttatctagaggtacttaagggtggcagcctgggggccagaggggctcaccggggacacttgaagattctcatccactagggcttcccgtagcaccaaatgcccagcattctgtagctgctgcagggagatcaccagggtccctagaggcctaggggagtggcatagagcaaaagagtgacccaagagaatggctctaagtcacccccagcccaacctgcatccctgtctccccaggcctactcacctaaggctgaatacacggctgcagttgaccacctgcacagacagacactccccagccagtggagccccatagtggggccatcggaacagctggggacaggaggaagcttgtgacacccatgctgtgctgaccctaaactccaatccaaagcccattcttggctgggcacagtggctcacgcctgtaatcccagcaccttgggaggccaaggcaggcagatcacttgagatcaggagttcaagaccagcctgaccaacatggtaaaaccccttctctactaaaaatacaaaaattagccaggtgtggtggtacatgtctgtaatcccagctactcaggaggctgaggcaggagactcgcttgaacttgggaggtgaagtttccagtgagctgagattgtgccattgcactccagcctgagtgacagagtgaggccctgtctcaaaaaaaaaagaaaaaaaaagaaaaaaaaaaaccctattcctaaccctcagacaggagccaatcctccagacttagagctaactttaggactaacatccccaaacctggaagggatccctgcacatgggtttgaatctgagtgagggctgatctgggactaactagtgatcaagaatgaattcccccagtcttgcaactaatttgttccaatctgggtctgatctctcaggcctcagactgaccccacctcccaagactatacttccccaaacccaggaatgagcccctgaaccccaggttggacttggatgggagacagatcaggaaccaactgtactgacctcaccgatatctgcttctggaccacagtgaatttttcttgttttctgggtaaagcctgctcagaactgaaactagtcatatatcagcccctccccccacacacacaaaaataatttgcttcccccactcttggcccagtgtcaagtccctcctggattcacccttaaagaaaggtagacaatgggaaggaaagaggcagagggttggagataccagtgtgggtagagaaaagaaatgggctgtagagatgggaaggcattgggtcaagggcccccagtttcaaatatccttagggcgcccctgcaagcctcacctcgaaaggtgagcttcacttgtcggtcgtgggtgccggtcagccctgttagtcgttgcacgcgttaccgtcagagccatggtcccagtggcactggcacttcctctgcccgtctgcccttctgcccaccagcccgcccacctgaatc

SEQ ID NO: 1596 - DNA, 150946 bp, Homo sapiens
ggcggccgccttagcgcccggtgcttgggtcggcgccgggagcgaggagcgagctacttcaaagccaccaggcctggagcggggacagaggcggcgactaggggaaggtgaagccgtcgctgcaggaggaggagcaggaggaggtgacgcaggagaaacgcaccgcccggagcccgtctgagctcagcgagagccccagcctgaggggagaaggggaagagggccgtcgccggccaaggaggaggaggaggcgggcgcggcgaggagcgagttccggcgccggtgtgcagccttttggttgagacgcccgcagccccgagcccggccgccgcagcctttcgatacactttgttgccggtcacccccgggcctgggatgcacccagggtaggtctcgtcccgggaccgagccccaccgtcgcctggtgcctcccgcctccgtgtgccctggttgtgagaagacgtctgtgtcgtgcggtgagtggccagctgcactggggcgacgctctttcccggggccaacagctggatgtgggtgaggggaggagggcgaggggggtgtgcgtgtgtgcgagcctcttccctcggcggctgccggccaggctggggcttccccgttccccctcctccggcccgggctgggcgggcgcgcgggcccgtgttgtgtgtggagccggtgtcccgagagcgtgtctgtgtgttttggactgtaagggaaaatggctgacggctccgtccctccccctcctcccccttcccgtcctgtctggggccgagtaggaggatggagtctccgggcgtggcgggcagcccccccgccgtccgcacccgggggccgggtcggtttgggggctggccgccccccgcccggcggccgctttcctacccggtctggttccacttgacaccaaacgccattactgaggtggagtgatttggagctggggagctaggcctcggctacgcctggctatcaggcctgacgacttgtccgcctccccccaccctcccgcgataacccgcagtttctccccggccctgggctcctggagtgggagctgggttatcggcctcctacacctccttcgccccgctttatttgcagagggccaaagccgtgaaaggggtttttgaatgcagaaatcgcttccaagctagcttggacctattacctttctatttttaactgtttctgcaaatattagcatgtgcgagtttggtagtgatcaggtcttcagattcttgtgacgtgaggcttagggttggataaatggctgatttttcattcattgtgaaataagttaaagagttatacagcaggtgtgtagatggcttcttaaattatttgtgtggatttctgtagcgactagaacttacacgagaatttgcaaaatttctagtagaacctgcttaaattaagcatgttattttttggaagttccatagttacaacgttaattgaatttacacggtgcagtttacaggtgtatataattgcttcagattgtcttttagtttaaataagcaagttgtaggtatagattaaatattcatgctttatttttcggggagagaagtatgtgtactgttcttttacctggaaacccatgagtccctaaatctacttaacgtttgtatactttcacttttgaggaagaatgatttggggtgcattgattaggaaactttccagcaggtacttaaccctctcggagctgattacccttaggtaaggactccttaaccatgactagcttggctggttagtacacttgaactcaaaaatagagactataaactctcctttagatctcgctcgtcttctaattcgctgggctgccattttggtttcagcaaataccttcaaattcttgaagaattatgtattaaatataaaaaagtgtcaacattcgttttctcaatttttaaactcatgtgctgtgtcatacatctaactttaaccctttaaactttatcgttccagcttttgggtggagtgaaagcttgaagtatttggaattggtgttccacaggtgaactcaaaatgtctttggtattttactgttttattttctctaatttaaaaataggacgtttggactatatgaattctctctaccccttttcttgtatttttttgcatgaacatgtaacttgtaattctggttatcagcgttctcatgtttcttttgtttgctgaccttggtagtttctgagaatttctggagggagtaatagcaccagcaacagtacatgtgagaatcttaagttacttcaggaaggaacattgaagggcagattttacctttcaccaggttattggggtctctagtttggtgttccatagtccatagttctcatggttttgtttgtttgtttttttgtctgtcgcccaggctggagtgcagtggcacgatctcggctcactgcaacgtccacctcccgggttcaagggattctcctgcctcagcctccctggtagctgggactacaggcgcgtgccatcacgcccggctaattttttgtatttttagtagagacggggtttcaccgtgttagccaggatggcctcgatctcctgacctcgtgatccgcccgtgtcgacctcccagttctcatgttttatctatggaatgctcaagtaggatttactttagatcttttttcttccagagtcttgtttttaatatcttaaggtatgagatttctttgctatcttctcagagatttttctttgacatggtggtaataatgcagcttatggttttgaaatggatgtttgtcatgaatttgctaatcatccagttcttgattagttggtcacacaacaagtgtctttgagcttatttttatttaataagatcaatttctaacgttttagtttcaaaattttagtattaaaaccaatctttgtttaaaacagatgttaagaattagttatttgaaatatctagcagtgtgtgttaatggattagtgttcttctaagtcttttgggcagtgaaggtgaggggggtcttatcctgagattgagttagttgatttttattctgaaagaacgtattactttttatggtagcctacattatgtttcccctcttgtaggtatgttttctgagtcttgaattgtttttcttttttttttcaaaaagggaaaaaaccggattttagttgtcatttggttcttttaggagctgtgtttttgaaagccatcctgtgtattgctaagttcttgtattattttaacatagagtttaacgttaatatttgggaaagagttagtgcattggacctcaaccctgactggacatgagaatcacttggcggggttaaaaaacaaccacaacaaaaaaactgatccctgggttccacccccagagactgattaattggtctgatagggagcctgggcaaaggtatattttaaaagcattgtggatgattcttacatgcatttggagttgaaaaccactgggctattgtttttatcatgttgttagaactttcaagtggataaataagaaaatggatttttttctcaattgttttcagttattagcatgattatcatttgagcattaattgtctgtcagcactgttaagcattttccatttattgccttacgatgggtctgaggtctgtcaggttcaaccagtggtgcttcgactactgtgctatgttagtgaaatgacactgattgctatttttaaaaaagcatttagagcttttggtttgtttctcgtaccagagtaagttaagatatagtttagtttttaagactatcaagatagtctccaatttgataaatatcttggttgcccaagggagatgttaaaagctatgtggcaaataggtttctccccttccatatatcttccagcgtgctcagggtgatagtttagttggtgcgtttatgacaaaatattacacaacattcctaaaaggtgtagaaactatgcatttgtctcctagtaatttatttaaatgatcccacaaattaccgtttagtgtcacatgaaattctgttatctcagtttgagaatttagagttttatttgtcttagtcaaaatcagtttgattttgattaagcgttttgaattttgtgttgttttgggattgatgtataattgttttatggaacgaatgaaataacaataacagacatttatttggagtttctgtctcttaatccccttggtccattggaccaaattctgcatggtgggggcatggcagcagggaagcctataggagtttaggatctatgagggttttttttttttttttttttttttttttgagacagattctcactctgtcactgaggctggagtggtcacggttcactgcagcctccacctctcctgggctcaggtgatcctctccccttagtctcctgagtagccgggactacaggtgctcccatgcctggctatttgtattttttttctcttttatagagatgggttttgccttgttgcctaagctggtcttgaactgctgggctcaagctgtctgcctacctgggcctcccgaagtgttaggattcccggcatgagcgactgggcccggccctatgagcattcttagtgtgacacaagattccccaaagatctttttgttaaattatagaaaatgagactataaggatcatgaaaaaagttgatgtaataaggaaaaagacttaaaacttctaacacttacctatattgggcattgaatttataatttattgtggattataaagtgatgaccattgtaatatacttttaaagaataacttgtgaaaaagtatattgttaggatgagatcgcttacctaaaatttattcttcaaagatactcatgctaaatcttggtgtcttcaacgtgtgtatacacacatatcttatatttggcagcaaatggattttcaattttattctcaatcactgcctaacaaggattttctaccacctctgtgtatcaatcatctgtggagctttttcaaaatatatatttgctctataggtgagtctgatgtgtaaccagaggtttttttttgcagtcccttttagggaaaggggagaattgagaccctttgcatgtcatgtgttccaccattaggcagcagtactcttgtttgagtttcgttttgttagtcacacagtcaaaaattccagactgaaacacaaacatgtagtgaaaagctcaaacactagaagagacagggattccacactcacatgtattatatacagtatatgtgcacatatatatcaaatttattgtcacttagcaccttctcggtgttacggttccagctctactataaacattaatatctgttaagacatttgtttcctttttaatccgttcaacaaatacttctggggcatctgctgtgtgctaggcactgttctagagattactgttgtctagaagctaacatatgaagtgaggtgggctggactagctgatctctaaagtctttagtgctagttttctggcattcttttatgtacctcgtaggagagattggattaagttgttatttaaaaaaactttgttatggtatatgccaattgaattttttttgtcactaaatagaatttcattctgaactccagttttctccagtgagcccaaatgtcaagtatagtagaaataggttcttttggaattcttggcatactggctttaggaatagctgtacttctgatgctgttaatttttgaccagaaattacatactctggtgtcaccccttactcctgccattcctttgctgtattgatgctctattatctctatacagtgtgtttttctatttaatttactttgtttaggtgttttgattaattttgtcctcacaattctatctttaaggttagtggctttcattctaagtcagtgataatatccttagcacctagaaagtgcctggcatatagacatttagtaactgttggatgaatatagtttatcacattcttgctattttacttattttttgctaaatctttttacttctgggagtcacttttcttactaatctcattacaatgagaaatcctggaagagatctcaattctttctagtcagacccttcatttttcagatgaaaaaaatggctcaaagaggtgaaaggtgaagtaacttgaccaagatagcatgccatagactaccttctttatgaagctatatctatatgtgtcaaatcacattaattattaaattctctgtagtcactcataaaattaacattaaactgtctccctggtaatggataataaggtcagggattctgtcctttacctttgtatattacagagcacctagaataatactgtttataataaccatttgattacctgaatgggaaaatctggggcagtatttaacttgcagtacctccaacctcttgtacagaattgattcatcttcattttatggcaccctacagtttattcttattaatcatgtgagctttgaacaccatgttagtcaaccataatcaaaggaattgttttccttgggatgagtttgagctggtgatcgtgcatattagatcccatcttctacagagcctgtgaattgggtggaaaggaaaaagggagtggcgaagcctcctgttagtatccttgatgtccattttattcctgctgactttggtggctattgagagttataagttgaggctgttggttacatctctcatttctagtcttttctgttaactggttacttagaactcctaagtaaggccgctcattattaacttggaccccagagagcatggaagttaccgtatagtattgaacccatttctgcctaacagtgttttctctctggtcgaggtgtagtgtacaaagttttggttgctctgcttggtaacatctctggagttcagagcacagggatcagtaaactttttctgtaaagggccacatagtaaatactttggactttgtgggctaagaggcaaaattgaggacattgggtaaaatttttattggtgaaataaaaaatataattaaatacagttatgtataacttaggtctaatgagaaaaacaatttggtgtgtgtgtgtggaggggaggtaatacagtattttgctttattgggtaaagttcagtgttccctgtcatcaaattgattgcagacgttctgtgtgaaatccattcttaccttgtgagctgtacaaaaacaggaggctggaattggtctgttaccatagtttgccagcccctagttaagagcagtgatttttttttttaagaggaggggtctcgctgtcactcaggctggattgtggtgacgcaatcatagctcattgtagcctggaattcctgggttcaaggcatcctcgcacctcagcctgccgagtaagtaggaccacaggccgacatcacctcacctggttaatttttgttagagaacaggggtttgactgtgtttcccaggctggtctcaaactcctggcctcaagcaatcctcctgttttggcctcccagtgttgctgggattataggcctgagccactgtgcttgacctcctatttgatacactatatgttaacaactctgaacctcctttccttaagtcaggttcaaacttctgtacattagctgatgaaagggatttctttttattgcaaggtggtattgcctgagaatagtttggtttcagcagctttgctgtatttgtacggcagtatcttgtgtttatgtgcaagttcagatgtattttgcctttttataagaatgagcagaaaacaaaaaagtaaatggcgcgatctcggctcaccacaacctccgcctcctgggttcaagtgattctcctgcctcggcctcctgagtagctgggattacaggcatgcgccaccacacccagctaattttgtatttttaatagagttggggtttctccatgttggtcaggctgtcttgaactcccgacctcaggtgatccgcctgcctcggcttcccaaagtgctgggattacaggcatgagccatcatgcctggcctacctggaggtcttaaatatccttgagacagagggaactggttagggatatgaatcttaaaccttactggattaggttgtgctcattggttaggttagttggctttgtgcaaatagtgaatgcaataattagaatgaaataggaattaagtgaggcaaatgtatgatgaagtttacatttgaaaggtgagggtataattagaaataaaagtttctgtactctgtgagtgggaaaaacccctaaaaaggtgactgtcgtttttgaaatttttgacttctctcacattttcgggaatgtgaaaggaggatactggctatgtacagcatttgtccagacttttgaaaatatagaaaatctcatttactcatttaattagtgtgtatattatctgtttactgtgtcctttgtagatataattaattatccaggattcttaagagttgacttggagcatgctgagctgaggcaagagggattgtggggccagactgagtgttggaggaggaacctactgtagtgactacaggtgtatttcttttttctttttttttgaaatggagtttcactcttgttgcccaggctacagtacaatggcgtgatctcggctcactgcaacctccgcctcctgggttcaagtgattctccagcctcaacctcctgagtagctgggattacaggtgggtgccactatacccggctaattttgtatttttagtagagatggggtttcaccatgttggccaggctggtctcgaactcctgacctcaggtgatccacctgcctcatcctcccagagtgctgggattacaggtgtgagccaccgtgcctggtgtgtttcttgtctgatgtcagtgcatgtcgttatctgagccatatcaatgtcagctgaggattgctttgttatcctcggtgcattatgggaaggagaatcatgtcagtgctaccttactgtgattgaattgaattcattgatttaatatagattcagttagtacgccttatccataatatttgggatcagaagtgtttccgattttgtaattttttccccatattttggaatatttggaatattacttgcgggtgagtgaaaattcaaaatccgaaatttggggccaggcgcggtggctcacccctgtaatcccagcactttgggaggctgaggcgggcagatcacttgaggtcaggagttcgagaccagcctggccaacatggtgagacccccgtctctactaaaaatatgaaaattagccaggcatggtggtgtgcacctgtaatcccagctactcaggaggctgaggctggagaatcccttgaacccaggaggtggaggttgcagtgagcccagatcgcggtactgcactccgtctagcctgggtgacagagcgagactccgtctcaaaaaaaaaaaaaaaagttcagattttggagcattttggattccagatttttcagataagggatgctcaacctgtgccattttaggcaccagagggtatataaagatgattctctgctttcaaggctctgaagtatggtgaaccagacagttatacagtgcaattacagctgtattaagtggaggtgtgaaaagtgtagtaggagagatggagaaatcattgtttggcattgggtgaggtcttcaaagatgtcctattttcatggccctattaattagagcagggacttccggtcagagggatcaacttgagatcaggcagggttttttaaccctattgacagtttggggcagataagtctttgttgtgaggtgctgtcctactcagccctggcttctacccacaagatgccagtggtatagcccctaccccactcatatgtcttcagacattgccagttgtgccctgggggcaaaattgagaaccattatttgaaatggagcaatgcaagtgtgaaagtatagtgttttcagagtaagaactagtaggagagtgtgcaaggaacactagagatactgggaggggaggggttatgggagatggaactgaaaggtagtttgagtgaagctaaaatcacaaggggtaaccttgagtgccatgttaggacatttgccttttactgttaaggtaatgagagatgtactttgaagtttaagtgaaaggagacattagatttgtgtttgtttttgaaagataattctgatggcattcgtggcagatgtgttggagagttgagtgtcgggggattgagatggtattttaaccgttcttctgaaagataagaaataatgattagggaatggaataaaggaaggagatcaatggggtgctcccatggtatgagggaggtgctgctaatttgagtttggcttttctgccacagaatggagtactgagctaaaaagcaaaacacctctattgtcttcctttcaacttttcctgccacctccaattccctttcctcactgagagctgctgtctgttgaggtctgttgaaaggtcattgagagaagggaatctgggttacagaatgactactctctcaatgtggttccttaaacagtggattatcaaagcacaagtgtcatcttcccccccgctccccgcaaggggttagactggcatccagagagcattaattgtagcctctccttggtttgtgtagatgttattttgccctaaaatactttgatatacaaacataggtgaataatctgatggtttaattgtaattatttcattgcttcctattttggaggttagctttactattttaagtgagaatgtagtcagtggaagggtactggacttggagtcacaagatctgtgttttatttttttattttattgattttttgagacagagtctcgctctgccgcccaggctggagtgtagtggtgtgatctcagctcagtgcaacgtctgcctcctgggtttaagtgattctgctgcctctgcctctcaagtagcttaggattacaggcaccaccacccacggcgaatttttgtattttttgtagagatgggattttactatgttggccaggctggtctcaaactcctgacctcagctgatcagcctgccttggtcccccaaagtggtggaattacaggcatgagccaccgcgcctggtcaagagctgtgctttagttccagttacccaactccctgtgttaaatcacttagctaacctcttgggtcttcatgactctgtaaaaccaagatgttgggcaagaggtgagttaaactactacttttttaagttcttaaattttatctttattcctaaagatgtggaaaaatctgtagtcaagagaaattgtcaagtaaaggaaaacagagaaggtaaacactttaatgggtttagaagttggttatattcctccatttacttgtcaatccaacaacttgaatgtctcctctcccttgtttctcctgtgtggtctgaagggctttattttatttagaatcctgtgggttaattgtgcttggcccacagcttgtactgtgaatttagggaccatagactttgtagccaggggtataatttctttgttggcagagcaacttaaagtttggttaagttttcatctgcagtctagtgctttaataacataacttgctaaaaagtgatatagcctgctaggggaaatagtatttagggggaaattattttttccgaattgaagatgaaaatacacagataaatacagtaatagtgatttttatctggcacagatggtttcagagaaaatgttgatacctcatttcttattttactgtaagagaactagcaaaagaagcttattttgtttcttaggtgagtcattctcaaacttggtctcaggatgcttttatactcttaaattattgaggatcccagagagcttttgtttatgtggggttacagccattgatgatttactgtattagaaatgaaaacagacatttaataaagttatgtatgcttttaaaagtaacaaaaccccactgcatgtcaattagatatttttatgaaaaataacttttccagaacaaaaattagaagagaggcattgttttacatgttttacaaatctcctatctggcttaatagaagacaactggattctctgcctccttctgccttcaatctattgcgatataatacgtcatatagcctttggaagaactccatagtacacttgagaaagaatgacagtgaaaatggcaagtaaagtcttaagaaaacaattttgacctctctgacctcttgaaaagatctcagggatctttgagaaccagtgtcttagactgccaagagaagatgtgatgttatcttttgagtggcttatctactgtaaattttattttaactgagatatataacttacagtaaaatgcacaaatatgagattgtatagcttgataaatttttagaaaatatatacatctgtgtagtcattcagatcaagatacagaatatttccagcaccctggaaggttcccttatgcctctacctcctccctgtaaaaccccaaataccctgacctcttttttttttttttttcttgagatggagtctcgctctgttgcccaggctggagtgcagtggtgtgatcttggctcactgcagcctccatctcctgggttcaagcgattctcctgcctcagcctcccgagtagctggaattacaggcacacaccaccacacctggctaattttgtatttttagtagagatggagtttggccatgttggccaggctggtctcgaactgctgacctcaagtgatctgtccacctcggcctcccaaagtgcagggattacaggcgtgagccaccgtgcccagcctgacctctgtcttttaatgaatgttatgcctatttttgaacttcggataaatggagtaatacactatatactcctgtatctggctgctgttgctcaatacatgatcactaactgtctttttctttattgtttttttgagatggagtcttgctctgttgcccaggctggagtgcagtggcgagcttggctaactgcaacgtccgcctcccaggttcaagtgattctcttgtttcagcctcccgagtagctgggattacaggcgcctgccaccacacccggctaatttttgtgtttttagtagagatggggtttcgccacattggccaggctggtctcgaactgctgactgcctgcctcagcctcccaaagtgctgggattacaggtgtgagccaccgtgcccagccaacttcgtctttttcattactgtatagtattgtattaaatccatgatttatttatccattctgttggattgaggtgggtttttttcatttgtttgttttgaaacagggtcttgctctatcactcaggctggagtgcagtggtgtgatcacagctcagtgcagccttgtccttccaggctctagcgattcctcccacctctgcctcttgagtagctgggaccacgaccacatgccataatgcccagataattgttttttttttttttttttttttttttaaacagagatggagtctcactatgttgctcaggctggtctcgagctcctgggctccagcaatcctcctgcctcagcctcccagagtgctgggattacaggtgtgagccactgtgtctggctgacgtttgagattgttcagtgttttcaccaatataaagaatgttgccatgaacacttttgtatatgtcttttggtggtcttttgctgcatatccaggattggaattgctggtttataggatacatatgtgtttagctttagtcaatactgccaaacagatttcccaagtagttgtaccagtttaaactcctactagcagtaggtcgtgttgctcttccttatcaatacttagtattattatcagtcagtgtttctaattttagccctcttggtggaagtttaggaatatctggtggcttaaatttgtatttgtgtctagtgtttagaatactttcacatgctcaccagtcattttactatttaactcttgcttacctataaaatttgaagcttggctaataacatcttgtgtagttcaaaatcactagttgaatgaattttctgaaatgaggcttttaaaaataaacttaattggctggtcatggtggctcacacctgtaatcccagcactttgggaggccaaggcaggtggatcacgaggtcaggagatcgagaccatcctgaccaacataatgaaaccctgttgctactaaaaatacaaaaattagctaggcttggtggcatatgcttgtaatcccttttctgagaagtctttaatagatactctctaccctcttctaatttactccctttccaagctttttattaaggaaaaatcaaacatacacagatgtagataaacttccatttgcccatcaatcagcttcaactcatggctagtcttttttacctacccccttccattttgatgcaaaacccagacagcatttcatcttacatatttcagtatatcccattctaatttagatgtttttttccttggtgctcatattgtgctgctctattgtaaattataagttcaatttagttcttacatattctctcattctgctttgtaaacttctcacaggtaacaatcactaacacttaacacctgtgtgtgaggatctatgaaattgcttcacctgcataaattctttatattcttacaacagctctaaaaggtagatattactgtctctgttgtatatataaggaaaccaaggcacagaggttgaataacttgtccagcttgtacacctagttaagtggtagaacaggaattcaaactaaggcagtttatcttcagtctttagtgttaactactgcattacataatgtctgagtaaatgagcgctctactgcatataagttccttcaatcgtcctttttaattagcattttttccttgttaattttgcctcctgtcttgcatttccaacggcacacaagtattatttgctctttcataaaatctagctaaaagggcccttagcatgcaactctcttattttttatttatttaaaaaaaattttttttgaaatggagttttgctcttgtcacctgagctggagtgcaatggcgtgatctcagctcactgcaacctctgcctcctgggttcaagcaattctcctacctcagcctcctcagtagctgggattactggtgcccaccaccacgcccagctaatttttgtatttttagtagagatggggtttcaccatgttggccaggcaggtctcgaactcctgacctcaggtgatccacccgcctcagcctcccaaagtgctgggattgcagatgtggccacctctcctgttttaaagatgatcatcccttgcttttagctgttctgcttctaattttatatgtgatattctatcaaaaaattgctgacctctggtctttttgtttaataatagtgtctctataattatggggagaaggtaccacatactgaatttaaatattttcgtcttttatatactatattttaaatttttaatgtttttatttttgctttaacattgtatttgaaaatttcatttgcagtaactcgatacagctttcactttagatttttctgttttgagtattagcccttccggtgttaatttgagtgttcgaatctttaggattaattgtgcaaagatataaagactttagagaagccagccaggcacggtggctcacacctgtaatttcagcactttgggaggcttaggcgggtggatcacgaggtcaggagttcgagagcagcctggccaatatggtgaaacccagtctctaccaaaaatacaaaaaaaaaaaaaattagccgggtgtggtggcacatgcccgtagtcccaggtacttaggaggctgaggtaggagaattgcttggacccgggaggttggctcactgcaacctccacctcctgggttcaaacagtctccctgcttcagcctccctagtagctgggattataggcgcccgccaccacgcctatagcaaagatcgcactactgcactccagcctgggcgactgagcaagactccgtctcaaaaaaaataaattaaaaaaaataaataaataatgactttagaggatacttcttctcagatctttcttagtggaatttgtgtatgtaaaactattacagaaacaacccaaatgtccattgtccatcaagtgatgaatgcataaataaaatatacaatggaatattatctgtcaatgaaaagaaatgaagtactgatacatgctacaacttggatgaactttgaaaatgttatgcttaagtgaaataaaccagtcacaaaagacctcatatcacatgatgccatttatatgaaaatagattagcatgggactgaggggaggttggagggaagggagaatgctattaatggtatgaagtttctttttgggggtgatgaaaaagtaatctgagatcgattttggtgataattgtgcaactctgaatatactgagaacctttgacttgtacactttaaatggacgatttgtatggtatgtgaattagatctcaagggtgttattttaaaaaacttaaatataatttataatgataatctcattgattaaacataatttgaaattttttggtgtactttttcagattctttacatttatgatttaaccaatctggttttggaagatacaggcagaaagaacacccagtggaggcacataaaaaatgttactagactgggtgcagtggctcatgcctgtaatcccagcactttgggaggtggaggtgggcggatcacttgaggtcaggagttcaagaccagcctggccaacatagggaaaacctgtctctactaaaaatacaaaaaattaattagctgagtgtggtggcacacacctgtaatcccagcaacttgagagggtgaggcacgagaattgcttgagcccaggaggtggaggttgcagtgagttgagatcacgccgctggactcaagtctgggcgacagaacgagactgtctcaaaaaaaagaaaaagttaattattaatactgccttgtctaaaatgtcataaatgaaatgagatctttcttttcagtgtattgggttagcatttcatgattgggttagtaacttagaaaagttagataattttgtcaaaaattggtaaaaagctgttaacagataactttgagtttatcttttttttttttgagacggagtcttgctctctcacccaggctggagtgcagtggtgcaatcttggctcactgcaacctccacctcctgggttcaaacaatctccctgcttcaacttccctagtagctgggattataggcgcccgccaccacgcccggctaattgttgtattttttagtagagacagggtttcgccatattggccaggctagtcttgaactcctgacctcaggtgatccgcctgccttggcctcccaaagtgctgggattacaggcttgagccaccacgcccggcctaactttgagtttatcttaacctgttgtttcaacagagtagattgatagttaggcatacccgcattctgtaacatttgatgtgacttatgtctaatattaagtcaacattgctcacctattggctgatttagggactgggatttgtcggaacttcacagcctttgtaacgatttaaaaaaggagttaagaaaggtgttttctttttaaaataagtcttttcgttttgatgatatttttcaacattagtacatgcatttttggattatccagatgactgcctcataatcaagaactgttaacatcatttcggtacttatgttagcttaataatgtgttggtgccaagggcaaatgatgtcacaggatactatgtgtatagagtagtgtaatcattcaggtagaagtaggaacatatgatggtggtatagccatgcaaaactcgaacccatgccttagcattcagtaatacactgccatctgtcacgttatattaatagttttatttgtattccatttataaatttattttagttttagttatgagagcagtaagcataaggaatttaatcctaatttcatttctgcatttatttaagcaacattaaaatagaaagtgattaaattagtttttaaaaattctgttatgatagaaccagaatttgcaagcttgagccagcttacttaatattattgctggaaacctagcatttggcattaggtgactggaactgggactgcagttttgtatttactaggttatttctctatttatgaaatgggaaatatatttctaactaaaagggtcgttcatttgttcattctttcactcaacagataattagttgtgtagcaccacataattttatctcattactagtttaattttccctactgtcaaattttcttcagagccagcacaaaatctgataggaatattatgctatgaattgtcttctagaaggtaagataccacccccactcccccttttttgagacaggttctcgctctgtcacccaggctgaagtgcagtggcgtgatcatggctcactatagccttgaactcccaggcttaagccatcctcctgtctcagcactcccagtagttgggactacaggtgcatgctaccacgctgagctaatttttgtattttttgtagagaaggattttgccatattgcccaggctggtgtgctgggcaattcctgggctcaagtgatctgcccacctcggcctcccaaagtgttgggattacaggtgtgagccacttcacacggcctatacctttaacttgaaatttactttttaaaaaataggacaaaataattttaaaatgtggtaggattctgttgtaatgcaatggaataacagctatatcagtaaaactgttgaggctgttcatttatttaaaaacctaagcaattgtggtgtgtataccaggagcagcaaattctgataatttatagttgggagaataattttcctctgggctggtctagagattatatttatagggaccctctgaagattcaaaaataagaattgtcaagaggggataatcagcatttcaagagaggaataaccagcacttgttaaaacacctgctctttactgggtccctctgtgtgtctggtacttcacatacattctcctattaaagcttttcaacagtctctggaggtattagccatcttgagagagaaaaaaaaaagatacctggagttagaacatcatctgttgtcggcctgtctgctatgttgcagtatatgcattgttgaaaacctcatagtctgcaaaaatcaggtaccaaaaactaacaatgtgtatagggaaaaatgggcttaagagtaaactgatcacttcaaagctatgttactttgtaattagagcactaacaaaacaataaaaattccagtaaaatagcacagttttgaagatcctaaatttctgacaaactacaataaatataggacttgaaaaaggtagcttgatggaaggggcaggtataagggggagggttggggtgactgacttagagagacaaagctaagatgcataaatatcaggtggaactgcgtacatacttctgagacagagcatgtggcctgactaagccaagaagaataatgtggggctaggaggtggtggtgatgagcatctggttcagacctataacccccaaccccatgctgcattcagcttctgttacttgtgggtacaaaacatcaatgtgttgggggaaaagtggcaaccactattctactttgtgaatttgacgactccaggtacctcataagtggaatcataaaatatttgtccttttgtgaccgctttatttcagttaacatagtgccctcaaggttcatccatattgtagcatgtcaaaatttccttgctttctaaagctggattattttccattgtttgtatgtatattttattgacacattcatctgtcaaacggatacatatgcttccacattttggctattgtgactaatgccgctatgaacatgggtgtacaagtatttgttcaagtccctttcagttcttttgagtgtatacccagaagtggaattgctgtatgtatcatatgtaaattctgtgtttaactttttgaggaatcaccatatgttttccacagtggctgcaccattttacatttcttccagcaatgcacaggggttccagtttctccccttatccttgctatcacttgtgttttctgcctttttgattatagccatcctagtgatatctcatagtggttttggtttgcatttccctgatggctaataatgttgagtatcttttcatatgcttattgaccatttgtatgtcttacacattcagatcctttgcccatttttcaattgagttgtctttttattattattgagttgtatgaattctttgtatattctagatacaagtcccttactggatacattatttgtaaatgtttttcttgtaatttgtgggctgtgggttgtcttctcactgtttacagtgttcttcggagcacagaaattttaaaattttgataaagtcccatttaactatttcttttgttgctcctgcttttggtattgtatctgttagaatccattgccaaatcctaggtcattaagatttaccctcatgtttcattctaagagttctatagtttttttatcttatatttaggtctttgatgcatttcatgttaattcatgttgttactgggaaacacttctatatgtagtaggctcaacaatgaattatacacatgttgtgttacacaatgcattttaagtcagttaagagaaagaaatatgcagtcatactgttttcttataattgcataattgtatttaccagtgttatttcactgagtttgtgtcttgtcatgctcctccggttgtcatactggaagtatatttctgaattaatttttttttttttttttttttttttttagacagagtcttgctctgtcactcaggctggagtgcaatggcgcgatcttggctcactgcaacctccacctcctgggttcaagcacttctcctgcctcaacctccaagtagctgagattacaggtgcctgccaccacgcccagctacttttttgtatttttagtagagatggggttttgccatgttggctaggctggtctcaaattcctgacctcaggtgatccaccagtctcggcctcccaaagtgctgggattacaggcgtgagccactgcacccggccctgaattcatttttgaaataaatttggttgatagttttctttctttcttttcttttctttttttttttttttttgagacagagtcttgttctgttgcccaggctggagtgcagtggtgtgatctcggctcactgcaacctctgccgcctgggttcaagtgattctcctgcctcagcctcccaagcagctgagattacaggcgcccgccaccatgcctggttaagttttgtatttttagtagagatgggtttcacaatgttggccaggctggtcttgaactcctgacctcgtgatccacccgccctggcctcccaaagtgctgggattacagacgtgagccactgcgcctggccaatttttgtatttttagtaaggatgaggtttcaccatgttgaccaggctggtctcgaacttctgacctcaggtgagccacctgccttggcctcccaaagtgctgggattacaggcgtgagccactgcgcttggcacgatagttttatttctttcagtgcttgaagaatgccatcccactgccttctggccttcaagttttctggtgagaaatcagctgttggtcttactgatgatcctttgtatgtggtgatggatgcactttttgctgcattcaagattgtctttgtatttggcttttgacagttgatgatgtttctcagtctggatcttgaatttatcctacttggaatttgtcgaacttcctgcgtgtgtagattaatggttttcattaaatttggaggcagtttttgattctgatttcttcaaatgtcttttctgttcccttttctcccgtttctggggctctcattatgcatatgttggtttgcttattttgtcacacatttctctgaggctctgttcattttttttctctgttattcagattgcttaatctaacagtctgtatctttgctgattctttgttccgacagctcattggctgaatttttcgtttcagttattgtacttttcaacaccagaatttccgtttggttctttttgttgttaaattctgttagtctctgtttgtttagaaattgtcatattttacttctttaagcatggtttcctttagttcattgaacataagcataagagctgtttttgaggtctctgctaagtctggaccttctcaaagtcagtttcttttgcctactttttttctgtatgtggggcacacattcttctgtgcatgtcttaaatttttttgtttaaaactggaccttttatataatatagcaactttggataccctacacctctagcagctttgttgtttgttgcttccttatttatgtagtgactggctgaactattttagtgcctacccctcagcctgtgatgttgctcttcagcgggtgtagccttagtcatgcctgggatgatggtgattttagcaaggctttgtgagtttctgtgatctctctgttaaacctctctctgtgttggtatcacatgcacatattagcctctactaattgcctactgattggtctgttgatttaaatgactccttgggacataaattgccccacagtctgatccagttaaattctcatgctttccaggggtaagtaatctttgaggctgtgtctgaggtttgttctgaccccaggaaggttcttagcttttatttccctggttctatctggtaagctgctagctgagtagtttaacttgttgctgtccaccacaggtcttttgatagctgcttattaccatgatctctcctgttttgtgttgttttccaacacaccctcaggcagcatattaccatattgtttcaaatagttcactttaagacaacttcagaactctgttcttacggcctgcctttccccctgggcaaaatctttacaccactgcttcagaactgggttggactgtggctcacttctcagagtgacacctctgcttcttgagcagggtgattggctttgcctgccatggaatcttgactctgagtgaggtggggtgggggccattaggaccacgcttttcttgacttgctgcacctggggttaagagcgtctgcctcacaagtggggcctagctggaaaaaagagccccagacttcttagccactcttggtgcaatagagcctgtgcaactcaaagttgggggtgttgagaaatgctgcctgcctttacctcctggggagataccatcaactgggagctgggtcgggggaggtgtgttcttggccgttctcacctggagtggagctactgtcctgctgagctggctcaaatgccacagactatccttactgagatatggtagattttcttaaataaattattttttcatttggtatatgcccttaggacaatttccagaggcttttagtgttttttgttttttaaaaaaataattttcaccagttaacgattgtttcactggggagagcatttacggagcctttgagggcaccattccaaaagttatttttaatgtaaaattactcaaattgcctacagccacttaaaaatttgtgtttgagaatgctttggaaaagatgctgaagtttatatgtatgtaaaagcttcattactctaattgtgtacgtacaacttgacagatgctcgatatggaggaggtttgaataagggtgtttggccaattactgagcatttctaaaagaatacatttctgctgccacaaagaattttgaatgcaggatgcagttctgttgcagtgacttataggaagtagccatggatgtacacagtaatttagtgacaaaaatcaggaatctgtaaggggtgtgtatgtgtgtgtgaatagtgttggaaataaaatacgagcatttagctcaagtaacatatttgaatttaacaaagattaattggacatctttatttgcattaacctgaattattgattggatttaaagctgtctagaagtagcatcacactggggatggggggggcaggaaacctgtgcttaatacagttatcttgactggctttgggtataatttatcataatgtgtgataagaatgataaagtctgtgcaaatgataatggcagtgctggtggaactaggaaaagaaaagcttttacctttgagcaaaggccacattttaaaataacttagggatgtttaggtgtatagctgtgggctcaactattaaaaataacttactgtatttcagactccttaacatgaacctcctcatttaacacactctgtcagagggagagatccccagacttctcagccactcctgcctgtttgagaaggattctcaaacaccccctcccccagagaaggggcctcattttgttgcccaggctggcctcaaactcctgggctcaagtgatcttcctgtctcagcctccggagtagctggggctataggtgtgcaccaccacagccagctaatttttataacatgattttttattccatatatctgaggaatacagctaattgtgtcttagttccttgatatgtactataacagtgacaacgatacttaacatgcagaaattgtgaattaagtgaaaaatccaattttgtaaaacatgtttctgcatcaaaaactaaacagtttgtcttgggagtggggttatggtgagattaatggtagtttccccctcccttttctgacattattgatgtatggtgtgatagttaaaactgtaggacactggcacttgtactgtctgagtttgaatcctggctcctaccactttgacagcctgtagtcctctgtcccagtttttttactcatgaaattgggctgataatagggttgttctaaggattaacttgcttagaatagtgcctgagacaaatacttaaatgttagctattgtcactattaatgaggaaaatgttatttaaaatttgaggtgtgtcaacctggctgcactagtattgaagttgggaaatgagagacaaagttggaaaaataagttaaaggctgattatgaatgaccttgaatatgtaccagatggagaagagaagccattcaaggttttagagattgaaagtgttgagattaatttagcattaatatactgaacgattggtatggtagtgtggacgctagccaggatgctgttaaaataggagtctaggctagagtggtttgagtgggagtggaaaagataacattggacacatcatgaaagaagaatggaggagatgggaagggagagatttgactttgtttttactgtatttccccacactcccaattttagttttgagcactgctatagactgaacgtttgtctccacccctccacctcgcaaattcatatgttgaaacctaaccctcatgtgatgaggtggggcctttgggaggtgattgggtcacgagagtggaaccttcacaaatgggattagtgcccttgtattaataaaagagactccagggagttccctcactctttctgccttgtgaagatacagtaagaagattgctatctgtaaaccagaacgcaggccttcaccagacgctaaatatgcttggcaccttgatcttagactccccagcctccagaactgttaagtgttacttgagccactcactctgagcttttgttacagaaggggctaagacaaacaaacacctgttgtttgccaatgaatccttgggattcagtgatgagcaaagcttgcatagcttctgcccttaaggagcttttatgttttagtaagaagataaactcacacaggtgctatgagaaaatagggtagctggctcctagagtctaggatgtgagtacttgatgaatcctgagtcaggagagttgggagctgctgaattaatatgggtaaaactaagcagactgctttgttcagaggctctcagaggtggcatgaaggagcactttgtgaaggaacaacaagaaggcaaattgaactggagtttgaacaagctttggctggggttagctgcaagatgaggctggaattgggtgtttgagggccttgtagaccattagataagtattttgatcttcatcctggtctttgaagattttttttttttttttttgagacggagtttcactcttgttgcccaggctggagtgcggtggcacaatcttggctcactgcaacctccacgtcccgggttcaagcagttctcctgcctcagcctccctagtagctgggactacaggcatgcaccaccatgcccggctaattttgtatttttagtagagatggggtttctccacgttggtcaggctggtctcgaactcccgacctcaggtgatctgcctgccttggcctcccaaagtgctgggattacaggcgtcagccactgcgcccagccagtctttgaagatttttaagcagtgctgtgacatattttgcatttcagtaaaactcatagtgatgatttttaataccgaaagaacaaaacaattgtaggaatggatgcaggcctgacagtcactgctttcaaaagaaagctcaatcccttttccctgttgtttccttttctccccgtttgaatttatagagaacaacagattctgtagagaaccttcatggtatagttggaagagccaagggttttagagtcttaacggaaattattgtgatcttgtataagctcagtgtacttaatctcttagcttctatttatgtctgttaaattggactgatggctgtatgagataggtattatgattaaatgagattatacaaataaagcacctactgttgtgcttgatacacaagtaagtacttaaaacttttcaagaataatatacaaactaagaactggaaaggagccacagagaacttttgaatggaatggaaccaacaagtccacaaaagaaaaaaaatctttagcataaatactgagacctgtttcgccttgcccacagggtggttatggaccatagtgtctaaatataattgattgtgaggtgtatgctacaagtaattataagcaattaaataattagttaaaatagtaatgtttgcaaatgagattacctaaaaatattagagtcaagattatccccttaataattattttcactcacatttcatgtgttttcgattgaggcaccaaaagaatccttgaagtccagcatataagctattaatgtttgctgtttttattttgtgctctgctttatacagtttttgttttttggcaatttctctgtgtccatagaagtgtgtcaaacctgtgataaccttattttagtgtcctttctcatgctgtggtagaaaaactgctgtgtaggttactttttcttctagacaacaatgcactaaaattttgtctttaaaaacataattgaatctgtcatagcaacagcatgttcaatttaaaaattcaaaaagatctaaacttggcttaaaaatacgtttttttgttgttgtttttatttgagatggagtctcgctctgtcgcccgggctggagtgtagtggtgcgatcttgctctctgcaagctctgcctcctgggttcacaccattctcctgcctcagcctcccgagtagctgggacttcaggcacctgccaccatgcccgactaattttttgtatttttagtagagacagggtttcaccgtgttagccaggatggtctccaactcccgatttgtgatctgcccgcctcggcctcccaaagtgctggggttacaggcatgagccaccgcgcctggccaaaaataagtatttttgtactctaaaatggtgggcattttgaaagaaagcttagctgaaaagatgctgcttactggattgtaataaacatgaaacaattgatttatacattcacattataattttaaatcagtatatagttgacccttgaacaacatgggttcaaactgtgtggtccactttcactgcagatttttttcaataaatatattggaaaatattttggagatttgtgacaatttgaaaaaaacaggataaactgcatagcttggaaatactgaaaaaattaagaaaggtgtgtcatgaacgcgtaaaatacatgtagataataatctatttactaccataaaatatacataaatctattataaatttaacatttatcaaaacttaatgcacacaaacgtttttatagaccacatgtggtgccacgtgcagttgagagaaatgtgaacaaatgtaaagatggattaagtcataactgcataaaattaactagtacattctctactactgtaatttcatagccatctccttttgctactgcgatgagtttgttgtaagtatccgatgaaaatatgtgacgctgatctctgcatgagcagttcatctctccagtaaatggtctatcatagtaaaaaatgatctctcatgttctcatgtatttttcatcatgtttagtgcaataccataaaccttgaataacattacgggactcatgaagtgtcactagtggtgctggcgaacaggctcccaagaagcagagaaaagtcatgacgttataatgttctgcaaagtttcttataagaaaaagttgaattgcttgataggtaccatagattgaggtctgaggtctgcagctgtggttgtccgccatttcagatgattgatcttgtaaacagatgatgtaattttactttattggtaaaaacagtacagtactataaatacattttctgattttcttctttccttttttttcccttttcttttttttttttttgagactatctcactctgtcacccaggctagagtgcagtggtgcgatcttagctcgctgcaacctccacctcccgagttcaagcgattctctgcctcagcctccctagtagctgggattaaaggtgcacaccatcacacctggctaattttttttgcattttttattagagacggggttttaccatgttggccaggccggtctcaaactcctgacttcaagtgatccgcccgcctcagcctcccaaagtgctgggattacaggtgtgtgagtcaccaccccttctgagtttctttttttctctagcttgctttattgtaagaatacagtattataatacatgtaacaaaatatgttagtcgcctctttatgatcagtaaggcttcttgtcatcagtatgctgttagtagttaagtttctgaggaatcaaaagttatttatgggccgggcgcagtggcttatgcctgtaatcccaacactttgagaggccgaggcgggtggatcacgaggtcaggagttttagaccagcctggccaacatagtgaaaacccatctctactaaaaatacaaaaattagcccggcattgtggcacctgcctgtagtcccagctgcttgggaggctaaggcaggagaatcacttgaaaccaggaggcagaggttgcagtgagccgagattgtgccactgcactctagcctgggcaacagagcaagactccgtctccaaaaaaaaaaaaaagaaaaagaaaaaaaaaaaaagtagtgaggtctggcgccctctactggtgaaggctaagtatagcttgtgttgtacagttaggtctcttgtctctagtgagtcaaatattttaatggaaaaacaagggttatagatgtcggttaaacatagaaatttgaaaggaagagaagtaattccctttgattgttggtgcataaaaccggaataggcaaaattcacaagtcaagattaatttccaagtcaagataatttccatgtttgagcttaaggatgatctatcaaattgttttctaagaaactcatttcactttgatgtccagtaaaggaaataatctggtagggggttggagttgctgttgcttgtttattgtctctatccccagtctgtaatgttccacaaaagcagagatatttgatgcactgtgtacttccatatattctcctatgattagaacaatatgtgacccattgcagatgctcagtacacaatttttgaatgactaagctttgagtttttatttaaacaccttttttttggatgaaaagaaaaattgagagaagaaaatcttaagtatcctaggatcatatgtagaatcagaggatttcaacgtgctgtataaaaggagagagattctggaacatagggcaaattttagcagagttgggataatgactgggtaagaaaggataattctttgttctaaaagggatttctctggtattaaggccctgtgtgaaagctgctggagaaattcagttctgcaaagtttaaagtaaatggtttgctgtttatggagtactagattacttaatgcagtccagcctttatctaggtaaaggtgatgcttttcccattgtggaagatgttaggatgctaagtttgaatatgaaaatgtgttgtgtgttgtagaggcaatcaaatcaccattttggttgtatttcccattgagaaaattaaagatgcttctgtttgtgtaataattttgtttttatgaaataaagcgtaaaacttcatgtggtaaaatttcacactgtgattcattgtatttgagcatgcctatggaaagtgattgttactgtgtcaaatattgaatgatttgaataattactaagttgttcagttgtgtgtaggatactgctgctttgacttggtagagagcttgttctagccctgctaggtatgcctaaatctctgtgacataaaaaacaggctcttttagagttgtgagactgctacttgaaatcaggcaaagctgtgtgattcccagctgtttccaccacttgagtattgaataggatttattaagaaaagtagtggtgttattcttggataacttagttgtatctgtgataagtttttttctcccactcaaacctttccaaattatatctgaaggcaatattttcagattcattcctgaaatatttaggaactctgcacagtacattgtagaaagggaaaagaaaatttacatttttttgagaattactgtgcttgctatttgtgagactccttttattaaagcaattctcatggctttcttttttttgtgtgggtaatagcatctcaattttaaatacctggaaaaagaatgagagaggttgttactttctttttaagataggcagattgtaagtgacagaagttggattttgaatgagttatgtttgaatccagaaattatttttaattgctccatgcctatttcctgctctttatcttgcatcttagtgtgctgagggaaagggatcaaattcttatgtggtagtagagagatgcagcagagtatgctatgctgagacctgacatacctgctcagcaataccggaaatatagaaatgaggacagcttgtcgggtagaagaaacagaaaccaagagctagaaaggcgagactatataagagatagggatagcaagcagcttgaggcttttgctgattgagtgtcctgtcataagcagaagatgatttagttctgtggtcttagagaaaggtgttttgagagaggagtttcacactgccgcttttcccatttatcttagttattttgtttaaagggatagtcccttagttatccacatgatacttttgtctagaataatttataccatgacttttgccagatatttctgatttgtgtatagatggttactgaattcatatagatggaaggatattgtgcataaaaatatgagaatataattttgaggtattttagctcaaatgatctccaaatgctaaaagaactgcaaggtaagggaacagtgagtactctatatatacaattttactgtgggaaaatatacataaaatttaccattctaaccttttttttttcttcttcttttttttttttttttgagacggagttttgctctgttgcccaggctggagtgcagtggtgcgacctcggctcactgcaagctctgcctcctgggttcacgccattctcctgcctcagcctcccgagtagctgggactacaggcgcccgctattgtatgtttattagaggtggggtttcaccgtgttagccaggatggtctcaatctcctgacctcgtgatccgcacaccttggcctccagaagtgctgagattacaggcatgagccaccacgcccggcccttttttcttcttttttgagacggagtctcactctgtcatccaggctggagttcagtggcaccacctcggctcactgcaacctctgccttccggattcaagcgattctcctgccacagccttccgagtagctgggattacaggtgtgcgccaccacgcccagctaatttttgtatttttagcagagacaagtttcaccatgttggtcaggctggtcttgaactcctgatttcaggtgatccacctgcctcagcctcccaaagtgctgggattacaggcgtgaaacaccgtgctcggctgattttaaccatttttaagtttgcagttcagtggcattaagtacattcacattgtgggatgcttaccatcatccatttccagaacttctcttctttccaaactgaagcgctgtaccccttaagcaataactccccatccccccagcccctggcaaccatcattctactttctgtttctgcaagcgtgactaatctgggtacccgtgtacttggaattatgcagtattgttcttttgtgaatgacttatttcacttagcatgatgtcctcaaggttcacccatatcgtagcacctgtcagaatttcctttctttttaaaaaatactaaataatccactgaacataggtaccacattttgttcgtccttgtattgcttcctggaaagacttttaaaagagacacagtattggcttagtagacaaggtgatctccctggccccctacttgccccacacttgggaatatatagtcgctaacctcatcactctcaggaggagatggtagggagtggaggttgtatttattttcgggaaaaaaaacagactcccaggtggtgctgatgaatccatctcttcctacccttttgtgaatagttgaatctgtgttcaagattcccaagttttgcctgaattctagacgtgtagagccaactctctagtggttttcacctcagtttcaatgttaagaactgtacgaactgccactctacccctttccttggaagagaagtggacgggaaacctggagtccaggattatataagccaaggaagctcagagtttcaagaagggagaggtggtcagtgtctaatgatgagaagagggcaaacaggatgaatattgagaagcagttatttgatttgtcagtaagtagaacattgatctgtggaccttcttctcatgcgtcccctaatgcacatactcaaaagctttgtatgtaatttttaggggaattaatcttgaagcccatccctacgtctcgattaagaccttctggcttaaagcagttttagttttagtagctttggatggagccaggtgatgagagagaatggacaaagtggaaggtgagatgggcggggcatggtggctcacatctgtaatcctagcactttgggaggccagggaggagaattgcttgagcccaggatctcgtgaccagcctgggtctcaaaacaacaacaacaaaaaacccaaaatttacaacttacctactttgtcttcatcacatttatttaaaaagaaagagaagggggaaatggagacagtcttacgacttgtgggaaaagggaagggcagacactggtgattttcagtagggaagattcaagcacaggctgggaaaagattgattggggatgatgatgattggagcatcatcccttggagagggtatacaatgggatcatgaccccaagctgagggacaagaaaaagaagaaactggagcagatttgaagtagacaagaataaagttgaattggttagctaatattttgagtgccaagaaaataattattcacatattagccaggtgtggcagcacgagcctgtagtcccagctactcgggaggctgaggcaggagaattgcttgaacccgggaggcggaggttgcggtgagccaagattgcgccactgcactccagcctgggtgacagagcgagactccgtctcaaaaaagaaaataatcattcacataatttgtcagcagacccaaagtggctaaggaaaatgatatgcaagtttctcaaggttttgaaaattgtctgcttcacgtaacactctttgtaatttagggtgtataaaatggataacaaaagcgaaagagggactgcttaaatcagactttttcattttttttttccactttatgtatttaaagagcttctatgtctttagactcaccagtacttgatagtatcagtcttaaaactttgttttgcttcgccagtttgatcagtggaacaaattttggttttgtaatttgcattttcgcaattactaatgaggttgagaggcaggctagtgtagcatttaagagctatggactccctgggttggaatcccattttgccacttagtacttactgatacggtaatttacttttgctctctgtgcctccctttccttacctgtaaagagggatgatactagttcctactgtatacatttgtaaggattacggtgctacaaacagtgcctaacatgcgaaaagctctattttaaaattatgtcttatttcatgtatttattagtcacttctatttctttttgagaagtctatcttcatatctgtttttctacttctccctgaagcttctgaattttgcctagaggaggacatatcttttttgtgtgtgtgacagagtctcgctctgttgcccaggctgcagtacagtggtgccatctcggctcactgcaagctctgcctcccaggttcacgccattctcctgcctcagcctctccaggtagctgggactacaggtgcccgccaccacgcccggctaattttttgtatttttagtagagacggggtttcgccatgttagccaggatggtcttgatctcctgacctcatgatccgcccgcctcagcctcccaaagtgctgggattacaagcgtgagctaccgcgcccagccaacatatcttaacaaatcagtttttgtgtgtgctttagtcaagttttttttttttttttgagacagggtctcgctgtgttgcccaggctggagtgcagtggccccatttcatctcactgctacctccgcttcctgggttcaagtgattctcctgactcagcctcctcagtagctgggactacaggggtgagccaccatgcctggctaattttttttttttttgtatttttagtagagatggggtgtcaccacgttggccaggctggttttgaactcctgacctcaagtgattcgcttgcctttggcctcccaaagtgctagaattacaggcgtgagccactgcgcctgattttaaacatattcctctagcactttctatagttgtttacattttcctcattaatctgcctgtaatttgtgtgtatgtcaggtggtggcaggggttaaaatgtacgtcaacttttttttgacaatgatagagaacttgaagaggaagaagtcttagagtcagatgtgaattagagtccgctctgcataacttaggcaagcccctgctgtctcttatttttgactctgtaaaatggagataatactcaatttctgtgctgcatagactgggtatgagaatcaagtgagttgtggcagagcacttcgaaacttcctgcagtggcttggtaacctaagtggtgaaaaatacttgggtattaatattacagaagcaagcccccaggtaagttttatataccatggtatacatttggttttgaatgtcttaagccaggtcataattagaaaacttagaaatgaaactttgcaatgcttgtgggaagtctctctcaatctcttgagagccagtgagttagaaccaatcagttaagtttctctatctggtggcaccttagagtcattcactgggggagattttttgcaaagttctgatgcctaggccttactcccagatactgtaatttatttcatctggagaggaacctgggcatcagtgttttaaacaaaatcacttcaggtgattttattgtgtagctgaagagggctactgatctaatgaatatagaattgaggatttggtagcattctcctgtacttgtttgctggtcagtttgtaaagaagagttccctgttcttaaacagttgtggccttgtaaccctgttatggctctaggagtggctggagccaaaaccttgccaaagtagagagctgagatcatctgacaaattcagttgtattggagtattatgtagtttgaaccctcttaaaattttaccagaggtttttggggggttttcagggttttttgtttgtagggggtggagagagcggggatcttaacagaaatttgttctctcacaattctgaaggccagaagtccaatatcaatgtgttggtaggtttggtttcttctctggcttgcaggtggccacctttttgctgcatctttacgtggtctttactctgtatgcgtgcacccctgatgtttctctccaaagcgtcaaagtttatgttaaaagtacttagaagctagtttaaaaaaccatttataatgccctagtatcagtgataaacgttagttgtgcggcctgccttgaaatgttttaaaaaatcactttgtactttgtctaagtacacatgttactgaaacaggagagttccctgacgccctcacaggatgtgtgacaggggtgtggctcatttattcctcttatgggaaggggagcacacaggtgagcaggtacaggagccagggtgagcgcttttgggctccggccccacagcagtgtctaggagtgttacaatgctcctttagccctgctgtcccagcataagtgttaaacagctcagagaagagtcagtgtgacagcctttttgggtttctgcatttagggcatcccgagttcttttcctgtgtctgggaagaatcaggtcacagggacttgaaggatggtgaatgtggggatgttattgagtggtggaggtggctgtcagtgggatggggagctggagaggggatggagtgggaagatgatcttctcctggagttcggctatctcacagccaatctccaacggcccccagcttgaacctcctctccacctttagacacttcctctcttctctccttctctgctgtgcttctctgccactcttctgcttttggagcctggggcttggggtttatatgggcacgggataggggtgcgtggcaggccaaaagggaacacttgggcgtgaaaacaggaatgcctgttctcatttagggctgcaggtccaggcttgagccctcaccagggaccccaccctcatacctcttgtccttattcttacagtgtaatgaatgcatcagcaaattgaaaacagatagtttttgccgtttcttaatttaattaaaatgacagttaagtactttgatatattgcctttggagtcatttccaggaggctatatttgtttgttttcttggtataatggccagtgtaccaatgatcagttttaagttaaatgtagtattaatgaaacttcagctttttactttctcttcttgtttgtatagcccctttttcctgattagattcactggtgatactaaattcgaacagttccataattcatgttttttatatctaaaaccaattactttttcccctttctatttgtaggttatgcaatggtctctgcaagatggtttattcttgaattggacctttttaagactgacaaatgctggtacttcatcttctataagtggactataatttcttttctcaagacaactacataagcagacaaaattgcaaagatctgccctgtgtcgagtatgacagccacgactcgtggctctccggtcggagggaatgacaaccagggccaggctcctgatggacagtctcagccccccctccaacagaatcaggtaggatgttgaagatactagttaaagctacagtggggctggactcagtggttcacatctgtaatcgcagcactttgggaggttgaggcaggcagatcacttgaggtcaagagtttgagaccagcctggtcaacagggtggaaccctgtctctactaaaaatacaaaaattagccgggcgtggtagcatgcacctgtaatcccagctacttgggaggctgagacaagagaattgcttgaacctgggaggccgaggttgcagtgagctgagatggcgccaccgtactccagcctgggtgacagagcgagtctctgtctcaaaaacaaaaacaaaaaacctacattggtgggtctactgttggggtactaaatgatggaacatgttctaaataatttgtgaagcaactgttattttaagttttgattaacaaaagtgaacacgttgggcgcagtggctcacatctgtaatcccagcactttgggaggctgaggcaggcggatcacaaggtaaggagttcgagaccagcctggccaatatggtgaaaccccatctctactaaaaaatagaaaaagtagctgggtgtggtggcacgtgcctatagtcccagctgctcgggaggctgaggcagaagaatcccttgaaccgggaggcagaggttgcagtgagccgagatggtgccactgcactccagcctgggtgacagagcaagactccatctccgaaaaaaaagaaaagtgaacataggtcttgcatagtaacaagaaagctcaagtggtgtagatggtaatacttgagtatgtagtccgtctttttctgatggcttatactgtcagtcattaaaattaactaagccatgtgtcaattctaagggggaaagcattaaatcattcagtgtagcctatggttagcattggacccatcataaatcatgacaccactttctaccccataaatacatacaattgtaaattgtcaatttacaataagattataaaaagaacatggacccaagtcatgttgcctagcgttcaaatttcagctttgtaccatacttgcgttatgactctgggttaattatataacctctaagcctcagtttgtttatctgtacaatgagggtaataatagtgtaactacttcatggactgttaaaaggatcaattgaattaatgctaaacatagattttggtattaaggttttatgctggccgcaaaactcatagggtgtacctctttctgttctctggatgaatttatgcgaagtttattatttcttcattaattgtttggaagattttactggtggacccatctggcctggggttttatttatggaaaagttttaattgaagatccattttttaatttggagatggggtcttgctcttttgcccaggctggagtgcagtggcgcgatcttggctcactgcaacctccacctccctggttcaagcgattctcctgcctcagcctctcgagtagctgggattacaggcacgtcccaccacactcagctaatttttgtatttttagtagagatgggatttcaccatgttggtcaggctggtctcgaactccttaccttgtgatccgcctgccttgggcctcccaaaatgctgggattacagacatgagccacggtacccggccgatccatttttttttttttaagtggaggaattttttaatttttagtgtcttttggtaaattatggttttcaaggaattggtttatttcatctggattttcaaatttgaggtaaagttgttaacgaccctttttattatcttttttgtgtcttggggcctatggtaatgcctccttatttctgatatttctgataccactaccaatgtcattaaaccttctaaaaacaactctcttggctttactccctccccccacacccctcccgccaacacacacacacacacacacacacacacacacacacacacactctctctctctctctctctctctctctctctctcgcgcacgcgcgcgcgctctctctctctctgttccttttgcttactttggatttggtttgctgttctttttctcatttcttgaaatggaaatttagataattgatttcagttgtcttttctaatatatacagttttatattgggaagtattaaattgaatggcaaaacattaaaacttacgatgtacagctcacatcacaacttaccttctatagaggtaagaggtaagttgaggtgtgtgtaaatgatcacaaacatgctgcttccaattattacatgtttatgtagagtcaggtaagtttttaggcaaaagtgttattttgaagtttttatactgttatttggggataagttcttattgtccagctattacagattagatattctatcgtaagtagtatagaaaagagcttctgtctgtctctcctttttcttctttctctgccattttagagaagtgaacaagtcgggggttttttctcccccaaataaatgtgtcagttttattccttttcctctctagttcccattttcgagacataaaatattaaagtgtatggtcacaggtcttggacagagttaagaccttcctgtgacataaatttgttagccagtattcaggtttttaaaagcgtagtcagaggtttgagttggatgctaaagatttctaattttacaccagaagctagtagttagagttccagtatctttccctcttcctttttcattttatacctgcattgtccatggaattctaaccttttttgcaatgtttctgacttgcatggctttagacaaaaatcaaacctttaatttaaccttactcttattttaaggtgtacttgatgatttttagagctcttgggtttgtgatattcaacctaatattctatgtctacattgtgttctttttcttctaaaaactttacatttttaaagatgactggtaatttaaaataacaaaggaatgaaacaaattacattatccctcactcttacattttgtttttctctactttttaatgttaggattttattttacaagatctgacacggttgtaccaagaagcagcaaccaaagtgttaatcactgttcaatttagggctcgctttttggatatgctttttatgtgctggcataaagggaatttctaaaatcagatttttcacttaattttttttaagcatgcctttaaaaaaaattctcttagagaattttaggctttagtatgtagtaaaactcgataaatgaaacagccttggcagagacaccgtgggatgaacactcttggatgtggttgctgggagggtgcaaattttctggaatgaaatttggcagtatttgtcagtggccttcaaagaaattgtttatactgttctagtaattatatatccaggatcctatcctaaggaaaagttgaagttcaacacaaaggtttatatatgagaacattaattacagctatgtttatgtttgttagcagtaaaaattaccaaatactaaacgtccccttaattttgtttaattcatgcaatattatctggccattaatatttttttaagattcttaatcaaaaaattgaatacctagatatattgaatggaaaaggacagagacttatgtataattccagttttattgaacatatatatggacagtttttatttactcttaaagattacaaggaaataaatatcggtggtgtttataggtgtggaattacaggtgttttaaattttattttttatattttctatgagcatgtgtaaactacctgtatatcagggggcaaggagttaaaaaataataaagcaggcttccaaagttacatacttcacatcagacatttttgttggacttgtaacacttgacttccgtgctgtagtttcctgtgccttgagaccagctctgtgagcacctgcacagttttactgtgttactgtgagcacctgcacagtgcaccatttagttactaattgaccatatgagttcatgtataaactttgtgagtaaaacatattaatgctggtaaactcatctgtcttcgtgcaagtgcttatttatgcaactctttattttacaactgttaaataggtgcttgaatgataaggcgaggggcccgtttctcttaaagggccatcagcctatagtgaatagaaaattcaagaacacatgaataaaaatcagtttaaaatttaggttagtttcattttgaaagagaaaataccacctgctttctgaattaagagtaaaggtcataaaagttcattcacttagttgtgaaaatattatgcactgttaaaacggggggagagaaagacatgctaaaaatgaggaatgaaagagaaaaatagccacgttagttgaaagtgatgttacttatttaagaaccataatcatgaacttctaaataattattgtttggataatggtttgggtgtagggaagttatggaataattacattttctcccttcaaataaaaaacagaagttataaattactttataatgtataaaatgtgatgtatcatatttgtggaataatttctgtcatggcttatataatgggaaatgtaagcagagaggcagtacacattatgattaagaacacaaactatttagactttgatagaaatcctgagtatagaatttgagctgtgtgatcttgggctacttactttctgagttttttttcatctattaaatggcagtaacatatttcattaggttgttgaggattagatgaaattattttaaagcacagtagtacagagatggcctgaaacatcataaactttcaattattttatcttttgtaaaaatttacaatgcagttgtcccttagtattcatggaggattggttccaagacctcttaccacttggatagcaaaattggtgtatgctcaagtccctgatataaaatggtttagtatttgaatataactcatgcacatctttctgtatatacttcacatcatctctagattacttatgatgcctaatacagtgtagatgctatataaatcattattatgctatattgtttggggaataatgacaagcaaaaaagtttgtacatattcagcacataggcaattttttctgaatattttcgatccaaggttgttggttgactttgcagatgcagaacccatggatatgtagggctatttacaaaatttttaaatctgcaatgcttgtctatgttggtgtttggattactattttacatatgttatagaaacttaaatgtggaatgtttaatttttaattaagacttcatcgcctgattcttccaatgaaaattccccggcaactcccccagatgagcaaggtcaaggtgatgccccaccacagcttgaagatgaggaacctgcatttccacatactgacttggccaagttggatgacatgatcaacaggtgagttggtgtgtaacacccaagaaagagagcagacaggaaagtaaccccactgcctccttaatagtctttatagcttcgtcactgccaagtgctttataacccatgattcttaatagatttaataaatgaaagggagtgacagtgttagtaaaaatttcacattaatgatgatgaccctagttgggttgtttccgaagtaaaattgtatgttcagtttccctcttggagagtttatgaagtttttttctcattggtctcttggttgctggatgactttcataatttttgggatggcctgaggtaaatcaggtcatgaggacattgagttcctcagagcctgatcctagtgaactcttgactagtttgagctatttaaccatcctagatgtttcctttttttggtcttcatctcagggaacagttcagaatataatttttcacacttatagtacaaacaaccaccctatcccaccccacacactttgattatttagaggaaacctccaagagagtgaagctttaagcttttgtgcagaggaagaaaaagatttcaagaggctagggaagagcacatcaaggaatcccatgtgactgtgatcttcaccagactgtgggctcaacaagtgagtgctaggaaggtgcgacacatttccccctcactccccaaaaggaaagtaatgaaaacacatgttcttaaaggcacttgctttactgagtttttttttaaatttcattttctaaaaataagtcaacactattaaatgcataatgtgaggggaaatagaaatcctttgcattaaaaaaagaaatctaaatacataaataatgagtatgcgttaacagaaatattttgtgtaggtaaatttctctgtaatttcccccttacatacacatattcctgccaaaaattactgttaacaatcaatacattcttcagattacctttgtgtttactatcatatatgaattgatttttctataaatagaggattcttactataattttgtaacttgctttcatttatcttgaatatttttcctattaataaattccattgtttttaattatatatttataagaatacattgtgtgattctggcaggtgcctatagtaatggtatataataaattatatttaatagtggtccctgaccattctctatagcagtgataccatagcagaaggttgtattgtttgttgcttttccatacttgtctggtggttggtgattggtaataaaatacttcttaggctaaagttgcatattattagcaagttctcaggggggagaaaaatacaaatgattttttttttctttttttctttttttttttgttttttgttttttgttttttttgagatggagtctcgctctgtcaccaggctggagtgcagtggtgtgatctcggctcactgcaaccttcgcctcctgggttcaagcgattctcctgcctcagcctcccgagtagctaggactacaggcacgtgccaccatacccagctaatttttgtgttagtagagatggggtttcaccatgttggccaggatggtcttgatctcttttcttttctttttcttttttttttccttttgagacggtgtctcactctgttgcccaggctgtagtgcagtagcacaatcttggctcactgcaacctccgcctcccaggttcaagcgattctcctgcctcagcctcccgagtagctgagattacaggcatgtgccatcacacctggctaatttttgtatttttagtagagacgtcatttcaccatgttggccaggctggtctcgaacgcctgatgtcaggtgatcctcctgcctcggcctcccaaagtgctgggattagaggcgtgagccactgctcccgggcaaccctgtctcttaccaaaaaaaaaaaggggggtggcggggcaatgaagaggtttatcataatgtctcctttgatctgaatcctgaaagagcacttccctatgaattttaacaaaaatatccatgatacctaattagttaatatttgattgttataatagttttatatcctaagttatcaagataatttagttttcttccctctcttattgctgtatcttttgacagtacctgtaaaaatttgtagagacatcaggtggtgcttagtcccacaaagcagataatctgccaaccttgtcttaatattttaatgttattttaatattaatattaaatattttcatagcaagataattataattagtagctcatttgtagtgcctcttttagtgtacaaccattaagcatgtttttgtttggtaaaacttttaggcctcgatgggtggttccagttttgccgaaaggggaattagaagtgcttttagaagctgctattgatcttagtaaaaagggtaagttatatgtttttatgcttcctataatgtatgctactagatgtatttttactttatcccaaaagcggatgaagtggatttgttttcctccatcataaacacatactgcagcttgcaaggaggggctcatatcctttggacattcttaaaggatgtttgtgaactctctgaggtcacataaaatttatatttgtatttctacggagtggattcattgtttcgtcagatttgcaaagaggttgtcactcagaggttaaacatttttaattgagggtcttatctgttatgggaaatactatacaaaagaacattttacaattaagtactctataaatgatggatggtatgatggactccagacatatctgccccctgccctccttgtaattatcttgagtcatttctgtcctcaaaatattactatgtaagtctacaaattatttacacttgacctttgactgctttactgaaatgacagtgaattaggatgtgtggctctttgtactcagtaaaattttacctagtaaaatcttcattcataatccttcaggtaaaaattaccatttcattaatattgtacttctgaaataaactgtctcgcttacatatttgtaagatagggtcttgctttgtcacccaggctggagtgtggcgatgtgatcatggctcactgcagtctctacctcctatgttcaagcaatcattctgcctcagcctcttgagtgggatacaggcatgcgccaccatgcccactaatttttttttttttttttttttttttgagatggaatttcactcttgttgcccaggctggagtgcagtggcgtgatcttggctcactgcaacctccacctccccggttcaagcgattctcctgcctcagcctcccgagtagctgggattacaggcgcccaccaccatgcccggctaatttttgtattcttagtaaagacggggtttcaccatgttggccaggctagtctcgaactcctgacctcaggtgatccacccgccttggcctcccaaagtgctgggattataggcatgagccaccgcgcccagctaatcttttttctttctttctttcttttttttttgtagagacagactggttccccaggctggtcttgaactcctgggttcaagtgatcctcccaccttggccttccaaagtgctgggattgcaggcgtgagctactgtacccagcctatttttttttttttattaatacacaggaaaggtgtgatttttctcttaaagaatcggaagatgaagtctcagtttttgtttaaccagcaaaaggaaatctggtgtttttactcagttgtccagaaaaaaagcttaatgctggaattaatcttttttttcccccaatgactttggtctactttaggtgcagttgaattatctaacagaggactaccattgtaataactttcaattcattttttaagatattgcagattaaaaagcagtaacatttcattttctgaaataggatagctatggatgtgttataactaacagtaggcactatcacaattgaaactgattattgtcaaaattaacatgtttagtactttaagttcaactccatggcaagggaaagtttgatttatcttttaataattcccctcttttgtttaaagaacgtgtccttatgcctcattaatcttgtagaaataatatcccaaagtgaaaatacaatacgcggacaggttacagttgttttcaccactcagaattttttgttcttttatacgttcactaattcatcaaaattttttaaagaaaatatctttttttattttaaaaatgttgaatttttatgggtatatagtaggtgtatatattttggggtaatgagatattttgatacaggcatacaatgcgtaataatcacatcagggtagatagagtatccattacctcaagcatttatcctttgtgtttcaaacaatccagttttactctcttagttattttaaaatgtacaattaaattattttttactgtactcaccgttttgtgctatcaagtaactaggtcttattctaatttttgtacccattaaccatcccgctattctttacgtccgtgagttcaattgtttgatttttagatcctgcaaatgagtgagcacatgtgatgtttgtctttctgtgcttggcttatttcacttaccatggtgaccttttgttccatccatgttgttggaaatgacaggatctcatttgtttttaatggctaaataatactccattgtgtatatgtaccacatttcctttatccatttatcagttaacacgtaagttggttcaaaatcttggctattgtgaacagtgctgcatcaaacatagtagtgcagatatcgcttcaatatactgattttctttcttttgggcatatcagcaaattttggaagacttctttgctaagcatgttctaagtcctgactgtaaaatgatggataaacactgattaatggtatttcatttaatagcattgacattcagtggacatgtattcctccctccaccatattttttttctgagaccacggttattttcaacaagttccaaatttttaaaagtttaaattaccatctcttttgtactatcaatcaaataatactttctgtacaaattgaatagtttttatttggtcattaagagttacagattttctttgtttggaagcacattgctctgttgcctttctaaaatgaggtgaaattaagcaaagatataaagaaacagagacactgagataattgagagaggctaataaggaagacaagacataattcattttatttgatcaaacacagaatagtataaggatattgatgctaaatgaatgatttatgaacaaaataagattttaaaaattgggaaatgcttttaaggtcaaagacttattttcagggagcaaaatactatttaaatttgcctcttcttgtggtgctgctgatcaccattttgtgtttaaggctagtgccataatttgtaacattttcagttagtgttaatattactcggttaatctacttttatgcaattaaatatttgttagctgtcggtgaagtttccagttatttattaccttttattgtatattggacaatgtaaaaacaaccagatgaacattttgtttgcattaatttttctccctttttcttaggccttgatgttaaaagtgaagcatgtcagcgatttttccgtgatgggctaacaatatcattcactaaaattcttacagatgaagcagtgagtggctggaagtttgaaattcatgtgagtcttgcatttgactttaaaggatcagatttacatagtgatgcctgtgagtgggaagaggtatatgtgtgtgtggctgtgttatatttattctgttataattgaattaaaaggtctaaaaatgaaaaacttaaaaatgtttataaattaagtctcttgaaggccgcatggtcatttagaataagcatgagatttagagttaagcttgggtttaatctctcctctgggatctcaagtgtctgtgaccttaggcaagtcatcacatttcattgaaaatgtaatgctatcaattgtaaggtacatcactgttttatggactattaaggaagaaaaacacccaagatggggcatttcatatacgtctgggacaccaaagggtcagtatagaggtaaatgagaaatgaacttgctatgcagaaagggacagcaaaaaatcctgcatatctcaaccttggcacttggtggagggagggattaaaaaaaaaagtgaaaatctaaaccacaagccagtatttaaacagtttcgtagtctgaattcaaattatagttgcaatacaaaaagcccttaagtggaaaatgtaaagtggtctcatgtcggtagtgcccccaagtgactagcagaagcaaacacaattcctctctgcaaataccttccatttaggaaaacagtaatgtattgttcattgattataagatagagtcagattccagagatcttaaaaagtgaaaaaagtatatgtctcagactgataaaatgccataactactctaagtctctgttgcttttgttttttgtgtgtccccccgcaagacggagtctcactctgtctcccaggctggagtgtagtggtgcgatctcagctcactgcaacctccgcctcccaggttgaagtgattcttctgcctcagcctcccgagtagctgggactacaggcgtgcgccaccacgcctggctaatttttgtatttttaggagagatggggtttcaccatgttggccaggctggtctcgaactcctgtcctcaagtgatccgcctgcctcagcctcccaaagtgctgggattacaggtgtgagcccccatgcccggcctctgttcttttgtatactatggaaatggtcataagttgtcaagcagataatatttttgtggcctataacctatttcccaaatatgaccatagcataaaaattccacattttctgatttaacatgtaattgtataggtgtagaaatggaaactttggaagtggcgtcagacttctgcatttgacatttagctagcaaatttatcttggatgattgacatattgtttattttatttatttttattttttgagacagagtcttgctctgttgcccaggctggagtgcagtggcgccatcttggcttccttggagcctctgcctcctgggttcgagctattctcatgcctcagcctcccgagtagctgggactacaggcacatgccagcacacgtggctaatttttgtatttttagtagagacagggtttcaccctgttggccaggctgatctcaaactcctggcctcaagtgatccgctttcctcagcctcccaaagtgttgggattaacaggcgtgagccactgtgctcagcctgacatactgtttagactctagaattgctgcctctcgtgtacaaattccacagagaaaaaatagtaacttgcatcttacctgtggacgtagagcaggaatagatatcttatggtgcctcttgtattttttaagccatagcaaatggcttttgaaagtaccatataaattatgaagtaaacaaattctaatttgtcctttgataatcagtttgatcccaatattaatgattagaaaaatggagagatcgttatttgttaggatacgattaatattggaagatatttctgtttgaaattgcagtgttttgatcttgtaaatcgcctttcccccttgtataacagaggtgtattattaacaatactcatcgtctggtggagctatgtgtggccaagttgtcccaagactggtttccacttttagaacttcttgccatggccttaaatcctcattgcaaattccatatctacaatggtacacgtccatgtgaatcagtttcctcaagtgttcagttgcctgaagatgaactctttgctcgttctccagatcctcgatcaccaaaggtgtgttggtttgttattttcaaaattaaataatacaattgttttgttctgacacagaatcttcagtgatctgtatttaaagtgtgacaatgaaataacactttaaatgaaaatacacacaaccaggagcctttttcgtagctttgtcgttctagttctttgttttttctgcatgtataattatccccattgtcttctgtccagcctctttagaagtagtcataatttgggttagtaggaaacagactgtattttttctttgaaatagagtaggagattacttctttgaccaaggactcaattgttgttctgtagggccgtgatcattttaggcattctaagattttgactccaaaatcaagtatatcctctaaatacctaataatacatcataaaattacagaaattgttaatgaaatcaatatagtaaatcttccaaatctcacttaaatatattgtgtacataaatgtaagttttctatattggtgtaaacagactgtacactttaaaaaatttttccctaaacgctgcttcttttaataaatattatataattttaaaattttagattttagggagacatttttaatattataggtcttgtacaaatttccctttttctatccagccagaaagattttaagtcatacattatggagaacttggtttattttactaataagctgaagttatcaaaaaaaggtcaaacttaagttgagattttctgatatttcctagttcatatagttgccactagatggcttatttttgcttgagtagatcaggttactatctaaataatggcagtcttcaaaatgaaaattttaatctatacctgtatttctttttaaattttactttttttttttctctatgtgccagtaatccacaacttaagagattcacagggcacaaaacttgatttaacatggctaaatgtaaaatttttagatgacttctggttgaagatagttttatatctttgaaatatagttcttgctattaaacttataaagtgtagcgattgtgagagtgttagcctttcaaagccttcaagagtacaatttttaaaaatatagcccaaaatatagttgcgaatcaaggagaagcatattctatggagttaccttcacatttacttgctattgaagtaagagaaattttatcatacagctaaacaggtcttctataagcttttaaaaatctgattaaaaggggacatgtttggcagcatcttcaaccatgtcctagttgaatgcagatgtcatgatataatgaaaaatctaagagatatgtaatagcctccatatgtttttttctcctgttctccaaaagtggtagtggcaaaattcagatcatcagacttagtcgatggagataaactttctaagctgtagattcactttcggatactgtttgtaatgagtttcatttacctttgagaaatttgagttacagagcttaaaagtgttttattcggaatatttttgagccttaatacttaatcattctctggagcttttggtaggtcttctgttctacttcaaattctctctacacctcctaccctcctgggacattgaacctctgtggcctcaacttttgacccatgacaaagctaaagctgtcaggactatctctcagagtgtttcctaatccccatcttcccccaagatgtttgaagatgtttaaatgagatcatttattcaaacatttaaaatataataaaaacttcattggttacgacaaaaggtcttaggtgaaattcaccatgctatctttgagaaaaggaacttgtagcaatagaaaactatgtggaaagcatatggtgaattgtaagctatgtggtcattttgaattttctatttagggcgactgatctttctctgccagtcttgaaaacttagagccagagaaggaaagctgttgttggcagctgctgaagctagcctattagcctcagtttgaagcactcttatctgaatattcccaattgtttaagcatacattgcagccaaagaaatacagaaagattagctttagactaattctttactgtgtccacacctgctgttttataaatattgtatgtaactatcaagtatatcaatctaatagtctcattatagttactgaagaaataaaatatattacataatgagcatgtactttcttacaattgctgaatgacaaaagggatctggtgaattaagtactcgagttttaatggttttgaattagcctttcatgactaaaaaggtaggaaaacactattaaattgaaatacgttaatgggtttattagagaaacttagttcattcatattcttttaaaaccatataaaaactagcagtaggccaggcaaggtggctcacgcctgtaatcctagcactttgggaggccaagacgggtggatcacctgaagtcaggagttcaagaccagcttggccaacatggtgaaaccccatctctactaaaaatacaaaaattagccgggtgtggtggtgtgtgcctataatcacagctacttgagaggctgaagcaggagaatcctgcttgaaccctggaggcagaggttgcagtgagccgataatcacaccattgcactctgggcgacgagagtaaaactccatctcaaaacaaaaaaacacacagaaaaaactagcattagctatcatattttctctttaaacaaacattgaacatacagccatttagcatctttactttttcctgtattttttttttaaatagctgtagaaattatttttgcttaaggcttagaagagaaattgtgtattttgctccttgttttccagtggcttctaaaacatggcctaaattttagaaggtggcaaggtgtgaaaggttttcttaggtacattaatttctacatatatttgattcttatatttatatagccttttaattcattttaggtttttacatacagacaggcttttagcctcacaactgttgtctgtgccagctgtatggtactttgagctacagctctttcttagacagttcatcctgttgcatggtgttacttctaagataaggagaactgggtgcaatttgtataagcaaaagtatcaaccagcatattctacttaggaacagtagatactagtaccagaccttagtttttaattgacaattgactctcaggctattagttactgtgtttatagggaaattttaatgttttacaactaaacaagaagtagattcaaaattcattaccaagtagcttcttcttaactctcttgaagtctttctgcctcctgaaaattattttaatataaaagactttacagtaattagaaggtattcattcttatatggtgggatatctgaaataggagcatgtcttctaattcctgttcaccacttacattggtacagacagacagaactatgccccagtgatttaatctatacttactacgtatactgcttctgtctcacagatggaattactatgaacaaaatgcaatgttttgtggtcctttgaaagatgatttattttattgaatttactatttctagtatatttcaataaggcttttttttcgtgctttttaccctttaaagtaggaagttaacttttttcattaattgtgttacagggttggctagtggatcttctcaacaaatttggcactttaaatgggttccagattttgcatgatcgttttattaatggatcagcattaaacgttcaaataattgcagcccttattaagtaagttacatttaaaaatcaatggttagtgcaccgtagaattgctggtttttgcttcataaaaattgagtttttcaagtgtggtttcttcaactaataactgggattttttaaaagtaatataaagaatttagtcctaaattgattttaagaaattgcgtatttacaggagttttgtatctttcttatttcagaccatttgggcaatgctatgagtttctcactcttcatacagtgaaaaagtactttcttccaataatagaaatggttccacagtttttagaaaacttaactgatgaagaactgaaaaaagaagcaaagaatgaagccaaaaatgatgctctttcaatgattattaaatctttgaagaatttagcttcaagggttccaggacaagaagaaactgttaaaaacttagaaatatttaggttaaaaatgatacttaggtaagatacttacctcttgaaataattgttaatgccgattttagaatcatacttatcactgaatttttcttacagattattgcaaatttcttctttcaatggaaagatgaatgcactgaatgaagttaataaggtgatatctagtgtatcatactatactcatcgacatggtaatcctgaggaggaagagtggctcacagctgaacgaatggcagtgagtctttcagttcttcttcataggaataagaatctacttaagacaagaaattagaatagctctagctaaaaaaattagtaatagtaacattttaaagtaaactgaaattgggaggtgttttgattgatttataactctgttaatcctgagaactttttgaaataacatagtttattatttggtagtgatatgggtagctttaaaacatctttgataaacttagtgatgaatgtggcgttttgaagtaattattagtttgttggagagtgggaagttggttgaaatggagtaggtagagttgatctagaaaatggattgggtagtatctagtaccttataaagtggcctattgttcatttgaccatttacagttaaacgttttaaaacaggaaataaaattactagaataagatctatacaaattgttttatcacgattttgagaattttattttgaaagcccttattttgacattgaaattttatgaaactttatgtaccatagctattttgtattatattgttttgaaatgagtaagtatgccatttaagttacagtgccaatattttttgaatgtatatgtgtaacagtcctggggaaacatctgtaggagaactgtccttgccctcaaggagccctcacttaataggggagttagtgattagagtatgttaaaatgcatgtggagactgcttagatattgccctgtgttagggggtcaggtggtagacatctggtttcatacatatgatgtacgtatctgcctcatggaaagtccagcacagagctattcaaagtgtgctctgaagactggtgctggttcttgaaccagtcctagataggacagagaatggcattaagtgtttagaaactttcattgcagtttgacattgcgacatttttattgtgttttacaaaattatctgtggctctgcagtggctcacgcatgtaatcccagcactttgggaggccgaggagagattgcttgaggccaggagtttaagaccagcctgggcaacaaagcgagaccctgtctccatattaaaaacatatgtgtatatatgtagaataacataaaaacaaatatctgcaacagattagacattaaaaactggctcattatcagctgagacatgtacttctctagcacattttgggcctaactactttttattctcagctaaatactgcaaaatcatatagtgtggattactccctgtttgtatcatgagttagcactttattctgttgctatagattaaatgaatgctagttgagcaagctagcacagtgttacagaaaaacagactgtggaagcatatgacttgattcatattccaattctagcatctgtgagcctgtttacattttgtaatagaataatgtatctcttactaggattgtttggaaaattaaagagataatggataagcaataatagtgcctagcacatgataattgttaataaataaaagtaaaaaatagagagcctttttacccaaggtcaaaacataattctgtggcaaaattgggataaagaatccaaagatcctaaaattggtcctgtactcaccctaccatggtgattgtgtacttaaataatatttttctgagtaaatgctggagtgtagaatcttcttaatttcagtattatttatgggagcatttctgtatgtgcaaaattgttataaaatttcataattttccattaaagcaacacataagtatattttaccagtattatattttgtaaatgtgttttgaatttccttatattatttaataatagtgtgagcaattaagaaaaaattgttttaatttctgctttcaaacacgtttttgaattaacatttaggaatggatacagcagaacaatatcttatccatagtgttgcgagatagtcttcatcagccacagtatgtagaaaagttagagaagattcttcgttttgtcatcaaagaaaaagctctgaccttacaggatcttgataatatctgggcagcacaggtaaggaatttaagatgatggctatttagtttttaaaataaagatactaaaaactgaagaaatacagtagctgtcatgaaatggatgcaggcttgtattgtttgactttgagaacgtttaaatgcttgttaccctgccaggaatctttttgaaataaccaataatcttttaaaaataaaaatattcttttatctgtatttgataaaggttgagaatttgtcagtggttttaaataaagatgcaaacagtaaaatcataaggaatgtctattgaaagagagtaaagacatctgtaattggtttcttcatagatttaatagaaagcaaaaacctccagtgtcaggagaattaattcacttgattatttataaagacctgtaataattattccagagaatttataactcttcagaaggattagtaacctttttagtttttgagttggaaactacaactccttctattatcttaatgacagttttctaatcgtggatttcttgggaagcattattgagttgtagattataaagctttgtttttttagtctataaaaaccaagaaaacagctttgcctttgagtgcttaaggttccagttttgaaacaatattgttagtgtgccttatttttgtatttgcaatattaaaattgtcaaattaaataaattgtattaaaggtttgtatgaaccgccaaaatacacattagctgtatttattatatcatgaaattaagttgccaggttttagatggcagttctaaagcattttataatgttagaatttttttttttttttttgagatggagttttgttctgttgcccaggctggagtacagtggctcgataccggctcactgcaaccttggcctcctgggttcaagtgattctcctgcctcagcctcccgagtaggtgggattataggcatttgccactgtgcgggctgtgttaggaattttcttgtgttacatagttaaatgaaggagataggagtactttattaattgtcagcaagcagtatacactacttaatctattactcagattcttgtgcattgtgatttcgtttttgtttttcaataggcagggaaacatgaagccattgtgaagaatgtacatgatctcctggcaaaattggcatgggatttttctcctgaacaacttgatcatctttttgattgttttaaggtaattgttaacatagcaaaatattaccattctatttcaaatagaattgattaattagatctgtgaattacttttagccaataaatacttaaatagaaatcccattaaacagtctgtggtgtgaaggaattggcccattgttttcttttccaacaagaacttgatgttcattttcttaatagcccccataatggaaactcaggctatcactttttctttctttcccctggtagtttctattttagttacaggttcaagcaaattgtaggactacagggaaggatgattggctacaataaacagtaagatgaaagcaagagaataccaatatcttggtattctggggtcatatgtacaagcaaaatatgagttaatcaaaatgtaactgataaggtagcccaagaactcctcctacagtcatatctgcattgatgccatcatgttggtttttgaggccatgttttgtaacatctttgattagttgccagggttaggtttgtgaaagctcaagtggttagtgaatttgtggattaagaacgtaactttttggcagtttgcactaagaggtgttctgttaacaactggcattagatcaataggtcaccaacgtttcttgttaaaaataataattatactgaccagtgggaacataaattgctatagccactttggaaaatacttggtatttctggtaaagtttaagattctcataactcatcagtttgacttctgaatatacacttgagaaactcatgcttatgtacaccaggatacgtgttcagcaacacttgttagcagaattacttgtaatagtgaaaaaacctgctatgtaggatagataaaacatagaatagataaattatggaatgttcatacagtgcaatatttcacggcaatgaaagagcaactcaaccatatggatgagtctaataaacagaaggttgaagaaaggaataaagccacacagtaattaatacaccttgattacattaatgtaaagttccgaaatgggcacagctggtttctgggatgttacttgccgtgtattattttttacctgggtactagttacacaggtgttcacattgtgtactgtaataatggtatatgcttgtacttttctagatatttcacagtagaagaaaaaaataccatttttactggcttccatcacagacatgttagatcagtaggtactgaagcccaagagtctgtattttaagcaagtttcacagataagtcttagggacattaaagctttgatttatggaaaaatcgctgccttatggaaaattttattttgaagggaacaaattattgagtgaatcttttatgtggtttttatatattttgtttctatacatgtaaaagcaaaacttaaatactttttccatccattgaagtatatcaaaggcagctgaggaaataatagaattggtcatcatgggcactgcaaagataaagacttccgaaatgatgatacgtgaccagtgatgcctttgatgagagaaggaaaaaaaggggttgttattatatctgctgtatcccccctcttctcaggatagtctaaatacaataatggtctgaatataataataattcttcatgttcttccccctttggcttaacatatgtttattgagcacttgtcatttggtaacaagcacttttttcccaaggtgttggtaaatctggcaattcttatggagtgttgaaagtttctgctaaagatgattttgaaaggaagcaatgaagtctgagtcaccttgtggttctttgcagattgcaaccaaatgattccaaccttctgggttagactttgctttatgtacttggcctagagcctagtttttaaacatttgagttctaagtaagtttcatatctttgccagcacttgttcttgtcagagttctgaatttttgacaatcttcttggtgtttgaaatgttacctcattgtgcttgtgcttttagtttttatatcccttgatcaataatgagattgagtatctttctgtatattttttgagctatttgccttttttttttttttttttttgggtgaatgcctgttccccccctccccccaccgtggcattatttgtatattttttggattgtagttcttgatatattttgaatgctaatctttgtcagttcaagagttacaaataatttctcccaatttggttatctttttcattcacttaatggttgtactggttgaatagatgttcttaatttctccttttcatgtagtttgtatgtctaaaagatgagtacatgaaaaaattcacgataccattatctacctaaaaaacaataattccttaatatcataaaatagttttaaaacttccagttgtcttagatcatacatcttcattttagaagtgagttttaatcaggatcctggtgcagtccatgtgtatgtcttttaagtctctttgaaactagctttcttcttttttacttcccttgcaatttatttgttgaagaaactggattgtttgttgccttggtgtctgtcaatagttttgatacagaaggttttttttttttttaattttactagagcatatctcaagtggtggtgtgcttttccttgaggaggaatacctagttgtctctctttttataatgttagctagaggtttttaattgtaatctgatattttagtcttacatttttagcagttgtcatattccttttgttattttgtgtaggctggaaggaaataaaaacaggcattcacatcatctttgaagacgtaccatattaataattccattgaactaatcttctctcattaacttaatcgttgttttttttttttttttttttggagacagagtctcactctgtcacccagactggagtgcagtggcgcgatcccagctcactgcatcctccacttcctggattcaagcaattctcctgcctcagcctcccaagtagctgggattacaggcatgcgccaccacgcccagctaattttgtatatttagtagagatggggtttcaccatgttagccaggctgatcttgaactcccgacctcaggtaatctacctgcctgggtctcccaaagtgctgggattataggcgtgagccaccgtgcccggtcagcttaatcgttcttctgctgtttgacgttaagttcgtttcagtttattttctaataaacactgatcagcaacttagtgcatttgctgctgctataacagaacaccacagactgggtaatttataaagaacagaattttatttggcttatgattctggaggttgggaagtacaagaggcatggtgccagcttaaccgtgagttttgggggggacattcgaaccatagcagtaactttactcataaaacttttcccatattgcttagcagcatccctggtctctactcactaaatgccattagtaccctgcccttccccaagcatgataaccatgttgtattacaataccattttagaggttttaaaaaaatgtattttagagtttttaattgggtgtcttctaaattgaaatagtgtatcatttatttttcttttttggaatttaactctaccctataaaaaaaataccaggctaactatattttcagatctcacttgaatcattctgtgcttagctacgttgcttttgatgaatttgaatatagttaacctggtgacaatttatgaagtggtgactaaatatgtgttgttttcatgtcacttaatttttttctaggccagttggacaaatgcgagtaaaaagcaacgtgaaaagctacttgagctgatacgtcgtcttgcagaagatgataaagatggtgtgatggcacacaaagtgttgaaccttctgtggaatctggctcacagtgatgatgtgcctgtagatatcatggacctggctctcagtgcccacataaaaatactagattacagttgctcccaggtaagagtgtactgctttgctcactttttgtgacttttccccttcagttaggttggcttagttacaggatagttctgttactctgacattgttagtttttaaatgatcttccggagttgactttttttgttcattagtctgctttccttaggatctgtacatcaaggttttgtgactcatctgaaaagcattttagtctccttgggagaaagtataaacagaacagattatacagtggtggcattatcaagtgtatggttctgaaatgccgtttcgaatagaattcgaatgttaaagctgatagggacttcagagggaagagaaattaggttttctttgctcatagggaagttaagaaaaattaatagaatttcctaaccattaaaacatttagtgcctccacagtgagcaaatcacacagtttccctacattctaatttgtggcatgtgtattttttaacacatggtaaagtgaacattgctgagtaatttctcacatgttaataaaactatttgttacactgatgaactggtatttaggtaagagccaagaaaagctcaggaaggtgtattaatgtagatactactcaggttttgactatgtttacttgtgacagttcggtaagtatttattcagcaaattaaatagtaataagggccttgagtataaattatttcattaaaccaagggtccttctgaggagtcttgaaatcagagcagtacatttgctatcagggcttttaactagtaacttcttttttaaatatctattagtatcagtgcctggcatagtgatgtacacattcattcatgaatagttactgagtttcactgaatttagtagactgttgccttttttcaacttcaactttcatttattgtttgggaaaaaatttttaaaagtcattttccaactgtcaccttttcccttctgcttgccaaaactgttgtcaaagtgtacatttgatcataaatgttttcatggccttaaaaatgtacacactattaaacccaacaattctacttagagaaatttcttctcggaaatagtgaaaaaggatacaaagaggtacccacaaggacattcattagtgtttatggacatgaacatgtggaagcctcctgaataattactttttttttttgagacggagtcttgttctgtcgcccaggctggagtacagtggcgcaatctcggctcactgcaacctccgcctcccaggttcaagcgattctcctgcctcggcctccccagtagctgggattacagacacgtgccaccacacccagctaattgttttgtacttttagtagagactgggtttcaccatgttggccaggctggtctcgaactcctgacctcaagtgatccacccgcctcggcctcccaaagtggtgggattacaggcatgagccacagctcccagctgtgaataattactaatagtttatacaaggttcgattatggcgccattaaaaggattaatatcacttaagagtatgattctaattttgctgccgaaaaaggaatatctgtgtattacaaaataaccccaaacttgaggggtttcaggaaaaaaaaaaaacaaaaaactccacaaaattgttttcctttccctgtacgcaaaagtaaaacaatccgagcttacgaaattgttaggcacacaaacttgcagttctgattactattgactttaggggaagaggtgaagtaactgaggtttgagaagtaaaataccataattgaaataattttgagtttataacatttttaatttttaagtttatatctgcctctgtcctttttctctccttgtacgtgtgtttctttattttgattttggcgattatttttaaatgtagttgtcattctatttattttcttagtcaaatatacattttttgtgttcttcactgtactaaaagatggcccatttagagtaagtcagggtcttgttatatattaattctggattttatgatacggtagaatctcttaaaatactggctaaatacctaccctctggcaaacttggaaaatgaaactttctgtcagtgtgcctaatacttaggatctgtagtgtgtacagatatatttcagtccatataatacaaagcttttataacagtgctgggctttttggagttctggtagtaagtgtgaaataaaaacaaacttaaagcttttattatttaaattaaactctttactgtaattacaacatgatgcttgtattgctaatcttaaaagaaaagcttttattttataattctcaaaataatttgaaaataaaattctcctgagtattgatctatttaaaacattgaaatcatttgtttaaggaccgtgatacacaaaagatccaatggatagatcgctttatagaagaacttcgcacaaatgacaaatgggttattcccgcactgaaacaaattagagaaatttgtagtttgtttggtgaagcgcctcaaaatttgaggtaagactttttaacatagaaaatttcaatacttaaaatttatgtactttattgaaaagaaacagcatattggctggcaaatgcaaatttttaaattagtggagtgagaagaggctatataagaagtgtttggaacaaaagaattctttattacatctacctcctttttttttattaatgaggaagtaagccacagttaagtgataaatcagaatcaaggtaatattgcctttgggttcttggttcagaattattattatatacatactatatttccagcaagtatgccaagaagtttcatagcatgtctttaaagatggattagaccacaagaacatttaaattgatgaaacatgacaagataaagtttcataatttttaaacatttattttagctaaatttctttttaatagctgtctttatactatcttaggtgtcatattctggttactgaaataatttgtcctattttctggtaatacagttggaactgataacatgaaaaggaaaaataatgtgaagagaaagagagcagggtgcagtagaaggaatattcacagtggagtcaggattcctaggtgtgaatcttgtgtcaaaccagtaatttaatcttgtaaaaattctgtaaagaatcatgtttggcctggtgcggtggctcacgcctataatcccagaactttgggaggccgaggagggcggatcacctgaggccaggagttcgagaccagcctggccaacatggcgaaaccccgtctctactgaaaatacaaaaattagccgggcgtggtggcatgcgcctgtagtcccagttactcgggaagctgaggcactagaatcgcttgagcccgggaggcagaggttgcggtgagctgagattgcagcactgcattccagcttgagcaacagagtgagactgtctcaaaacaaaaacaaaacaaaaccaaaaaacatgttttctttatatgtaagattaaatgattgccaggatcctttacagctctagattactatgattatacctcagacagaaatagaaaaggtcatgtatatgtctttatttaaacagttgaactttgtctcacttttttccctaaggctagaaaaaattagcaaattggaaaagctatagagataaacactgtaagaaattgagacatatatctcgttaacaataatatttgaggagcatattttgagtatgtttggctcatcgtacatatttcggcctttctcaaatgaatgcatttatctttcgaagtagacacagtagttcacatactctcccaagaacagtggccttgtctcccctaaaatagtagtagtggatgtgaaagttgattggtttcagtgaaggtagcaaaacagattagggtttcaatgaagatagcaaaacagatgagtctttgtggtgacacctgtgggcaaacttggctacaaacagagtgtcccaggatgttttcttaaatagctaataagaagaaaatgctaagagcattttctttgattgaattcttccttacaactgtagcataatctttgtgatgctagtcttgcaaaaaatgtttctattttataattttgggaataattacataacataagtgctttggtacagttatagtatagacattagtcattgaggtatactcccatttggtgaagttggagaatagtgatggatgctttttgtgtaaaataataatgtaataaatgtcttatcttttgaagagtttaagttggttgtgatattttcattaaaagaagtaaatgtacaaaagtataatttttaagtttttacatcagtagctaagaatttagatagtacgaactcttctggttacaacagagtttaattgcctaattatattgttaagttcttctcgtttcagtcaaactcagcgaagtccccatgtgttttatcgccatgacttaatcaatcaacttcaacacaatcatgccctagttactttggtagcagaaaaccttgcaacttacatggaaagcatgagactatatgctagaggtatgtattgtaagctaaaataaactatgggaaatagcagggacctttttttgcattaattaccttagaaatgtaaatcatgttcctttatggatttaagatccactattactcccaactcttagacatcctaaactctaggccagcagtttaagagtcttcactaagtgcttgccttcccccattctctttgttaaatagatttttgttctctgctttgggagctctgcctgccttttttacgattgatcgctaccttcttaggaatgtacttggctcattttcaacctttatgtcctttaccaccacctttagctttttaaaaggaaacttgttttgtctaagtctgttcttactttatagttcttttataatgccaagcctatgttttgtaagtgcttcaagactccatgaatttaaaaaacataagagtagagatgagaggctggctgtaagaatctagatgtttacattggcattcaaagtgtgaaattgtttgaacatgtttaggataaagtttcctgtgatttcaacagatcctgattgtaagtcttagcctgccatgtgtggagccctgtgtcagtgctcttttgccctttgacagttatgtcagtctgtgtgtgcaagagtagggatggcttctcagtatatactgttcctcttctgtcttatgacaaattcatacccctttccccactgatactttgttgtttcaagtttgtttcccgagcagtatgtaagaaaatactgtattacgaatgttagttatagagttaaacatactgattactcaacttaccattcatttaacatgttatgtaggatctgcagaagcccatagtgtatgttaaaaatgagaatatttataatactcattatttgaggagtaggcttttgacattattgaataaaatcccctcgtgcttaagaattaccagatttttgcttaatacttatgtacatttcccaatgaaattcagataaacataaaaattaagtaactcttctgatactcccagtgatagtgttgactctttattcttccatttatcccctcggggccaatagattgttagagctagacaagcaatctaaatgttaggcagctgatgaggaacagacagtgatcttagcattttagtcttaggttccttctaagcagtgtaatagaatgatcaaggcaatacaaccatgtgatttatgttctataccaaaggtactcaaaatcagtgacataaaaaagaggtttatgtgtagtatacccaagcatttgggtttagtatattatgattataatctcttcctggtggtacacagccctcatggttgccaaggagggccttcccccagagtggagacatataattcatacgtgctttaatgctaatttttatttacttcatttgcatgtggtgtttaatttcattgtcagaggtcaggaacccggctgtctcactagggttttttctgctacattttagtacaattctacttgagttaccgcctcatctcaacttcgttatcacaggaatgattacattcttcagtttttcctccttatgttgtctgtatatctgcaaactgagagatgtgagtctgcatagttgcctaggtctgaaacatgacccaaacatattagctgtatgactgtgggcaggttatttatgctagaataatgtctggcacatagtaaattcccctctgaattttaacatcatacctttttttcctcctaaccttggtaccttttcttcttccaatttattacactactcttgattaatactgatgagtctggagatagttaaatatgggggtgggggcaaataatttttaaaaccagtaaaattcttctattaaactttttacaacgttaaatcacttctgtggtaacatccactaacatttctaaatttgcaattctaaagttaattatggtttttgcctctataataaaagtgatagacaaatcccattagctatgaggcattaggttacttggcatgataacatcaggctttcacagtttactgatattctcaatttctgataaccattttaccaatggtttgtgctgcctgtattttatcttcactagcatctttagcttttgggggaaaaacatttcctcagtaagcatgatcagctgattttacctcctataaacattatttagataaaagaatgaacttagtaaaattctctacagtatttactcatgttctcactacaagtgttttcatacactggtacttaaattattctttaaaagtttttcatatgcatacaatgaagtataaaccaccttttagttttcactcaagttttaactcattggtagaatagtcattctactgacttcaatacttaccgaaagtttaatttaccattttttcttgtttctggatagagttggatgacccaacttcactgtaggtcagatttttccactctgtttacttaggatgctaccttctgttacttcttcccggtcttttccatccaacagtaacagtttttaggaacgttttccacacaaaaagattgctttatgagtgtcattcaccaacagtgctatgttagggtgcagatcctgtgctagattttctcaggactcattccttacatcaactatgaagtactattaagtctgtgtgacttctctgtggtttaaaaataattacatactatccattttgtgaacaatttgtaccttcttggagaaacggctgtttccaggcgtggaacagggaaagtaccacatgatccttgaccatcctattccagaaagtaagaaagtgctcaacgatcatgttgacatgtcaaaaggacacaggagttggctttcactggccataattaggtcaaaattagtaatgaaaataaaatatgaaaatactcatgtagacaaaaatgccaactaacaaatgaagagtatatgatgaaaataaacccaagggggtgaggattttcacgtctggaatggcagaataaaatgttcagcagaccttaacaaaacaaccatttaaccggagaaaaatataaacaatagtcatttagagtacctgaaaattgtcctaagagggagtatagcaaatgggaaaacactcaagaaaatctattaaatctgcaaaacagcaagagtctgtagcatttgagccacagcttgttctgttctcccatgttcagatccagctttcttgtgtggaaactctactccaggcaggtgtgactaagaagcaggggctccttccctgaggctgccagtctagggctgtagtttgaccacatgaggtggtgtgggctactggcatttctgatccttttcagtcgtatgtggcagaagctctgttccaggcagtcatgtccaagaaaactgagactcccttaccccattcagtgcctgcttgtaggataaatgctttacttaaggcatggcaggctgagaatattgggctctgattatccccaacctggcttgctcacagggtggacattatatgtcagggagtgcaatctgaaaaaatcagagtttgatcccacacacccaacaccagcacctgctcttaaggcagggatataattttgggagaagttagctgctgtcctccctctatctcctgaacagtaacatagatgttctgtccagatggagagagaaggtgtgaggatgctgtgctcagcagttgtgcttgaagggaccaactttctttggaccagaccgtgctgtgcctaagggtattatcacaaatggagatttgggtgatgaagaattaggagagtgcttgtggctcccttatactggtatcagcaagtcacaggatgagcaaccagaaatttaacagaaagatctagataaagagatggccaagacaagctctcttgtgatcacagtcaaccctgggggtcaggaatgctacgtgtatgcattaggcttcacctaagcagaaacaatcagaactggacacgggacaaattgaaaacattccccaagcttcatgtcaatccgtcagcaaagggtgaaagcctcaccagtacagtggacttaaatacagctctgaccaaacaaagcattgggtgaataataagctaccccgactcaggggcaactcttaggaagccagacatgaaaattacatgtatccctggcagtctggaagacttgctgcatccttgctggagtgattgagaagggaacaagcaagctgctagtctccgaatgagcataggacaaaaacataaactttctgagtggtgtgatagcagcctccaagccacacagacatgcagtggtaaagggtaaaaatctactagtcaaggaggcttaaacacagcgtttggccaataaggggcttatactgatgcaggggcaactcctaggtaggcaggctaaaggattaaaagaaggaggaaaacatgggggcagagctgtcggaagctgtgcactgtgagggaaatagactatgaagtctatttcccagtcactatatcccatagccatagcccttatttcccatagtcatatttctgtttcccatagtcatagcccagtcactaaacaagcaagcaaacgggtgggggaagggagatcagtattcaggttgttgttgcatatctaacatgtccagattttgatgacaaaaattgaggcatgcaaacaaatgggaagatgggacctgtagactgacgcagagactgcctttgaaggaggccaaatggagggctttgcagacagacttgacagcaaagacttgaattacaaatatgctcatagaactgaagaaaaccatgtctaaagaatttttaaagtatgatgacaatgtctaatctaaattagaggatagtaaagagaaattattttttatttaaaaaatcatgtagagattttgtacttgaaaagtataataaccaaaatgaaatattcataagaggggctaaacaatagatttgagctggcagaagaatgaatcagtgaacctgaagatagattagtagaaattatgcaatctgaagaacacaggaaaagtgaacagaatctcagggaaatattgggtaccatgaaggggaccaacattaattttaatgggaataccagatgaatgagagtgacagaaagagacatagtcactgaaaacgtctctaatttgatggcagacaagaagcttaaaaaagaattgcaaatagggtaaatgcaaagagccccagactgagacacattatagtcagagagaacaattggaaggtggtgagagaaaaacgagtcttcctgcacaaggaaaccccaataaaaattaaccgctgacttctcatcagaaacattgaggccagaaggcagtaggacaacatattcaaagtgctggggttgggggacagacatgacaaccaagaattttacattcagcagcacagtctttaaaatctgaaggcaagctgaagatattcccagataaacaaagactgagagaatttgttgctctaagacttggcttacaagacaccctaaaggaagtaattaggcccaaaacaagtgacatcagacagagtgttccgaatttgcaggaaaaaaatacttgaatactataaaccagcagtccccaacctttttggcactagggactggttttgtggaagacagtttttccacggactggggggtggggggctcacctcctgctgtgcagccccgtttctaacaggccacagacctgacagacatctgtggaatactccatccaacaatagtgaaactactaaaagcacatatcatcttaatagatgcagaaaaagcatttgtccaatccagcctcttttcaatatagaaaggctcaaactaggaatagaagggaacttcctctacctgatcaagactgtcccaaaaaacccacagctaacctcatactaattaatggtaaaaaactggttgctttccccctaggaacaagaatgagacaaagatgtccactccaaccacttctatttaacattctgcttgaggcattagccaggataactaggcaagaaaaagaagtagacaacccaattaagaaatggatgcaaaggatctgaatagaaatttctgcaaagaaggcatacaaatggccaatgagcacttgaaaagatgcttagtattattagttattaggggaatgaaaatcagaaccacagtgagataatgctacttcatacctactagggtgacaaaaaagacaacagtaaatgttgatgaggctatggagaaattggagcattcatatagtccttgtgggattgtagagtggcacccaccttgcaaaatattaatcgtagaatttaccatattacccattcccagttacatacccaagtaaaatgtatacataaatctgtacaacatgaatgaactttgaaaacattatgctaagtgggaaaaagtctgtcagaaaaataccacatattgcatgattcttttttttttttctttttttttgagatgaagtcttgctctgtcgcccaggctggagtgcagtggcgccagctcggcacactgcaacctccgcgtcctgggttcaagtgattatcatgcctcaacctcccgagtacctgggattacaggcacatgccgccattcccggctaattttttttttgtagaaacggtttcgccatgttggccaggctggtctcaaactcctgccctcagatgatcagccctcctcagcctcccaaagtgctggaattacaggcatgagccactgtgctcagccatgattccatttttatatgaaatgcctcagacttaagcagggagaacaaagggagagggtggtttgtacagggtttcttcttggggtgaggaaaaatgtagacttagattgtgatgatgattatacaactgtactaaaaaaattgaattgtatttaaatggatagattttatggtactttatgactcgatgttttttttttaaatgaacttttaaaataagttctaaaatgggccctagaaaacttgctgtttatgatgacaagaaccaatttatgttagtctcagccatgattcactacctcttcctacctattttcatagacatctgagtaatttagtctcatctaattcttcctgctgttttcagcgggatatttgccacctagacaatatgagtcaaaagtggattatcctcctcatttgactgctagctaacaagtccaggtatttgttttgaactgaatatttactactaaactaccaatttatatatatacatatatatatatataaatttgtcttgacagcttggaagcttctctgtagtaagagggcctcttcattcctatttagcataaaggcatcttatttcttgacttttattgattagctgtcagctgaatgtttccaaagttctactctttgtgcagggtcccagttcttcataagtaaagtgttagcacctaaacaaaaaaagggaggtgggttgttagctaaaactagtgggcaaaagtttaacaaaatagttacatagcctcaaagtctctctctacaaattacttattaattacaaagagcaaaatagtacctttacatcagagaaacctgcctcccttctgtgttactcgccacaatgcttagactgatctaattatgacgaagtggcatggaagcccaaattgagtgacatttcaacaaaattgacctccagttttcaaaaaggtcaaagaacacaaaggatgattaattctgcagattaaagaatagaaagtcatgaaaaccaaatgcaatgtatatttaatcttgggctttgtagaaaagatgtaaaaggacgttattgggaaaattgatgaactcgaatatggaccatggattaaatcagtgctcctccgagggggtggaggtggctatttgacagtgtctggagctgtcttaaactggggttgaggggtgggtagaagcctggaatgttactaagtaacctatagtgcagtcctagacagaacagtcctgtacaacgaagattacctggccaaacgtcagtaacggaaaccctgggttagatgatggtagtattttactagtgtagttttcttgttatttggaaatactcattgaagtatttaagggtaaaaggacatatgtccaactcttaaatggtttataaagattatgcacacacgtgtatgtgtgtattttttacatgtgtggcaactaatgaagcaaatggaggaagatgtaaacaattggtgaatacaggtaaagagtataagagaattcttgcctttttttttttttttttttttttttttggtgacggagtctcgttctgttacccaggctggagtgtagtggcacaatcttggctcactgcaacgtccacctcccgagttcaagcaattctcttgcctcagcctccagagtagctgggattacaggcgcctgccaccatgcctaatttttgtatttttagtagagacggggtttcaccatgttggccaagctggtctcgaactcctgacctcaggtaatccgcctgccttgccatcccaaagtgctaggattacaggcgtgagccatggcgccctgcctttttttttttttttttttttttaaagagacaaggtcttgatgttgcccaggctggagtacagtggtgcaatcatagctcactacagccttgaactcctgggctcaaaccatcctctcacttttttttttttgagacagggtcttgctatgttccccaggctggtctcgaactcctggcctgaagcaatactactgcctgggttgggcttcccaaattgctgggattacaggcatgagctaaaacttgattttctttccagtttcttaagaaaacctcttgaagtagtcctttaagtcccaatctctgatgaaatatgcattcctgaaagtagagtgtttatgcctgtttgcatattccaatatatgtggaattagaaagtagtttggtcgtaatatatggggcttttttctttaccaaagcatcaaaaccaaatatgtttccagacattatgaatgtcccatctttataacacatcaggagtttgttcagagaagaaacatcaatgttttgaagaatttgattactgatttccaaaagagcttacataattagaatctttaacaatagcttgcacataccatagggtctgggatctgatatggaaatatagtaattaatgctgaaggaaaatgacacattctggacattaacatggtaatggtgacaattgtatgataacttggtcatgtagagtagcatcttgtgttaccctcacttcttaggtgtaaattagtaatatttatttttataccaaaataattttttcttcatgaaaacacctttcaatataacaggtaagaaattgaagaaaaaaattttgtcttccttatcagttcatagaccacttaggtcagtcttaggctgcaatcatgaattgcttcattgtgtgtgaaggttgcacgaaggggttgtgctgaataattatttttgatagcatatttaacagattattttgttttggttatgtaacaggaacgtatttttgtggggaaaacaggagatggatagaaaccaccaactggtagaatttaggttgccttttaatgataaaggattagtgacattttaactggcctaatttctttggttgaagtcaaagcagtgatttgggttatccatgtgtataatgcatggttttttcttaatttgcagaccatgaagattatgacccacaaactgtgaggctgggaagtagatatagtcatgttcaagaagttcaagaacggcttaacttccttaggtttgttttatacagttagtgttgctctctttaagaaaaagataaggaatacagaatgaatagactgtatagcttggtctttgttgggtggccttttcccaagtccccaagtcatgtaagacatttccctgtatttgttactaaatactttaaaatgattcgctgagttttaactttgttgcaatattttaagagaacacattttaacctttagaattgacttcgttcttcatatctgtttatgctggaaataatgtttatttttaaagggcaaattcccatattttgacacaaccggaaggaggactatactgacttaatgatatcatagacactaaggaaacgggggcaaaaggctgctagaccagcacctcaaaagagtggttggagtcctctggtatcttgtttattctaacagtggctgacaggcaatctaaagtcatgtgttaataatatcatttctgattggcttgaggggaaaaggtttattaagataaaatgtagtctagggctggattttctctgcaatatttagcgtttggtgatcatacacttaacagatgtgcaaagtgcctttgttaaaaattttgatggtcaggcacggtggctcacacctgtaatcccaacacttggggaggccaaggcaagtggatggtttgagcccaggagttcaagaccagcctgggcagcatggcgaaatcccatctctaaaaaaaaatacaaaaatcagccaggcatggtggtgttcacctgtagtcccgggtactcgggaggctggggtgggaggatcacttcaacctcggaggcggaggttgcagtgagctgtgattgcaccactgcactccagaccctgtctcaaaaaaaaaaaaaaaattttttttttaaatgagaggttccttttgaattcaaaaaaccacatgtagcaaaagagcttgtttagattacaagtgtgctaacagaaatgcccagattatcactgcttcttgaagtctattttatttatttatcttatttttttgagacggagtctcactctgtcgccaggctgaagtgcagtggtgagatctcagctcactgcaacctccacctcccaggtacaattctcctgcctcagcctcccaagtaactgggactacaggcatgcgccaccacgcccagctaatttttgtgtttttagaagagacggggtttcaccatgttggccaggatggtctctatctcttgacctcgtgatctgcccgcctcggtcccccaaagtgctggtattaaggtgtaagccaccgtgcctggccccatttattttaataacatattctgggtagttttgtcctgggctgtgttaattatggatttctatttattgaactctgtgcttatttatggagaaaattttaagtagctatataatgattttgaggaaaaacctctaccaaattttaagaaatttggcatttgtttaaagtgcattgtttttttttttcctgtgtgttttgtttttaaccacctggatagaaggacttgcctcctccccacattgagagttactgccatagtaagcagtcgttactgattggcatgtgttatatgtctcttaggtttactagaacagaaaagtggtttcaagcctttttgccattttaaagtttggaatcagaggaactattgtagtttctactctgttagtacctctgtatgtgagctaatagcaactaactcaaggaagaggaacctgactttaatgcctgctgtgtgttgggcctgtgccagacactttatatttactccgaagcaacacagtgcagcaggtgttactcccatctgatcagtaagaaacccaagattccaatggcttaaggtagcttgtttgaaatatcacagccagtatacgatggaattgcactactcaactaggtctcttttacttaagtctgtgctcttcctattagaccggtagtttttcaaacttacgtaggagctttagggcttctgagttaagttccttgaagatttctgaacaagcagtaggaagtttcccgatttttcctttctttttcctctcccaacaactggtgcagctctactttttaaaatatatatcagattccaaatgggattttcatttgaagaagggtctatgccatctttagaaaaaaacaaaaaaatggaaaacctttgaaaagttaagcagttttaactcataaatattgatggattagttatttgtgaaagtcacttgattgaatacctcatttttcaatgatgccatataagcaggctgctaagtcttttttctggttgttgttgttggagacagggtctcacccaggattctctacttaaatatgactgttgttaattgagtgctacaattaaattagccattgccatctttaattggagtgcagcggcacagtcttggctcactgcaacctccgcctcccgggttcaattgattctcatgcctcagtttccccagtagctgggactacagacatgagccaccacacccggctaatttttatatttttagtcaagatggggttttgccatgttggccaggctggtcacaaactcctgacctcaggtgatccgcccacctcagcctcccaaagtgctggcattacaggcgtgagttactgtgcccagcctaagtcttttatttttaactcaagctactaaacatgcttctttccaaaagtctggtttcaaaaactaaaggttcatggaatgaatcttttattcctaattcagctagctgcatttcaggcacaaagtgggtgttcagtgtgtgcttgttgaattaattaatatctagtggggatttttttttagtaccagataaaagtagagaaataggttattttgaaagaatgaatatctttttatctatagttaaaatataatggtgataaatgtattttataggtaatacagattgcctttccggataaaaattacataaatctaattgccaattttcaatgttttttcaagatttttattgaaggatggtcagctgtggctatgtgctcctcaggcaaaacaaatatggaaatgcttagctgagaatgcagtttacctttgtgatcgtgaagcctgttttaagtggtattccaagttgatgggggatgaaccagacttagatcctgatattaataaggacttctttgaaagtaatgtgcttcagcttgatccttctctgttaactgaaaatggaatgaagtgttttgagcgattcttcaaagctgtgaattgtcgagaaggaaaactagtagcaaaaaggagagcctatatgatggatgacttggagttaataggattagattacctttggagggtaagtcaaaagtaggaactctgtaaatggtgtctgatgtactttttcatgtacgtaaggaattgtaattttgcatataaattgtgtattttactctgatgtttgtctcaggaatttggtgtagttaggaattgttcatttttattatgtcacctgtcagtgggctttttcttctctcttcctctccctcctcctgccactgatgttccttttgtcttagcttagtatctgtgtattccatagatgtgcactaaacatacaaatctttcattcctcccccgtggatattaatgttccttcccgagttttcattcagtgtcgatctgtttcctcctcttcaatgtttaacactaaaatagaggacagaagagaggacttgtgtttagtatagattatgagtatatgctttattggcactgtttaccttgtgatatttttaaatacctgggggaataaaatactatctttttaaggctaatctatttttatagtactactctattatgcctatctttaatctgacctgttatacagcagtttatattgtttggatgtctcacatattttcctgcaaaccatagataaagatgtttattgtggcatttgagtatttaaaagcttttaattaagtatgtggttttcaacattgttttaacagcagaaacacatcttaaaactcaaaatttgcaccacactacaaaagtaaactgaattgaacaaggaaaatatgttttcttacttggtctccccatgcttatcccctttcccctccccaacccttttataggggccaacactgaaacacttcctcaaagtcccctagggttctgaacatagtttggaaaccactaatgtaattagatgagtgataaagatttatagaaactgggggtagagtagtcctttatgctaaactgtgtttcatgtaatctcttatttcctgtcaactaatttgaatttcttcttgagtgtctcacttggttatcaagatattaaattatagggttaaataatagtggtcaaagcgtattttatttttacaaaaatgtacctttcattcttaaattattcagagactttcattttgcatttattaccctttcttttggtctgtgcttctcacttaattttacttgattatcaaagtcaacttaccattaaatcattgaatagtgtgtttaagataactgaggatatggtttgaatttaaatgcccaacaaaaatatatgttgaaagggatgaatacttttatcattttgaaaccaggtcgtgattcagagtaatgatgatattgccagcagagctatagatctcctcaaagagatatacacgaaccttggtccaagactacaagtcaatcaggtgaggattgatgtgcattaaaacttccatatataattctttcggcccccatttctcttatacaaaagagaaaaaatattatctaaatgaatcttgccttgttagttgtcttgaagtgattgggttatttttaatataactatttattagatgttgaaatggcaaagaaagtctatgtgaattcattttgatgctaacacctaatcctgaagttcacttttgactaatttatgtttgttaacttatgtaatgctagcttccttttaataaacatacattttattattgtatggattctctacttaaatatgactgttgttaattgagtgctacaattaaatcagccattgccatctttaattggattaatatttggtttttacattttaaagcaattttaactgtgtttatttggcctgatatttgtaggtggtgatccatgaagacttcattcagtcttgttttgatcgtctgaaggcttcctatgacacattgtgtgttttggatggtgacaaagacagtgttaattgtgcaagacaggaagctgttcgaatggttcgagtattaactgttttaagggaatatataaatgaatgtgacagtgattatcatgaggaaagaacaattctccctatgtcgaggtttgtgaataactaatctattggtgctaattcttaattatttgatattttcctagccatttggtaaaaggagagcagaaatttttctcgtttgaaaattgttgtctttgcccattaaaaacattttcatttcatctaattttttttaataacctcccccactctcccatctggttttgttttggttttttgggtgaggcattcttaagttgttttctagttttctttttgtctttgacattattactcattaagtgttgcagtggcattttgcagttgaagtgtttttgtttatttgtttattttgagaaaaggtcttattctgtcacccaggctggaatgccgaggtgtaatcatggctcactgcgggctcaagcgacctttccacctcagcctcccaggtagctggggctacaggcacaggctaccacacctggctaattttttttgactttttgtggaggtggggtttcactacattgcccaggctggtttcaaactcctacgctcaagcaaatcctcctgctttggcctcccaaagtgctgggattataggcgtgagctacagtgcctggcctgtaaagagctcttaaaagctgccttgcatggcatataacaaatattttcaaatggtgtttatagttttgggatgttttgtgtagtcaatgccatcattttttttaaagagttttgtttattaatcatgaaattatatacagttgcttcttgaatatgatttttattttgtattttactttaaaaaaggtactataccaatataaatagcattttggagtgaattttgatatgaaggcttttttccagaaaaaaaataaagtgcattgtggcatttttgttgatgcttttaacaaaatgtaaaacgaccttttaaatgtaaaaggtaaactctaccttctttttttgaatttttttttttattaatacaaggtctacctatgttgtcgaggctggtcttgaactcctgggctcaagggatcttctttgcttggcctcccaaagtggtaggattacaggcatgagccactgcgtccagccaaccttttacatttaaaaatagtcttagtgagttgggcttttacagcataaaaataagcgttatatcttggatttaatttcattttagtagacacctcattttctgcaaccatagatacaagactaacaacaatagaatatgattatgtttttaaatattatttatatttttagttaaaaggagcaatatttttttttcttttgcatttcactcttgttgcccaggctggagtgcagtggtgcagtctcggatcactgcaacctttgcctcccaggttcaagcgattctccagcctcagcctcccaagtagctgggattacaggcgcccaccaccaagcctggcttattttctgtatttttagtagagatggagttttaccatgttggccaggctgatctcgaactactgacctcaagtgatccacccgcctcggcctcccaaagtgctgggattataggcatgaggcaccatgcctggccttattttcaagatactgaaagtaatacaggttgagtatccctaatccaagaaatccaaaatttgtctggtcccagacatttcatataagggattctcaagctgtattaagtatctttaattcacatcctcttgtttaataagaaaatacttagtgttaaatccccagcattattttcttggcaacaaaatttcagagtctgctgaatatgatgatgtctgtctttctttttccccccagagcattccgcggtaaacacctctcttttgtagttcgatttccaaaccagggcagacaggttgatgacttggaggtatggtctcatacaaatgatacaattggttcagtacgacgatgtattctcaatcgtattaaagccaacgtagcccatacaaaaattgagctctttgtgggcggtgagctgatagatcctgcagatgatagaaagttgattggacaattaaacttaaaagataaatcggtatgtatgtatagttaacagatttttcaataaaatcaaaccagagactatcgtttaatcagtaaatactaattgagcatttgttatgtttgggactgtgttaggtgttagagttatagcattaaagtatagcatgtagtctttcggattttttggttggtatatcactaagttttgtgttttgtgtaagtatttttccttgtttttgatattaacatagtatataattttcagcttattacagccaaacttacacagataagttccaatatgccttcaagccctgatagctcttctgattcctccactggatctcctggaaaccatggtaatcattacagtgatggtcccaatccagaagtggaaagctgtttgcctggagtggtgagtagatacagttttgaactactgtatgtaaggcatcatgctagggtttttgagaataaagtatatagagtggttctttcttttcttgaggagcttacagtttaatgagacaaaaaaatacagttaaccaccaacttcagaatggatccctctaaaaggtaattgtaacacagttggaatttaaaacataatttccccataggtatagtattgttacttttacataaaattaaccaattagagcttaattataacactattggatgtataaatttagaggaaaacagtcatccctcgtatacgtggagaattggttccaggacctctgcatatacccaaaatgctgcagatgaccctgtgcaaccagatatacaaaaagttagccttccatatacttgggttttgcttgctggaaatactgaattttctgtccacatttgattgggaaaaaagtctgcatgtaaatggacctgtgcagttcaaacttgtgttgttcaagagtcagctgtatcactttctaaaatttataccacaaaacggatagttcttttagaactatatatgagctgggcatggtggctcacacctgtaattccagctactggggaggctgtgaggcaggaggattgcttgagcccaggagttctaggctgcagtgagctgcgattgtgccattatgctctagcctggtcaacagagtgagaccccatctctaaaaatataaataaatgaaaacaagaactatgtaggaaaatacctgtaatctttatcagattgtcagtaacatatagccaaagaaatatttttaagctctcctttcgcccctcccgacagaaattttaatggttacaatagtagcagccactccagtgtcaggaggatttggctctctataacaactggattaagaatttggtagtgggcatggcagccttttgttatgtccagagtctaaattgtatatatgagagaaatggtttaatagaacaggagaggagctatcacaaaaaaatgactggaagtgacttgatgatgtatttgatctgcactattaaggatttgtagggattaaaagatgggaaagtcagactatttcaaagagtagaaatttcataagtaaaagtatagggattaacacagagaaacttacttgggcttttataaaacgggagtaaataatttagaggtaattattttgtgtattttatattctagataatgtcactgcatcccagatacatctcttttctttggcaagttgcagacttaggtagcagcctaaatatgccaccccttagagatggagcaagagtacttatgaaacttatgccgccaggtaagaatttttaaatgatgatcaagtacttgctggacaataaaggagtatattagcaaattctgtttctaaatggaccgtgctttttggtatagactataacaagagttgacagatgacagcccacaagccacatcaagccccctgcttgtttttgtgcatcccaagagctatatttttaagtggctacaaaaaaaaaatctagaagaataatattttgtgatacatgaaaattatatgaagtttaaattttagtgtccatgatcaaaaccaggctcatttgtttacattcagtctacatgactgcttttgtcttaaaatagcaccgcccaggagttgtggcagaggccatatggttcacaagcctaaactgcttaactttcctggccctttacagaaaatgtttgcctatacctggactataatatgggtcatgtgtcatctgcggtattgttccttttttatccttagaaacaaccacttccaacttctcgcttttactttagtatatatatgtaccattatgtctggagtgtcctcatacagctatttctttgttacttacagatatatactgattttctgctgtgtagatgaaaacttaactgttacatacccccacatcctcccagtatttgcttaaatccagattcaacatctacgtttccaagattgtttgaaatatagttctctagatcactgacaacttttatcctggatttaataatttcccttttattttcctgattgtacacctatcacttattcttcccacatacttttttttgagatattttttatctgaatgtgggcaaactatcacgtttgattaatggtttgtgtatagaatcctaggtttgaaaatatattccttctggctggtggcattgctgatgagaagaccaaagtcctcttggtttctattcctttgcatgtgaccttcgtttctggaagttttggttttatccttacgttttgaaatattatgatgtgccttagcgttaagtctgttttgtggtgcgtcacctgtgggcctggagatttcctcagttgagagagatttgtattctttgatagttttctcaccagcattttgcgttttgtgtgtctttgaaatgtctaagtgtgatggtgaatttactagatctgattttaccttttctctcttcccttctctctttaatcttattccacctttggggtggcttctttaaccttttccagctcttctgttggcttttcccctccaaatattctagtgttaaaatttcaagacctttgtctccttagtgatccttttccatatacaggattttgtttttcactaacacattcttgcatttatgttctaatatatgtgtgttcctttaaaacctaatgttcggcaaaattatgcactaaaaatagtagggcttttggggaaaaagtagagttttggcagatcattcaagcctatacaacctaaaaattttttaaatgtattttttggaaatacttacaatcttacagaaaaattagaagtataattcaagaacacttgagagtaatttactggtttttgtagtcccatcgcccaccaaatactttccctacaaacaaggatatttgtctgtataagcaaaattaagccatctataccaggaaattaatgtcgattcattactgccatctacttagcagactctattgagtgttttcagttatctccttcacagcaaaaagatatagttcaaactcagatatagtcagccctccatatacatgggttctggatctatggattcaaccaactgtggattgaaaatgtttgggggaaaaaacattgttgaaagttccaaaaagcaaaacttgaatttgccacatgctgagtactgtgttgaatccacacgaatgaagctatgtgtaagcattgtattaggtgttacctaatacaatgtacagttaggcaccagataatgacgtttcagtcagtgatagaccacatatacaatggtggttctataaaattataataccatatttttactgtaccctttctatgtttaaatacacaaataccattgtgttataattgcctacagtattcagtacagtaacatgcttgtatgggtttatagcctaggagcaataggctataccatatataacctagatatgttgtaggctgtatcatccagatttgttgtaaacacaccctatgatgttcacacaatgatgaaatcacttaatgatgcatttctcagaacatatgcaacacgtgactgtaatctggagataatttatacaggaagatgtgcatcggttgtatacaaattccacatcattttatataaggtatttgagcatccctggattttggtgttgggagggtggatcctgaaaccatccctgcacccccaccccccatggataccggggaataactgtattgcatttagttaatgtatctctttagtttccttctgaaacagttcctcatactgtctttgaccttcatgaccttgactcttaaagattacaggccagttaattatagaatgtccttcagtttagatttgttttatcatgattgtattcaggttatgcgtctttggcagaaataccacagaagcgatgttctgttcttctcaatgcttccagtcagatagtatgtaatttcaatttttcccattactgacgatgatcactgtgatcacttgagttttttccttgcttccccactgtaaaattacccttccctttgaaagtattttgggccaggcacagtgactcatgcctatcatcccatcactttgggaggccgaggtgggcagatcgcttgaggccgggagttcgagaccagcctggccaacatggcataaccccgtctctactaaaaatacaaaaattagccgggcgtgttagtgtgcacctgtaatcccagctacttgggaggctgaggcttggacctgggaggcggaggttgcgttgagccgagatcatgccactgcactccagcctgggcgacagcgagattctgtctgaagaaaaaaaaaagtattttgtgcagaggtactttgaaaatatttatactgttcctcatcagacattttattcattcgtttatatctgtatgaaatcatgatcaaggagttataatctgttactatcatttatcttgatgctgaaatgatctcgtttggccagtgggagtcctttcagactgttctgtgttactttaatatgttcccattattctttcagcacttgtgtgctctttggctcaagatgtttaagattaggtcaagtgtagtggctcacgcctataatcctaacactttgtgagggtgaggcaggaggatcactggagctcaggattcatgaccagcctgggcaacatagccagacttcatttctattaaaaatttcaaaaattagccaggtgtggtgatgcgcacctgtagtcccagctacttgggaggctgaggtgggaggatcacttgagcctgggagatggagactgcattgagctatatgatcaagccactgtactccagcctgggcaacagaacaagacgctgtctcaaaaaaaaaaaaatttaaaaaagttccagattaacatcctgtaccctctctgccccagtcctgaaattggctgtttctccaaggaggcctgtttgatttattttcctggagaatggtgtttagaaaccaagatctggacatttattgcactcattgctatcgatgtattgttgctccctggctctctaagcagttagagctaaggaatgtgtgtatgtgtatccacatttaagtctattactatatatatacacacacacacatgaatatatatatgtgtgtaagtttttacaaaaccatggggtcacacgacttcctcccatcccagcctatcacagtttcattctagttttctccctttctatatttgtaattttttttttttttgagacagagtctcgccctgtcacccaggctggagtgcagtggcgcaatctcggcttactgcaacctccgcctccctggttcaagggattctcctgcctcagcctcccagtagctgggattacaggcgtgagccaccatgcctggccaaactctcttttctgacaatgaaaaacctggcttctgttatcctctcacttattttcctatttaatcagttatctccagaccccccaccctttctttgaacgcagaaggactcttgtctctgaatgttgggtctctaccccagggacactcctcgctctgcttgagttgaatctttatgctgagctctacccacttattgggctccctcctcctccttcatggtctgtaattcccaacataggactacctttaaaacttgcacatagtttaattagagcactcataaaatgataattagtatcctcagagataatttggacagtccaggcaggtacttcagtgtggctgaaggcttcctcaggagatagtaaaaagacacaaaaccagtacagaggaaatgctgacttgacattgctgagatacagtgcaaaagagtggagctctgagatagatgggctaccattaagataggcacagggggaagtagaacctgccaaggtccatgaaagtctagtttaggattgtatctcacaagatgagcccttgatgcaagtattcactttaaattttcctttaaaaagaaacaggcttctgcttacacatctacccagctgagggggctttttgctttgctcattttaatttttttgttgaagattaacagttctgttgttctggctactgttgcctggaagaaatcacacatgaacaaactcaccttctgcattatactgacatcattatatttgccaattgattgtgagctaattggggttatagaaacgtgctatagcataacagactgtaattatttctctctaggctattactgatggatattatgttttcttctttttccagcatcatcttttactgtccttgagttttttaactagctttttatattaaaataatttcaaactgtttacaaagaatacagttggctcccaaattcagtaattaacagtttgccgtagtgatggcaaaagtttcctaacatttggagaacaagttgtagacaatcatctttttcttcctaaatagcttagtatatgtcttctaaaaacaagaatgttctcacttacattaacatagtattattcaaaataaaaaaaatttagcatatacagtaatatcatctaatctgcagaccattttcatattttgacactttcctcagtattggactttataacaatgttttctggttgaggatctaaatccaggttcatacattgcataattattcggtatctctttcagttgtctttaatctggaatagttcctcagtctttgtcttttgtgactttgtttttgaatggcacatgtcagttgcgctgaatatctctcattgggtcttatctgttctgatgattatatggaggttgtacatttgacagagtactacttgtatgttgatgtgtctaagagcatcacattgagagacacatgtcactgtgtctttggtgacattaacccagatcacttagttgatagctgccaggtttctcctctaaaggagagagatgctttgtgtagagagatgctttgagacttcgtaactatctttttcctcatcaaacatttgttttatcatctattgtgattgttgcctaaatgtttttactatgatggttgcaaaatggtaattttgttttaattttgtcatcctttctacatttattagttgacattctataaggtagtgctttgttttctcgcctttatatttgtcatatatgatcactcttatgggtttattttattcattgggttataaccattgtaatggttatttattttgatgctcaattgtcctagatatggtcagtggaagcccctataggttagacccagacatacaacctcaatttttttaaggtactttattgtactttattattttctggtatgagaagatgtttcaagcttatctatagtatttcctctgccccagctctggaatctgccattccagagtttttagaaggaagggtatttagaaatcaaaatccgaggtttaaatcttttttttttttttttttttttttttttttgagacggagattttgctctgttgcccatgctggagtagtgcagtggcgtgatttcggctcactgcaccctctgcctcctgggttcaggtgattctcctgcctcagcctcccgaatagctgtgattacaggcacctgccctcatgcccggctaattattatatttttagtagagacgaggtttcaccatgttggccaggctggtctcgaacgcttgacctcaggtgatccacccacctcggcctaccaaagtgctaggattacaggtgtgaaccacagtgcccctgccaagtcatccttatttcattctaattgtggtaaggtgatacctcattgtggtttggatttgcatttccttaatgattagttatgttgagtgtgctttcatgtacatgttggccatttggatgtcttcttttgagaaatatctattcaagtcttttgcccattttaaaaatcggattttttgctgttgagttccttatatattctggatattaaccccttgtcagatgcatagtttgcaaatattttctccaattctgtagatttgtctttttgtggtcttatttcctttgttgggtagaagctttttagtttaatgtaatttcgtttgtctgtttttgtgtttgttgcctgtgcttttgaagtcttagccaaaaagtccttgcccacactaatgacatgaaacatttcccttgtgttttcttctagtagttttatagtttctggtcttacatttaagtttttaacccatcttgagtttatttttacatatgatgaataataggggtttagtttcatttttctgcatatgtatattctgtttttgcaacaccatttttattcaagagattgccttttcccccaatgtgtgttcttggcacctttgttgaaaatcagttgtttctgattatgtggatttatttctgggttctctattctgttcaattgatctgtgtctatttttgtgtcaataccatgctgttttggttactattgctctatagtaaattttgaagtcaagtagctgatgccttcagctttgttcttcttactcaagattgattcggctatttggagtcttttgtagttccatatgaattttaggagtgttttttgtatttttttgttttaccttgcagattcacctcaaaggatgttttttctatttctgtgaagaatataattggtattttaatagagattgcatcaatctgtagattgctttgggtaatatggacattttaacaatatttgttcttccaacccatgaacatagaatatttttccatttatttgtgtcctgtgttcgttctttcatcagttttttttgtagtgatctttctcctccttgcttaaatttattcctaggcatcttatatttttgtagctattgtgagataactttcttgatttctctttcagatagtttgctattggcaaatggaaacactacttagttttgtatattgatttttgtatcctgcagttaactaacacaggttcacgcttgtaccagtccagcttcctagtcatcttccattccgtatttgtatctctacagcaatgagaaatctgaaacctgagggagttggaaaggcttcttaatcagtcttcagcctctgtctttaggccttcgaatcatttgtgccttcccaagtgtttgttgttttcatacccttggcttttctcagatttagtggggcattaatttataggcaccctcttctccttgccttcacaacaactaaaccaacttcacaacttcagctaaaccaactatctatccccatcttcactacaccgtcagtaatttgttgacagctgtttaatgtgttgcttccccttctgtttttatgttcttttgagtttatgtatttttatattcattcattctcattttagtggggtttggggatgaagtactgataaatatagtgcagtacaccatatttagttgacataatttttaaagctgtcttctgcttttattacctccattttctaaattaaacaccttgttgggcttctcatcttgctttgcaattattatgggacagaagcatttcacattagattcttagctaaggcttctctcaaaagatatatttcattcttgtctgttacatcgtttagaatttacatagtttcatttgttagtatttcagtaatagtccttgcagtgctttactgcagattcaaccttcacaacatactgtaaaaacacaaacccaccactgaatccttgatcttgtgattggcgcttaatgccaccagatggcgagcatgagctcttgtcagacagttaaggcaagaaacttgaagtgggtgctttcttcatgttttatataatgaaactagaatacctaaatttgaaacagccagcttttgaaaaagctggtaatggttgtattgcagcagaaaatcataggctttggactcaaatggacttgagttccaatcctgcttctaattgctactctatggcgttaaacataagtttcatagtttattagagcttccttatccttagaactgggataatgataacttttttgtgtaattgcagggattaaatgaaacaatgtatggaaaacccctagcctagggactggcacttagtattcattaaacattaaaccactctctgtcacttccttttcttagagctcctgcttcctttcttatttaagagtttgtgtctaaaacgtggtaatacaatcttttgtaaaagtctgttgtaagctcttagcactgataaactcaacttaaaccacacatcatctctataaggtatagttaatgactaggaaaaaagctaatgattctctctttcccctccatttaaaatacatccaagagtgcacaaatgctaaatgatcacccaaatgttacacttcttttcattctgaatctttgcctgaagccaagtgcccatgttatgatttgctgttaaacttaaaacttctgcagtcctctctatatgtaataccatcttttgtaaaagtctgttgtaagctcttagcactgataaaccacacaacatacctataaggaaattattaattttatctgtattttaaagacggagaaactgaagcacagagagattgttaattcacctgggacacatagcttaaatgctatttctcatttctttttttttttttttttttttaaagagagagggccttactctgtgtcccaggctagagtgcagcagcatgatcctagctcactgtaacctcaaactcctggcctcaagtgaggctcctgcctaagagtagctaggactacaggtacacaccaccacacctgactttttttttttttttttttttttttttttgagatacagagtctcacactgtcgcccaggctgcaatgcagtggcgcagtctctgcttactgcagcctgtgccttctgggttcaagtgattctcctgcctcagcctcccgagtagctgggattacagatggacgccaccacgcccagctaatttttgtattttttgtagagatggggtttcaccatgttggtcaggctagtcttgaactcctgacctcaagtgatccgcccacctccgcctccctgagtgctgggattacaggcatgagccactgcgcccggcccacacctggcttattttgaaaatttttttgtagtgatgggggtcttgctgtgttacgcaggctggttttgacctgggctccagtgatcctcccatcttggcttcccaaagcttaggtatcttttcaaaaggctagaaagaaaccaaaatcgtcataaactctggatgacaagattatgactggcttaaatttttctggcttccattttttataaaatgtaacatgatataatcagggatgaatatgagagctggaatggccactgagtgttaactttgattcagatctctcaaatgagtaaactataattcaagaccattaaatgatttgcttagaattcactacttctgaccgggtcacgctggtaatcccagcacttcaggaagccaaggtgggaggattgcttgagcccctggagtttgagatcagcctgggcaacatggcataactctgtctctacaaaaaaatatgcaaaaattagctgggcatggtggcacatgcctgtggttcccaactactcagaaggctgagatgggaggatcacctcagcccagggaggttgaggctgcagtcctcacgccactgcacttcagcctgggtgacagagtgagaccctgtctcaaagaagaaaaaaaaatatccaccacttccttttcttgagctcttctttttttttttttcctcctactcccctttgcctccatccttcactcagaatatttttaagccaagcaagatactatgagatacagtggttaagcatatgaattgggttgcttttagggagtaatttgacaatgtatgtcaagtctttgggcattatgttcaacttctttatgcttgcagggttttgcatggtgaaaattataaaaattcagctgctaggatctttgatgtttaaaaaggtgaggggaggtaaaaacctaaatgcccaataataggaattaaactggtaaaataatattgtcattttaataatcagataaaatgatatagatgaatattcaatgacacgagaagatatttataaatattttattataaaaactattttaattggttacattatatgtcgctatgccttcagagtagagagaagtgacagtttcaacacaaactgaaaaatttgtaagataatggctgctatttctaggcctgtaaaaattcatttacccaaagaaaatcatagtttttttttttttttctggagatggagtttcgctcttgttgcccaggctggagtgcagtggcgcaaccttggctcactgcaacgtccgcctcccaggttaaagcaattctcctgcctcagcgtcccgaatagctgggattacaggcgcatgccaccacgcccggctggtttttgtatttttagtagagatggggtttcatcatgttggtcaggctggtctcgaacacctgacctcaggtgatctgcctgcctcagcttcccagagtgctgggattacaggcgtgagccactgcgcccagacctatttttcttttctttaaaagaagcttttacttaaaaaaaaaaaaaaaaattatcaaggtatttttttaatcatagggcagttaccttagatcatcaaaatactttccaaggttgattgactattaataaagttggaatatttggtagctaatgcttaattgtattttgggattatcttatttttcccccactgtgtcttttcaccgtaatttaaaattatgttttaatattatgacaaaaggacaaaagctctgcttgctttgaggtgaatgtacataggcacttaccctttttcgatgtttgctttttagggttcattttcttggatatcactacattcctttcagtgaagcaagccagttaatatatagtgtcagggggcaaacaataaagaggttagagggaagagtttataatttttttcttgttattttcagtcagaactacttccttttgaaatgtatttttttccatctccagtggctgagaggagagtatcttgatttgaggtccctgagtagcagatgctttgtattgagagtaactgattaaagagccctgttttttgtttttgtttttgtttattttttttttcttttttaatcattccaggtcttgtcatgtcttaggaagtttgagcctatagcccaactgagtggattgttattccatattagtatggtcttcaagatatcaaaagttaaatatgtatgaacacatgaattacattttcacactgtctctttttttcctccagatagcacaacgatagaaaaattaagagctatttgtttagaccatgccaaacttggagaaagcagccttagtccatctcttgactcacttttctttggtccttcagcctcacaagtgctatatctaacagaggttagtttttggggttttttgttgttgttgttttctttgtttttccttttaaatttattctgtgttctttaaatttgacctttcatatggtaaggtgaatgatttgggtaaaattgtaatgaagtagttttgaaatgaaatattaatttgaaataaataatagtgagatggtcaagagtttcttggcactgacaatagtacaaatagaagttattttttttttaaatcttttaatacagccctctccccctcttctctatttttccaggtagtctatgccttgttaatgcctgctggtgcacctctggctgatgattcctctgattttcagtttcacttcttgaaaagtggtggcctaccccttgtactgagtatgctaaccagaaataacttcctaccgaatgcagatatggaaactcgaaggggtgcctacctcaatgctcttaaaatagccaagcttttgctaactgccattggctatggtcatgttcgagctgtggcagaagcttgtcagccaggtgtagaaggtgtgaatcccatgacacaggtaatacagactttttaaaaatccttttataatagtagatagcaatttttaaagtaaaactaattagtattttaagtgtagagttcaaggttgactcaatgttcaaagtgccttatttcagaggttttctttatgatgtttgtattaaaagtgcaaatacttttcgctgacagctgataatctgagggtagtttctccctgcccacttaaatcttgcttgactttcatttattttaaacctaacaaaaactccatatgaatctcttattaacttgtgcctggtagatatataaagacacagattgtaataagagatataattggtttatcttgttgcttgtttcccttcccaccttgggcttaaacccaagttctgagcttattctgactcggtttctgccttggtggcattcttgatccatgtcacaaaaaattctcaagacatgccagaatttgatacttatttatgagagatcaaactatgcatttaattctaagtaaagttttataaacatcataaatgattgttttactaagttactgatagaaggtaaaacttcagggataaagattttcttctttagaaatggcttagttttcaattgtggagatcagaatgttgatatttatggtaatatcacatataattgttttagctatgataatactgtggttatgtttaaaaggaagagccccctatatttttgaagtgattgctaagatacttccaggtgaaattacatgatatctaggatttgcttaaaaacaatcctggggtggagaagtgatggaaagcaagggaggatagtcagattaaacaatttggttcactggcgataattcctgaagctaagtaatatgtacatgggagttaattatactactttcgacactttgatgtgtgttacgaattttctgtaaaaaatggcttaaattttatattgttttgtatcacaggtcccatctttgttaggatttttttttttttaaagtagttcttattaggtaagtaaaaagacagcttcttgttaggataaaaacagatttttgtcatgatccctgacacagatacttaatgaagtacacagaaaacaattacatgtttccactttcacctttcttcagtatttattcagagaatgtgccactatggatacagaggtacataataacctctaatctcaacgagctcacagtagggagcccaatgcaaacttagtaatatagaaatatcttaaaataatattgttgaaatatttacagtatatatatataggaggggagttacaacttgaaggcagtcagaattacctcgctaacaactacgtaatgaaattaatctgtcactgatttaacaacttgattatagcattaagtaaaaactagggtacctttcatacattagtcctcttactgctttttcagtattccttaatttttcttttttttttccaaagaaaaatgtggtaacaatggggaatacaagcagggtctgcccaaggcatgtacataaaagatgtacaatactttactgagtctctagaagggaaccagtctatttagtgtatcattatcccctgcaagttaagctgaggccagatttagagacacgagttgattgctctagaatggggatttgcagacacgtggcactacagtgcacaaggaagagaggaagcccactttgttggcagtgctttttgtgtaagttgccacaggttctataatgtgtatatgcaaggaagtcgttctgcaggagtgggtgatgaatgaagagcaattggttaggtctggttatgtacaaattatttactccaaataaaatggttaacttttttcagatcaaccaagttacccatgatcaagcagtggtgctacaaagtgcccttcagagcattcctaatccatcatccgagtgcatgcttagaaatgtgtcagttcgtcttgctcagcagatatctgatgaggttagttttatcaagacttctgtcacaattttaactttcctaggcccacttattttaatcactgtctcattctatagataatgtccccttaatatcagttttgtctactattaatattagtactttctgtttttaatcaactttatgtataataaacagcatccttttaaagtatacagatggggtgattttttttttttttgagacggagtctcactctgttgcccaggctggagtgctgtggtgctatctcggctcactgcaacctccacctcccaggttcaagtgattattctgcctcagcctccacagtagctgggattacaggtgccacacccacccccccatgcccggctatttttttatttttagtagagatggggtttcatgatgttggccaggctggtctcgaactcctgacctctggtgatctgcctgcctcagcctcccagagtgctgggattacaggcatgagccaccatgcccggcccagattcggtgaattttgacatatatgtgtgaaaccactgctgcggtcgaaaccgaatgttttcatcactctttatgcacttttgcagtttattctttccccaggtaactactgctctttttgtccctagagagtattttttgtcttctggagttttatataggtggattatagtgtgtgttcttttgtgtctggcttctttcactaagaataatgactgagaattacctgtgttgtgtggattagtagttcattcctttttattgctaactagtacccattatgaatattccacattttgtttatccatatacttggtgaaggacagttggatcattttccctttttggctgtgaataaagctgatgtaaacattgtgtacaagtgtttgtgtagacataaattttcatttttcttggataagaaactacgagtggaaaggttgtcatctttgtagtagtaaaatgtaatagtaaagagctagagaacttggggagcgtactttgttgtattgctgtttaaaggcaggaggtggggaataagccaggtgcagtggcagatgcctggacttccacctacttgggagcatgaggtaggaggatctcttgagcccaggagttcaaggctgtagtgagctatgatcacaccactgtactctagactgggtgacagagccagagggccctccgcccccacctttttttttttttttttttaagacaaaggcaacttgggaatttaaaaacaatggtactacacagtaattcctatttcctttacaaagtgaaacatttttgtttttctaaacataatttcactctcattctatcaacagttctatttactcgttatcttgcaggcttcaagatatatgcctgatatttgtgtaattagagctatacaaaaaattatctgggcatcaggatgtgggtcgttacagctagtatttagcccaaatgaagaaatcactaaaatttatgagaaggtaagaattatcacagaactatattccttgtaaacaaatgtttcttaattgtgcatgtggtttgatttttattagctttgctatttttaaaaattgaatcacttgcatcttaatggttgaaaattaattgatagctatgttgagaatatggtaaaattttactttgaaaatgaagtacttaagaatcgtgccatgtggctgctttttaaatgaaattgccttttgctgcttcttgtgggggtcagatataattgtctcatactgaatttgctttatcccattctcttttttcttttatcatctttctgtcctgcgtaaattttggtttgtcagttatggtatggcatttaagtatttttatttgattgtcttaaagcagtcaaaaataagagtgttagccaattagatatcattcctgaccttctattagattaagcaaattatctacagaagagaagctgtggttggctttttgatttatcatgtgtacctgcccctgatgctacatatttagaaggagaaattgagttacaggaacttccctgacttggtagagcttcttttacatggccaacatcaccctgatttgcccaggatatatgttgatgttccatagtatctgtctggcacagccctgggtattcattcagcttattaactgaatacttattctgtttcaggcatgtactgtagttactactttttgattaataaagtcagattagaattcattaggtacctccccaggcatattttaggttgtaagcctttgaaacccttcctgaatagttgtcagacaattgattttgaataaaatggcacaataggcaagcaacataatggaactagtcaaaagtacctaagtgctatgccacagtggttcctgagaaaggattggttgttggttcagaagtaaacaactcagaaggtctcaaaaagataggtagtgtgctcagtgtgctccttcagccctcctgaagacataggaaaataatggaattagactttattttctattatagtcatttccagactattccaaaggggcctcaagagttaacatgcagccatggagaggctgaggccaggtggtttaagtgagcagatgagttttaagcactaactagaagttgtgtgagatttttcttaaatacttctttgggtaatttgttcttgattgtaattttacagaccaatgcaggcaatgagccagacttggaagacgaacaggtttgctgtgaagcattggaagtgatgaccttatgttttgccttgattccaacagccttagatgctcttagtaaagaaaaggcttggcagacattcatcattgacttactattgcactgtcacagcaagtaagtatcttttttaattgtaagaaacttactttttgtaaatggagtgaattaatttaggctggcaaaatgtgtccccaaaattaaatatttattgtctctatggcatattggtattgaggaaaattttattatttaagagtgttttgcttaacctaaatgtttggttttagtctctgcaaatgccaatattaattgtcaaagcatgatttttttctaatcttagaatttagttttacctgggaggtatatagattagcctatttctaaaaatctagtttgcaagatttaaatcatataggacattagcctcctatcttagattcctagatgccaggttttttttaaagccaaacagaatttgatatgaaatttgtaagacagggtcattgtaagaacttttgcagtttacactgataataaagatcagttataaagctcatgttttcatttcaagagcatttaatcagtggcagtaattttgttttgggtttctttttctgcaagtcagtcagatttatagaaaatgttggtttccatcctcttgtatcagtctgatcctgatcttcgtatatggtaactttattaacttgggctctaatttgtgtcactgttgtatgtaattaacttgttttatctgtattttgtgaaaagacacagaaaatgtttactttcatcattccatcacatgccattcaataatgacaaaattcattgatgaaaggttgatgtaaattcacaataagtcatttgttgaaatgaaacatagtaataattaaagttttaaaaatgtacatgctgtggggggtagggttcaacttgcccactcgagaggatgtagagtctgaagtgggaatgtcactttagagtctaaagtgatttagtgggtttaaagtgtgaatatcacctattttaagaaggtccttgggtaagttctttgaagaaatccagtccagcctattcagaaactcttaacaggatccccacaaatcgggttgggcgtgctacctccttgagaagacaatcctgcacgttggaaaagataaataggtttagtaagtctaattccatttaatgatgcatacgtgtgggaatggtgaggataggaaagatgattagccaacagttttaatgatgtcaaacctggagggtagcaagtttgttattctatgttgaatttttaaaatcttaaattaggaacttatttcatctcttagtctactaactattaaggaacttgatttaacagggttttttgccctctaccctttatgaaaattacccttatataagtcagaaccattttgcccctctcttccctgaaacttgcatgcagtgcggtaatgtactgtagaaagcatgttatctcattatgtcaccatattgtctgcaataatagggagggcgttctaagttaggatctttttgagttttaagtacctgattttttataaatatctgaatacctatgtaggttcaaaatccattatttcccgttagtaagaatttgtcagcaagtccgacttggacattaattattggcattaatattctaaaatctgaatccccaggccgggcacggtggctcatgcttgtaatccctgcactttgggaggctgaggcaggtggatcacctgaggtcaggagttccagaccagcgtggccaacatggtgaaacctcgactctactaaaaatacaaaaaattagttggacattgtggtgggcgcctgtaatcccagctacttgggagactgaggcaggagaattgcttgaacccggaaggcggatgttgcagtgagctgagatcgcgccattgtactccagcctgggcaataagagtgaaactccatgtcaaaaaaaaaaaaaaaaaaaattgaatccccaaatacatactggccccaggggtttcaaataagggattgtgagctgtgtacaaatctgcccctcagatggagtttataatcctatagtaacgtttaagcatagttatttacaaggtacttctcacttaatccgtatagcaactcagaagtagactttgctgatggagaggcacaaggactgtagaaattaaatgactaacaagggcataatgatcactaaatgctaacactaagactgaaggttttctgcttcttgagttctgacatttctgccacacaaattgggctctgggtgtaattataatccaccagcaaatatgtgaatccctacctatgtgcttggcaattaaaaccaaagtcaaataaggcagttcttgcactcaaggaactttgagagagaaattggtgccataaaaggtaaaatactttgagaattggaaaggccataacttactttctacctggaaggagcaaaagtgaaggttttgtgcaggatgtagcatgtgagctcatgtttgggcaggatttatatgtgcataaaagtagaagatggtcattgccagtgcgctctctctctccctttctcactcccagttatgtggcttttacttcatgtgtctttgaactccatacactttcctcctcatggtctaccctgatctaagcagtctggacccattgcctggacaatcatagtatccttgatcttcccacctgtagtgttgtactcttctaatctgttgactacacggcaagcagagtgatctctagaaaatatgagcatgttgctttcctgcttaaaatctttccatgtcttcccgttatctttgaattaagttcaaacttttaaatttggcttataagcactccataatttggtccctgcttctactcattcagaagtttcaacttaaatgccacatattctagtaacttttccttatccctaatctaggaaaggtttcctagacctctgttcctgttagatggtctgcttccacatcatgacactgactttattttattgtagttagttgcaatggatttaaattcttttagataaacgatatttttttctgctgtttccacagcctgttgttttattccctgcctagttaactcacttatgttacctctctgatccgagaaagcatttgactttgccactcctgggatagtgctttcagagcagagctgagtatttggttaaatgtttagaaaaggagtcaaggataatactgtacaggaggttagtgggagtcagtttgacagaaggcctatggtgctaaggtctaagcagtgtttgatgttaatgtggtgtaggcagtctcatgtatatgtttggtaaatattgatcaaatacctattgtctacaagacactacccactgtggatatggcaaaacagacaaaatcttagccttctaggagcttacatgccaaaagggatgggggaagagaaggcatacgagaagtatatcagataggaataagtgctatgggggtgaaataaagcaggaaaaggggctgtgtagtacggggcatgagtggagttcatttttttatagggtagttgaagaagacttcacaaaggtgatagctttgtttagaggtcaccttttatcattacctttcagagcaaagtaataatccatgtgactcatggagaaagtatattttaagcagaaaaaacaacagatgtgtatgtccaggcatgtcaggaacatgcctgacatgtgaaagaacagcagggaaactggagtggatggaacagaggcggtaggggacggggacagttgtagggagtaaagtcagagaggataacaaacaccctgtgagggtttttataggtcattgtgaagacattgaccctaagtgagatgggaatctttcagagggttttaagcagagaaatgatgtgctccaccttaactttgtaagtttattctggttaagaatagtatgtaggatagcaggaaaagcaagctattttatgaatttaaataaaagatgacagtgggctgcatgcagtggtggctcatggttgtaatcccagcactttgggaggccaagacaggaggatcacttgaggccaggagtttgagaccagcctgggcaacatagtgggaccttgtctctaaagaaaatagaaaaaataagccgggtatggtgaacatgcctgtagtcccaactactcaggaggctaaagtgggcagatcacctgagcccggagaggatgaggctactgtgagccctgatcgtgccactgcactctagcctgggtgacagaacgagacccagtctcaaaaaaaatttttttttagctggatgtggtagcatgcacatgtagtcctaactagtcaggaggctgaggtgggaagattgcttgaacccaagagtttgaggttacagtgagctaggatgatgccactaaacagcctgggtgacagagggaaaccctgtctaaagtaaaagggactgactgttgtgaagatagaggcaacaggattagttgacagaaatgtgtttcttttgaagcactctagaagtctgcatttgctcagggaagttctatcgggtattcacgagcatcaactttttattgcccctcatatttgggctgtatacctagcttattgaaaaattagtaaaccaaagcagtgggaatagcatacctttgaaaatctgattaagttatgggcttgctcccagaaaagtagatacgcctgactttggtttacttgggttccccccaaattctacctccaaaaattttaggggcttctgaatccctctgatttataggcctatggactgttttcagaaacctaagataccctctagggagggaggttagtacacagaatgtatgctgtcaggtcctttacacttgtactttaaattaagttctgagggctgggctcagtgactcacgcctgtaatcccagcactttgggaggccgaggcgggcggatcacctgaggttgggagttcgagaccagcctgaccaacatggaaaaacgccgtctctactaaaaatacaaaattagccaggtgtggtggcatatacctataatcccaactactcgggaggctgaggcaggagaatcgcttgaacctgggaggcggaggttgcagtgagccgagatgttgccattgcacaccagcctgggcaacaagagcgaaactctgtgtcaataaataaataaaaataaatttggttctgagttatctagtaactagcacaaagacagaaatgtagttatccatgaaatgcagtttgtgatgtctataagatattcacaaatgcttagcaggtacttgttgagcatcttccatgtgtcatacattgttctaggtgccaggacctttggcatcaagaaagcccctacccttaaagagcttactttgtaatggagatagactacacatttgataactggttcttgaggtcctcttatacgccagacactattctaggttccaatggcacagttttaattaaaggtagatgatgtctctgccctcttggagcattttattctagtgagatctatatagtacataacagtttttaaaaaagatagatccatgattcccagatctgagaatcatgagacaaggttttcccaagggtcatcagagagaaaatatggtattgtgattctcaatctttcttttttctttcttttttttggagatggattcttgctctgtcaccaggctggagtgcagtggcgtgatctcagctcactgcaacctccgccttccgggttcaagcaattgtcctgcctcagcctcccaagtagctgggattacaggcacccaccaccacgcctggctaatttttgtatttttagtagaaacggggtttcaccatgttggctaggatggtcttgacctcttgacctcctgatccgtccgcctcaccctcccaaagtgctggggttacaggtgtgagccaccgcacccagcctgtggttctcaatgtttagtgcacatcagattgacctaaagagtttattaacacattgctgggccccacctccagtatttctgattcaggaggtctgcattggagcctgagagttggcatttctaacaagttcccagataatgctgatgttgctgctctggggaccgtgcttttggaactgccagtacggtatacggcagcagtccccaacccttttggcaccagggcccagtttcatggaagacaatttttccgtggatcagggaggtagtgggggatggtttcgggatgaaaggattccacctcagatcatgaggcattagttagattctcataaggggcacataagctagaacccttgcatgtgtagttcaatagggtttgcgctcctatgagaatctaatgccaccgctgatctgacaggaggcggagctcaggccataatgctcatttggccttctggcctggggtttggggacccctggtgtaagagacatctgccacaatagccttaccgtggttactacagaatttccacagagctgttgtgcagaaccacagttgaataaaaattctgtggaaggccaaaaagatgcataaggttattgtagtagagcatttggtatatagaggaacatttccagcctgttccaagaaagaggtgttagaaggtggtatccctcaaactcttagtgtcaatttgaggttatagtcctggacatagagcttaagttcatgtattatgtggtgttggcttgagtgcttgttgtgtgtaggtagggtaatcctgtatccttactattaatttatttcccttttatactccccccacctctcctccccaagagggaacaatgttacaatcattttttaaaatggaaataatgtattaaatgtgaaacattttttatttcagaactgttcgtcaggtggcacaggagcagttctttttaatgtgcaccagatgttgcatgggacaccggcctctacttttcttcattactctactctttactgttttgggggtgagactttttaaaatatgcttatcaatgtgattcattctttaagcaagaaacattcagaaatttgtggttttagcttgcattaaagttaggacagtctatatttaataaatgaagtactactttatttcccgcactgtggtagtcatcttctctagttaactctgggtttttaaaaaagtggattttgaggatggacgtgtaaattgatattattctactctgtttccagagcacagcaagagagagagctaaacactcaggcgactactttactcttttaagacaccttcttaattacgcttacaatagtaatattaatgtacccaatgctgaagttcttctcaataatgaaattgattggcttaaaagaattagggtaagttttagttaatactccatttatatgtcattattagtaaatagaatgttttattgatgatttatattttttgagcattttggttaaatggaaaactccaaagattgataaaagggaccaaagaatgtactctgcatcagtggacgttagtaatctgtgattcacaaaatgcatatctagtttagtaaaatgaattgcttacttgacacttgaaatactgatgttcagcttcttttattttagcattttgggcctttttgcaaattctaatttttaaaaaaagtattcttgaattgtttatgtcaaaaatgagtctgatagagcagaactttctaccataacatctgatactttttacttaggcaaaatgatacaagaatttatttctgaagagatttgtagtttttaaccttcaaattagcatttcttctagtagttcataaagccaatttctagaaagttctgaagaaaacaaagttgtttgaatggaaagacttaaggaaattatctcatatccctccagctctgtctcgttctggctcctctctccctctttacctccctttcataagctagacatttgatttcttcccccccccaccccaccccccgcctttggcaggatgatgttaaaagaacaggagaaacgggtattgaagagacgatcttagagggccaccttggagtgacaaaggagttactggcctttcaaacttctgagaaaaaatttcatattggttgtgaaaaaggaggtgctaatctcattaaagtaagttctgtgttcttggttgtaagctacatatcataaccttctaaatgtttataatcaaatttaattaatttatagtagtatcatgtctttgtactttcttgatcttttctcttttttaagaatctttatcaaatttacagtaatttaagaaatacagttatgccttactttattcaagagacatttctaaatttgtatttaaataagatttcatggctggacttgctggcctcatgcctgtaatcccagtactttgggaggccgagtccagtggatggcttgagcccaagagttgaagaccagcctgggcaacatggtgaaaccccttctctacaaaagaaaaaaaaaaaattgccaggtgtggtggcgcacacccatggtccccagctacttgagaggctgagatggaaggatcacctgagcccaggaggtggaggttgcagtgagctgagatcgcaccactgcactccagcctgaaggaacagagcaaggccctgtctcaaaataaatagataaataaataagatactttataaagtaattgttgtttagtttttctctttggaaaatctgaattgttaatttcatttaatgaggcaaacctctgttttgtaagaatgcatcttgtatatctttaatgagttttttcatacatgtagtaacacaaggaaacaaagtttcatttttgtacattttatttctattcaaaatgggtttaatttgctatacacttgattaaaggagcaaacatttaaaataaaaattttgataagtactatattcagttctttcttaatatttacaaatttatttaacctgcgaaattaggtatgttagtgatagtaaatagtgttttgaaggaagatctttttattagaaaatctgagttttctgagatgtaatgagatcttaaattccaatgagtaattttaaaatgatttacttacaagagaactttttttttctaaaaatatatagcattgctaatatgtaatccctttttcaactttttaggaattaattgatgatttcatatttcctgcatccaatgtttacctacagtatatgagaaatggagagcttccagctgaacaggctattccggtctgtggttcaccacctacaattaatgctggttttgaattacttgtagcattagctgttggctgtgtgaggaatctcaaacaaatagtagattctttgactgaaatgtattacattggcacagcaataactagtaagtatttttaatagaatgtgataattgatcatttcaatgtttcaaagttgttttcctgtttttctttcagaaaatatttccaacttacgtatttctttcagtaactagtttaacatttttagtgagtgaatgaacagttaagaccattataggccgggcacggtggctcaggcctgtaatcccagcactttgggaggccaaggtgggtggatcacctgaggtcaggagtttgagaccagcctgaccatggtgaaaccctgtctctacaaaaaatacaaaaattagctgggcattgtggtgcacacctgtaatcccagctactcaggaggctgagacaggagaattgcttgaacccaggaggtggaggttgcagtgagccgagatcgcgccactgcactccatcctgggtgacagagcaagactccatctcagaaaaaaaagaaaagaaaagaaaagaaaaaagaaaaataagaccattataagcagaccaccttgtatagaaaaaaattcaaacatttgttaagtggcatcctataagtggtgtcgccatttggcaagataaatttcatctcatgaaacctgtcataaaattcaaactccagattaaaaggtagccaaagtaaatgccgtagagtatagacgtaaaactttattttatttatttatttttttgagacggagtttcactcttgttgcccaggctggagtgcagtggcgcgatctcggctcactgcaacctctcgggttcaagtgattctcctgcctcagcctcccaagtagctgggcttacaggcgcctgccaccatgcctggctaattttgtattgccaccatgcctggctaatattgtatttttagtagagatagggtttcaccatgttggccaggctagtcttgaactcctggcctcaggtgatccacctgcctcggcctcccaaagtgctggaattacaggtgtgagccaccgcacctggcccagacttaaaactttaagttgcatgtattggaaaacctttcaggtcttcacttagaagttccgtaacgttatgagttcgaagaaaatctggctttgaagattagaacgtgagaagttaccattttggtgcaccttatttatgttctcatttaatgcccacaccaggcgcatgaataggctgcagatttcagaccttacagataaggaattgaagctcaaaagggcaagggcaatataaaatattaataacagaaaaagcagaaataagcataattgatgctgttttaagagaaaatcgctatttagaacacttaagaatataattgattatagtaaatctttaagaacatgtcaaattactttttgatgtgtttcagaatgtttggaagttttaaataacatctcaggaatttctgaataaattgattgcttaaaaggttagacctttagctgtcctatcaaatctatgtattgtgagaattcttgtattttttttttaacttaatgggggttaattttttaatcacagattggagtatagtacaacgttgtttgcatccttccctatctgccattgttccctgtcaacacagaaatatttacctaattccatttttggccatgcagtttggtatgatataattaactggccccctagacaatgatacttaatgttgtttccaggtttatactaggtggagggagataggaagatgtacagtgatttacaattatcacaaatctgctgtcttgcttgctcctcaaaatagcattatagatatcaggaaagcaagtgttacttttattattacatttactaggaagaaacagaaagttacctaaaggtgggggaaaaaaagtggtaagcatcagaaccaggatgtgagcccatgtggttttaggattatttaaaactgagaaaattataatgtgttgatatatttagataacatttcattccttgccaaatttgaaggcaaaagtatcaaatattaagaaagtgaataatggctaaaaataaagatgcaagtaaagttagcatgtagacattagaattatactatcttgtacttttgagactgccatagaagcaacatcatatgaaacgggtttgcgggtgattggataagaagctgcacagtggtgcctgttgctgtatattttagattgttggaagatgaagtgcaaactcagaacactgcttcaggttgctgtagggttagtcgaattatgggtggtagaattattgccagggttgctttgtcagcataatagagtttgaaaggacagaatggccgtgttcatgctacaagaatctttccttctctcagcttgtgaagcacttactgagtgggaatatctgccacctgttggaccccgcccacccaaaggattcgtggggctgaaaaatgccggtgctacttgttacatgaattctgtgattcagcaactctacatgattccttccattaggaacggtattcttgccattgaaggcacaggtagtgatgtagatgatgatatgtctggggatgagaagcaggacaatgaggtaaatttgagttaccatttctgttttctgtgtttcaagttatgataccagatactattctctcttaagagagtgttatactttcatcaaacgtattaaagtatatttgaaagttagggatgggccgagcacacacctgtggtctcagctactcaggaaactgaggcaggaggattgcttgagcctgggagctggaggctgcagtgagccatgatcatgccactgcactccagcctgggttacagagtgagaccctgtctcagaagaaaaagaaaaagtaagtagggatggacttctcccagccagcatgaactgctacctcttaacatagtatagttctcactacctaccagaatttaaactgcagataatttttagaatggtttgtacatttctaaagcaacagttggctgggcatggtagctcacacctataatctcagcactttgggaagctgaggcaggtggatcacctgaggtcaggagttcaagaccagcctggccaacatagtgaaaccccatgtctactaaaaatacaaaaattagctgggtgtggtggcacatgcctgtagtcctagctactcggaaggctgaggcaggagaatcacttgaacccggaaggtggaggttgcgatgagctgagatggcaccagtgcactccagcctaggtgacagagcgagactccgtctcaaaaaaaaaaagcaacagttaatgtactcgtgtttttttgtgtagagtgtttagtataatttggggtttgtttgatggtaagaaccttcatttttgataatagttttaaatttttacttttctatttctaaattttaattttctattttatgccaagttatacagtatctgccaatttcactgtgtgtgcttacttttaggttattctttgaatttcccttagatcatagctcttcttgattaggaaacaaactttccctactttaaatagtctcacgtagtcttgtggcaaaatttaggctgcctactgagtatccagtgcagtataaagcagtgaagaagttgagttgtagtggcgaatcagaattgacataactgtaagatagctctttaaagaagagcatatggcaagaagacttaagttgtggtcatgtttgtgcttaccatgtaatatttccttggttttacttttcctgtttatagtgatagtgggaactgaagagagaagccagagtatattctaattgtagtaaatggttcttttcattccctcccttcagttgccagaactgattttgctctgaagaagtagtttatcaattggagcttctgaaacatctacttgcctcaactcttccctagacctgctgtgccagatggtctagggattgggttctgagcactttcactttataaaaaaaagcttcataaaggacacttatacccatacctgattaaaaaccactgctctgggaaaaaaatgtaattcaaattccagttctggagcccatcatatacctgggatattgagttaaacacaagtagatataggtaattgtactggcaagaagtaaatgaggcatagaaaatataacacaatttcaaataaggtgtaccacttttactctcatggtatcctctgctccatgttgtctctgcaccccagtgtactgtgggagtttttgtggggttttttgggttttggtttttttggcttatgtttttgtttccatccctagagtataagtttctcatgggcagggactggttgttgtctatttctatatcagagttatcagatacaactcagagaatactgaaagatagttaaatgtaaaaacacattcttctttgtagctgccatatgattatgacctttaggaattctgtcttcatgttacatcttacaccactacttctgttgttttttaaaattgtggtaaaatacatataacatgaaacttaccatctgtttttaaatgtgcagttgtcctattaaatacatttacattgttgtacaccatcaccaccacccatctccaaaactcttcatattgcaaaactcaaactgtagtcattaagctactccccattctccctccccacagcctctggcaactactattctttttgtctctatgattgactactctacatacctcatataagtgattatataagtgaaatcatacagtgtttgcctttgcatagctggcttatttcattttaaagtctaagtaatattccattatatgtatataccacattttccttatccattcatttgtcgatggacatttgggttgcttccccatttgagctattgtgaataaggctgccatgaacatggatatacaaatagctgtttgaggtcctgctttcaatatttccaggcatatgctcagaagtggaagtactagatcatttggtgatgctatttttattttattatttattatttttttcagacagagtctcactctgtcacacaggctggagtgcagtggtgctatctcagctcactgcaacctctgcctcctgggttcaagcgattctcctgcctcagcctcccgagtagctgggactacaggcacgcaccaccataccccgctaatttttgtatttttagtagagatgggatttcaccatattggccaggctggtctcgaactcctgatttcaggtgatccacccaccttggcctcccaaagtgctgggattataggcatgagccaccatatgcggccaaattttttgaggaactgttttctagagtgactgcaccattttacattcctaccagcattgcacaagagctccaatttctccatatccttgccaacacttgttatactcactcgttctggtagttgacaccctaattgagtgtgaggtagtatctcatggttttgatttgcatttaccaaatggttaacgattttgagcatctttagctgtgcttattattggccacttgttgatcttctttgtctatttttaaattgagttgtgttgttgagttttaagagttctctgtatgttctagatattaactccatatcagatatgtgatttgcagatactttcttttgttgcctgtacctctgatgtcatatccaagaaatcactgccaaatccagtgtcttgaagcttttgccctatgttttttttttttttttaacagttctgtggttttagctcttacatttaggattttgatccattttgagttaatttttgtatgtagtgtttcataagggctcaactttattcttttgcatgtggattatccagtttacccagcaccatttgtggaagagtactagtcatgcaccacataacaacgtttcagacaattacagaccatatatatgacagtagtccaatgagattataatgtcgtatttttactgtaccttttctatttttagatgcacagattcaccgttggtttgcagttgtctacagtatgtagtacagtaacatgctgtacaagtttacaacctaggagcaattggctataccatctaggtttataggtacactatgatgttcacatgacaaaatacctaatgatgcatttctcagaatttatccctgtcattaagcaaagaatgactatactgatataggtatattttattgacagatctgagcattttatatacaacagctacacaaaggatatattacccccattcacacataaagaaacttgaagcctagaaagtttaagtagtttttacttgctcaaagttacttggtttataagtggtagagcctgcatttatgtctagttcagtctaaattactatgctaatgctacactatattatctatctttcttacacatggtcagggttatttggttatgataactaatatgtgaaatggtggggataaacactaaataactaaaaatttataaattgaaaagtgctttggaaatgagcataataggaatacaaatcatttgttcaataactgcttggcatttgtctcaacgtattttattatactttagctcattggtgacattttttggtttctagagcaatgttgatcccagggatgatgtatttggatatcctcaacaatttgaagataaaccagcattaagtaaaactgaagatagaaaagagtacaacattggtgtcctaagacaccttcaggtcatctttggtcatttagctgcttctcgactgcaatactatgtgcccagaggattttggaaacagttcaggtaaactatggatggacagtaatagagatacttcttaaaatgaacatctcaatacactaacattaaacctctaaaagacatgttggaaggcatctttttttaagcactggtaatattcaaactgtccttaattgggtgggtttttttttttttttttaggtccccttaggaagaagtagaaactgccatagtaagtaagggcaacatcctttagtctcttaaccatattattaactttttattaggaaaacatctaataaatacagaagtagaaaaaatagtatgaacccctgtatacttgtcacccaacttcagtagtagtcaacttgtggccagcctcatttaatctatattcttaacctattttttttttctttttttctttttctttttctttttttcttttttttttttgagatggagttttgctcttgttgcccaggctggagtgcagtggtgtgatcttggctcactgcaacatccgcctcccagattcaagtgattctcctgcctcagcctcccaagtagctgggattacaggcacccaccaccacgcctagctgattttttgtatttttagtggagacggggttttaccatgttggcccagactggtctcgaactcctgacctcaggtgattcccatctcagcctcccaaagtgctgggattacaggcgtgagccactgtgcccggcccctacctatttctttctagattgttttgaagcaaatcttagttccatctgtaaatacttaagtatgtgtctgtagtgtctgtctcaaaacatgatcatgataccattatgtttttttaaaattgcttaatatcaaatatctctgtcagtgtttgaatttaccgagttatctcataactggtttttactgatattttttaaaaataagattcagttgaggtccatttaccacaaatggttggtaatgatcttgattattcatctgtttcttttttccctttacaattatgggggaatcggaggacaaatagtttagcatgtaaattttcccacagtctgaattttgttgatggaatccctgtggtcgtttattattttctgtttttcttggtcacctgcatcttctataaacaccttatgagatctagaggcttgatcagattgtggtattatttttctttttgtggaatggataggcaacgctacttcataggggataatgtttatctccatgaggagtgacattataatgtctgtcttcttatgatgttaacagcaattttttattattattattatatatatacaatttttttttttcccctgagatggagtctttgctctgtcgcccaggctagagtacagtggcgtgatctcagctcactgcaacctccgcctcctgggttcaagcaattctgcctcagcctcctgagtagctagggttaacaggggttacaggcgtgggccaaccatgcccggccaagttttgtatttttagtagagacggggtttcaccatgttggccagtctggtctcgaactcctgacctcaggtgatctgcctgcctcccaaagtgctggattataggcatgagctactgctccctggccttttttttttttttttttttttttttggagatagagtcttgctctgttgcccaggctgaagtgcaatggctcgatctcagctcactgcaacctctgcctcccaggttcaagcaattcttcagcctcagcctctcaagtagctaggacgacaggcccaccacaccccgctaattttttgtagttttagtagagatagggtttcgccgtgttggccaggctggtctcaaattcctgacgtcaggtgatccacccgcctcggcctcccaaagtgctgggattacaggcgtgagccactgcacctggccaattatcattatcttaatacagtatttcttcagggttataaaataacaatattttattttttcatttaatagctagaaaagatctataaagggaaaattgccctcaccattttctttttaagttagaaaactcagattacatttttatcttgtttcctttgactttaagtcagtactacgtcatgcactgtgctaaaataactacagtacaaccacgtaactcttactgtgtatgaaaaggggtataattctttatagcagtgaggtttggtttgttttgttttgtaagtaatcctccttggaatcccttcaaggtgcttcccggccagctgagaggagcggggaacgaagggtcacctgatactctgatccgccttcccttcttctgacaaagcagtataaatttcttttcctcccctaactaggccctctacttactctgtactagtgtcttgcgtggaccaccctccctcccatctctcattttgcttttagtcccgtcacccagcataccattctccctcctctctgactatttcagttctgtcttctttccctaggttattccaattccatctctgccttaaggctattttagcatttctgtttatgctcttccaaactgaagaacacaaacagaggcttatactgggttttttttttttttgagacagagtctcactctgtggcccaggctagagtgcagtggtgtgatctcggctcacggtaacctctgcccgctgggttcaagcaattctcctgtcttggtagctgggattacaggcgcctgccaccatgcccagctaatttttgtatttttagtagagactgggtttcaccatattcatcaggctggtcttgaactcctgacttcaggtgatccacccgcctcagcctcccaaagtgctgggattacaggcgagagccactgcgcccagctgaggcttacactttttaaactttcgtcttgtcattcagttacaattttttctcttgtaatgcctttgcttttttgacttttcagttactcgctgtgctagtggagctcggtttgtatagactagcactttggattatccacactttagacacataatctactcttgacacaagcgggttagttaactacacttcctcaccccactcttttattttgaaaagtttcaaacctacagaaaagatgaagaagaggtataattatcacctttatgttatattctttatgcggttttactaattaacattttgccatatttgcttatcttgccatatgtgtgcttggtttttggtttattttttttttaagttttgtttgtttgtttgtttgttttttgtttttttgagatggagtctcgctctgtcgcccaggctggagtgcagtggcgtgatctcggctcactgcaagctccccttcctgggttcacaccattctcctgcctcagcctcccgagtagctgggactacaggcgcctgccaccaatgcccagctaattttttgtatttttagtagagacagagtttcattgtgttagccagggtggtctcgaactcctgacctcgtgatccacccggctcggcctcccaaaatgctaggattacaggcgtgagccaccgcgcccggccttttttcttaagttgatagtgaagttgcaaacaggacgcttcaccccttcatacttcaacatatatcttataagagatcatatatcagaataaggcaattttcctacttatgtatgatacagttatatccaagtaatataataacgatttttaatctctaatattcatcagtatatattccgatttcccaaaagtggtctttataacttatctctctatcccaatctgatactcatgaaggaatcacaaggatttggctgttagctctttagttgccttttatgtaaaataatctccctaacttgtgacttgtatcgcactgaaatttttaaagaatccaggccagttgtcttgcagaatgtgttttttgatttgtgtgattgtttcctgatgattagctttatgttaaatgttgagggggtgggggcaataaaactacataattgatgttttgtgtttctcactgcactgtattgggaggcatgtgttatccacttaattattaagtgatattaattttgatttcttggtgtcttaacagatctctcctttataaagggtaccttttcccttttgaaattagttgattacatgtttgaaagtttgaggagttgaatatggtttgaaagtaaatagaacggactggtgtaatttccagtaatgaaacaagctgatttttaacaaataatatatttgattttaaacttactgtatacaaatttttacttgtgtaaaatataatagagatcagattatttgctatgtagaaaaggtttttacaaaagtataaacagacagttcttgcatactttaaaatgtcatttcttgcttagaacaaatacacttaaattctctatatacattattctgtatatacaaaatcaggtattattgatagtttccagcagtgcctgagttttagcagtatgagttctcatttttgtggtatgtagtgatggtgtcttttcttagattactcaagagattaactctagaacaagttaaacctttctctcttcacttgggaaaaaaataaatttaagagtaactagatctgatctttttactatttataatccaaaatttaagcaaaatgaaagaaataaaatagtgattgtaacatccacataagagtgagatccaccacctcatcttaatagtatctttaattggattcaaaatgcatgcatgtgtcataccacctgaagcaaccatccttcctggagccgtactatccatcaattacaccactagttttgtggcagttctttgccgctagagtactagttttactatgaggctcactctcttaccccactacattctacagggaaagcacattctttttttcctactttttccatgtaattgaggaataaaatctcggttttatatactgttgtttgtggtcttgttgcttttttttcccctgaaaaatatagttgtacatattgttctgtgaatgttacatgttacatgttttatttcattcatttcttaggctttggggtgagcctgttaatctgcgtgaacaacacgatgctttagaattttttaattcattggtggatagtttagatgaagctttaaaagctttaggacatccagctatgctaagtaaagtcttaggaggttcctttgctgatcagaagatctgccaaggctgcccacataggtaagtactaattacacattgaaagtatatgttgtaccatgtatatactaacagaaataaaatttttactagtacttacatacaaaagtggagtatatcactgattactaaatacctgaaacagaatgatttatatactttgcataccttactgctgtggggcttttttttgtttttgtcagttaacttttagttccttctactctgcctgatctcttagccattttattatattatactcttacagtctctttcttcctttcctttcctttcctttctcctttttcttttcctttctctttttttttctttctttcttttttgaaagagacaaggtttctctttgttgcctaggctggagttcagtggcatggtcgtaactcatagtaactttgaacttgtgggctcaagcaatcctgctgcctcagcctctcaaatagctgggactacaggcatgtgccaccacacctggctaatttgtaaatttttttagagatcgaatctcttgttgcccaagctggtctcaaaactgctgacctcaaaatcagtcgtcacacctcaacttcccaaagtgttgagatgacaggcgtgagccactgcgcctggcctactcttacattcttttacagaagattattcctgaggaaataaaatggcattttgcatatagctacaggtgttatttataaatttgccctttatcttagaacttgagtgattataatagtgtaaatacagtaagtttagaagatgacaaagctatggtagtatttcctatacaaatgaaataatgacttttaaaatagcattgattattgtcattatctttaaggtatatttgtatacaaaacatatcaaacctattgtaaaaaaagattttacccccgtccgggaggtgaggggtgcctctgcccggctgcccctactgggaagtgaggagcccctctgcccggccagccgccccgtccgggaaggaggtgatggggtcagccccccacccggccagccgccccgtccgggagggaggtaggggggtcagccccccgcccagccagctgccccatccgggaggtgaggggtgcctctgcccggccgcccctactgggaagtgaggagcccctctgcccggacagccgccccgtccgggagggaggtgggggggtcagccccccgcccggccagccgccccatccgggaggtgaggggtgcctctgcccggccgcccctactgggaagtgaggagcccctctgcccggccaccaccccgtctgggaggtgtactcaacagctcattgagaacaggccatgatgacaatggcggttttgtggaatagaaaggggggaaaggtggggaaaagattgagaaatcggatggttgccgtgtctgtgtagaaagaggtagacatgggagacttttcattttgttctgtactaagaaaaattcttctgccttaggatcctgttgatctgtgaccttacccccaaccctgtgctctctgaaacatgtgctgtgtccactcagggttgaatggattaagggtggtgcaagatgtgctttgttaaacagatgcttgaaggcagcatgctcgttaagagtcatcgccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgcaagaaacacccaagaatgatcaattaaaaaaaaaaaaaaaagcctaaaaaaataaaaataaaaaaagattttacaagaaaaacattgacaaaacaaattgtttgacttgaaaattgattaagggcttctattagaaatagttaatgagttcattactgataaatatacatgcctgtcatatggaagttttactttgggacttgttataatatggattaatgttgatttgcaatcgtttttcaccaaaatgtcacagtaagatagtattttctacaatccaaactgtattaaatatagtcatgggttgagtacacatgtggtttgtgggggtgttttgtttttgattaccaggaaatgattgggtgagaggtaatactatataaatgagaaatttctagcaagttatagtcttaccactcattcataattagggaatatacttattcacttagcctaggcaacttttagtccttttgaaaggccttttatattaggtgaacaataaaataaaattttaaccttgtttttaattagtgataaaaacagccaactttggggtcatttgttcatgttactcctccttagttttagacaattttctaaattatttggaaatcactggttttctttggcaagtgaaatgtcaaaagattatggtcttgaaatcagatccttatacctgatcaacagctaaactagtcttatttttttaactagctgggcatgggggtggactcctgtagtcccagctgcttgggaggctgagtcaggaggatcgcttgagcccaggagttagaagttccagtgaactgtgatcatgccactacattccagcctgggtgacagagtgagacctcacctcattaaaaacaaaaaagaaagaaactctactttgagtgcccatacaaccattctgtttttcactctcagtacagtattcattgaattacatgaatctttgtgttacaagattttgcccaactgtaggctaatataagtgttctgaacacatttagggtaagctaggctaaagctatgatgtttggtaggttgggtgtattaaatgcattttcagcttatgatattttcaatttatgatgggtttattgggctgtagccatttcataagcaaagagcgtccgtacttgctgcagagaccatatgcttcacaaagcctaagataaatttactatctggccctttacagaaagactttgctgtcctctaatgttagaacaccttctttttatagatgttgaagaatatcctacttttgaagtgtagtctaagatctaacttttttccctctatgggctgttccctgattatatagtaaaaatttgcttaatacctgctttatattccattcatataatttataaatgcctttgtgtaccttttttccggagtttaaaattccttaaataagggactatcttaaacagtgaatatccctcagtacttttacacatagaaagcactctcagtctatccattggatgaattaatggttaataatgtattcctcacatcccttgttttgcatttatgcatgtgtctcaccagaaattggaaagtctctttggtagaaaatgaccataaactgggattctagctccttctcaggttgctaatcctgtactcatttgtgtgtgcaaacttttgctttactaaggcttccattacagaaaaggaagaatatataaaaatttagcttattcgtagtttatcattttcagaacttaataaattcatgctttggcttcagcatgaattactatctaaacagataacactagaagcagcatcgtatactacaaagagattaagctgtgagcccagacagattcaactttaaaataccatttcacctaataatcttgatcaagttaacttttttattgctaacattctatgacttacgggtttcgcattataaaaatggcaaatgtatgggtgcagcaaaccaacatggcacatgtatacatatgtaacaaacctgcacgttgtggacatgtaccctagaacttaaagtataatttaaaaaaaaaaggcaaatgtagtttacattaagtccataactaaaatgtttacaaaactaagggataaatcctttttttaaatcgtttttaggtacgaatgtgaagaatcttttacgaccctaaacgtagacattagaaatcaccaaaatcttcttgattctttggaacagtatgtcaaaggagatttactagaaggtgcaaatgcatatcattgtgaaaaatgcaataaaaaggtacgggctgtccagttttgtttaattttgattacatttaatggatttagaagaaattggtttttttggttcatcctcacaagtcaccctatttttattttctcctactttggtatagtggtagcagagaagtagtcaatatgataactaatagaaggtttggcaaggaaggaaaaaaagtagtgccaaaggggctaggtaaataagataaaaataggtaaataagagtgaataattttaaaagtcataacgtgatagcacattctcttatataagttacacagacactttccatctctaccgagaaacaaattgccattgaacccctcaaagatacagagctgatagaggaaaacatttctcctgtcatgtccaggattacttgtcaagaccaaaacatttgctgaaaccattaattactttattgaaccacataagatttcttttagactagtcaagtggcccataagatttcttttatcacctatgttataaaaccatttattttggaaacttattagcagttctttgagagagatgattcacacgcattatagtaatgaataaggtgtatctttgggagctcccaaaccctttcaccctcaagtcacttgtgttgttttggccttatgcaccacttagagaagtcctgaagtttaaagattgagattgtgggctgtaaagccatactgcctgccacctgcagctcctgagacctgaggcaagttacttgacctctctgtgattactagttttcatcttttaaggttcagtagtacacacttgagaaggttgtaaggattcggtatgtttttacttgtgcggcacttagtatatattacctggcatctgaattacccaacaaatattagctactcttattgttattgtagttctttggtttgtgcataggaaaccaccttcgtgggaacaacagtaaacatcaaacaggtaataatggctagataacaatgacagaaaccagtcaacaatttaccatttgcatattattaatttcagcatttaaatcagctgataggattatcttgattatgctcattgtcatgtatttgtttatacttaaaaattcagataagtcttaatatcatttaaaagtttgcttggggtttttttttttttcctgtggattttaatagaacatctggtaactttgtcttgtttattttaggttgataccgtaaagcgcttgctgattaaaaaattacctcctgttcttgctatacaactaaagcgatttgactatgactgggaaagagaatgtgcaatcaagttcaatgattattttgaatttcctcgagagctggacatggaaccttacacagttgcaggtgtcgcaaagctggaaggggataatgtaaacccagagagtcagttgatacaacagagtgagcagtctgaaagtgagacagcaggaagcacaaaatacagacttgtgggtgtgctcgtacacagtggtcaagcgagtggggggcattattattcttacatcatccaaaggaatggtggagatggtgagagaaatcgctggtataaatttgatgatggtgatgtaacagaatgtaaaatggatgatgacgaagaaatgaaaaaccagtgttttggtggagagtacatgggagaagtgtttgatcacatgatgaagcgtatgtcatacaggcgccagaaaaggtggtggaatgcttatatacttttttatgaacgaatggacacaatagaccaagatgatgagttgataagatatatatcagagcttgctatcaccaccagacctcatcagattattatgccatcagccattgagagaagtgtacggaaacagaacgtacaattcatgcataaccgaatgcagtacagtatggagtattttcagtttatgaaaaaactgcttacatgtaatggcgtttacttaaaccctcctcccggtgagtatcaagagagtttagcttcttagtaataaagaataatttatagtaggcgtcaacatgtttaagttcataaaattaatgttttcactttaaatgagtctaatttgctgggtgtggtggttcacgcctgtaatcccagcactttgggaggccgaggtaggtggatcacctgaggtcaagagttcaataccagcctgaccaacatggtgaaaccccatctctactaaaaatataaaaattagccaggcatggtggcatgcacctgtagtcccagctactccctgtagtcccagctactccggaggctgaggcaggagaatcgcttgaacctgggaggtggaggttgcagtgacccaaattgatggccactgcactccagcctgggtgacagtgagtctccatctcaaaaaaataaaataaaaaaataaatgggtctaaattaaagtagcctgagaagggttcttaacaaatttaggacttctcaaaattaatggaaacacagacttgtttgaaaatggggttggaaaataaaaatgtgtttttatatctgcattttatttatagggcaagatcacctgttgcctgaagcagaagaaatcactatgatcagtattcaacttgctgctaggttcctctttactacaggatttcacacaaagaaagtagtccgtggctctgccagtgattggtacattgctttggattttcattcctattatactaatgtttggtttgcttctttaatagattgctttatgtttttctaaaccaagagaattttgtttgaagtttggaatatagaataaaaactctgggtcacaatagagaaatcatattaaaatagttacttagtctaaacatggccttttgttattcagaagctgacttctgcttctattaccttgtatcatatctttgacatccctgcaccaaagactacaagctgagactgggggacagtgactcacacctgtaatgccagcactttgggaagccagggtgggaggattgcttgagctcgggagttcaggaccagcctaggcaacatagtgagacccccatctcttcaaagaagattttaaaaattacccaagtatggtggcgcacacctgtaatcccagctactcggaaggctgaggtgggaggatcgctggagcctgggaggttgaagctgcagtgagccatgactgtgccactgcactccagcctgggcagcagagcaagaccctgtctcaaacaaaaccaaagattacaagatgagactgaaaagtgtaagctacttatgaaatttattaggttttagcttacctagattgaattctgacaccgattaaaagggtaaaaaattaaaatggttttcttaagtttctaattgtgaaagtatagaggccattatgatacattgatttaataatttttacttactcatttcaggaatatgtcaagataagggggtggtattttgtcattgaatctaggaagagtttgttaatggatttttagaggacaagctttcacctgtttggtaactctgagagaatagaccaagtcatagtatttatctattgttttaatattagaagcaacctttgctggttctctccagcagtagaggaagatctttgtcttttttttttggttcaatgagactcatccttttactatagagaacaagttattgacttaatagtcataggtttttttgttttattttaggtatgatgcattgtgtattctccttcgtcacagcaagaatgtacgtttttggtttgctcataacgtcctttttaatgtttcaaatcgcttctccgaataccttctggagtgccctagtgcagaagtgaggggtgcgtttgcaaaacttatagtctttattgcacatttttccttgcaagatgggccatgtccttcaccttttgcctctcctggaccttctagtcaggtaattgcacagctttctttctaaatgatgagatgtttacaaataaattgtgtttcctggaagtcgaagtcacaagcatatgtgcatccacttgatatgtttacctaacagaaacacacaatatgatgtcagtgagttccatttaatattactgcatggcaatgaatagtaattattggctctttaaaaatgtaagagaattttctctgttcggttacatgcagtagcttaattataagtttactgttaagtagattttttcctattttgaaggttttttaaatagtcttagatttttttaaaaaattacaagtgtaaaaaattataatgaaatccgcctctgatcttcattccctttcccaagaagcaaaatagtttagtttgtgtgatcagtccttccataaatgtatgcctgtatcagcatatgtgcatgtcctttttatgcaagtagaagtatacatataccttgttgctgtaaaacaggtaatgttttatcctttacaggcttatgacaacttaagcttgagtgatcacttactaagagcagtactaaatctcttgagaagggaagtttcagagcatgggcgtcatttacagcagtatttcaacctgtttgtaatgtatgccaatttaggtaagaatttaagtttttcagaattctgttttgatgtatcatattaaattgtgaagtcatttaggtcaagtgatgaaatataatctgatctgaagtagaaacaatttcccataaaacctgttgtgaattttatctgaacatggcactttcaccttttactttgtttatgcatgtgtctttgtggtagacacaggtcagaatctgtgttttgatttttttttttttttaatctcctaatgcagtggtgccaaatctggctgcttttggaaaatactggtttctaggcctcttctcacactgattgaatcagcatccccaaagctaatgtcagggaatccatgttttcaaaggggtccccaaatggttgtgatactcaccaaatttagatagcagacttggtctgtacataagtttttgtttaagtaaactacaattatggataatataaatactcgcttaaaatattaatttaggggccgggcacaatggcttatgcctgtactcccagcactttgggaggccaaggcaagaggattgcttgagcccaggagactaacctaggcaccatagggagaccctatctctacaaaataaaattttaaaattagctggatgtagtggcatatgcctgtagtcctagctacttgggaggctgaggtgggagaatcacttgagctaaggaggttgaggctgcagtgacccgtgattgcaccactgcactccagcctgggcaacagaatgagaccctgtctccaaaaagcaaacaaaccaaaaagtcatatatccaaaatgaagttctatatccaggcgtacctgtcgtttcaggttttttttctgtgatcttacttaatcaccattggatccatggcccttttaacataagggagattgtacttttcatttgtctatttagtttgtcttcttttcccttgtcttttccgtaattgcagatatttgggtatttgtagatgagaaagagaatatttattacacagacaagcataagtggaatctgtatttcaaacttaaaaatgccaaatttagacattcagaagaatcctattctgttcaactcttttagatattgcctgttcacaaagcacacatcattgttccataatgtaacctacttgtaaaattttcctgctgaaaacaaatactgtagggcctgtaaaccttaatatgaagtccttaagatcagatatgcattgggattgagaattgtttggatttaagaaaagcaaggcagtgcatataccaacatctctatagcagggtctgagacaacaacttacaattgaacacattaatatttctacagtaaaatatgaatatttatactgaagggagaaataaagactataagtagcctttagtcagtttgggctaggttatcccaccaaccacattttgacagcaacttaatgaaaaactttgttgggctgggcgaggtggctcatgcctgtaatcccagcactttgggaggccgaggcaggcggatcacctgaggtatggagttcaagaccagcctggcaaacatggcgaaaccccatctctacttaaaaatacaaaaattagcagggcgtggtggcgggcatctgtagtcccagctattcgggaggctgaggcttgaatctgggaggcagaggttgcaatgagccaagatcgcgccactgcactccagcctgggcaacagggcaagactccgtctcaaaaaaaaaaaaaaaacttgttataataatagcttttgggccaggcgcggtggctcacgtctgtaatcccagcactttgggaggccgaggcaggcagatcacaaggtcaggagttcaagaccagcctgaccaacatggtgaaaccccgtctctactaaatatacaaaaattagccgggcgtggtggcacatgcgtgtaatcccagctactcaggaggctgaggcagaagaatcgcttgaacccagaaggcggaggttgcagtgagctgagatcacaccactgcactccagcctgggagacaaagcgagactccatcttaaaaaaaattaaaaattaaaatagcttttggaatcttaggatttcagataagaggttgtggacctgtttttattatgtttttgggaatatggcaataaataagattgtctaatgggatatagaagcaaataatgtagttgccataaaatatgttaatagctataatagggaaaatgcaaagtgcatcacggggggcatggtacctgaagggatttggggagtgcagaagacttaatggggaatgtaacgtgggaattggttagttgagctttccatctagagtgtgaacagcagatgcaaagacttgataaacttggcgtggcttattggatgggatgaaaattgtccagtctgactagaattgatgtaagatgggaatggcaggagtttctgatcatgcagttctaataggccttgtgagagagactgaggcattggatgagccattgtagggttttgaacagataataccatctagaaagagcactgtggccacagtgtggaatgtattgcagtggagtaagatcccagagagtgttaaaatgatctatagacataagatcattgtgacctgtactggagaactggcagtgagggagatacaagtggacagatagatatatggtgctttttataagaagtggaatcagtggatttggtgatgggatattcagagaaggaggggacagggaagagatgtgaagaatgatgcccaaaattctaacatgaacaactgtgagtggatagtggtaccatttactgaggggaaacacaggaggagaaacatgtatgtatgggaagaaaggggtgagttcagtttgggtagattgagtttgagcctgtgtgacacccaaatggagatatacagtagaacagtaagtaatttgtcttgaaatgtttttgaatcatctgaatgaagatatctagaacattaaagccgtgagcgtgggctagatcatccagggaaatcagtgtgagaagatagcctggcatgggaacttggagaaacatcagtttttaagagacaaggaggagtcgcaaataagaacaaaaagaggtagaaagaaaatcaggaatccagggaggaagaagtggttatggtttgagaactgctccttagcttattactgtgaagaggggccaaaaccaaattggcatgagttgaggaatagaaaatgagaaagtagagagaccaaatgtaggtatctttttcaagaagtttggctgtagaggaaagaagagaggcaggcaatttataaaagagtttttgcttctcatttaatgtagttattttgttgttttcatcctccttacaaatgagggttgcagtgttggttagtccctttagactctccaggctgtagaaagtgttcgtcttctggtcgggcgtggtggctcataatcccagcactgtggaaggccaaggcgggcagatcatgaggtcaagatatcgagaccacccaggccaacatggtgaaaccccgtctctactaaaaatacaaaaattagctgggcatggtacgtgcctgtagtccagctactggggaggctcaggcaggagaattgcttgaacccgggaggcagaggttgcagtgagctgagatcatgctactgcactccatcctggcgagagagcgagactgtctcaaaaaagaaagaaagtgttcatcttccttacagtgagccggtgtgattggaatgtcatagtcatagtcactgttgaacaatgttaatacttatactcaatgggtgagttttcttttctagtaaaataattctctgaatgctaagtaaaagtgataaaattacaaatcaaaatttttctgatcataaaaattatagacaagatattttgtataactacttgttttattcatgaagcccttgccatcttaattttttcctcatatttttctccctctctttcttctccccttcactcctttttgttgtaggtgtggcagagaagacacagcttctgaaattgagtgtacctgctacttttatgcttgtgtctttagatgaaggtccaggtcctccaatcaaataccagtatgctgaattaggcaaattatactcagtagtgtcacagctgatccgctgttgcaatgtctcttcaagaatgcagtcttcaatcaatggtaaatttgaatgctccattctttacactagttttgtttgtttgtttgttttgagacagagttttgctgttgttgcccaggctggagtgcaatggcgtgatctcggctcactgtaacctccgcctccctggtttaagccattctcctgcctcagcctcccaagtagctgggattacaggtgcccaccaccacgcccggctaattttgtatttttagcagagacggggtttcgccatgttggtcatgctggtctcgaactcctgacctcaggtgatctgccgtcctcggcctcccaaagtgctgggattacaggtgtgagccaccatgcccagccctctttacggtagtttttaaatgctgctgggcatatatagtactaagagtctggaggaagatttttgctttggaatattttagccctgtaccttttttacgtgtttaatgggggtcttttttctgtctccttgtgactgaggttgataccatgtttatgaaatagtttaagaattaactttttaggctgggctcagtggctcatgcctgtaatccctatgctttgggggaggccaaggcaggagaatcacttgagctgaagagtttgagcctgggcaacatagcgagacttcatctctactaaaaattaacaacaaaaaagttggctgggtgtggtggtgtgcacctgttgtcccagctactcaggagactgaagtgggagaatcacttcagcccaggagatcaaggctgcagtgagctgtggtcatgccactgcactccagcctaggtgacacagtgagaccctgtgtccaaaaaaaaaattaactttttatatttagattttgtatttttatatcttggtatatctatctgatcattataatgcataatgttactttcttcgttgtgcttaggtaacttgatttaaaatgttatttctctaaaataaaacatttggccagacatagtggctcatgcctgtaatcctagcattttgggaggccgaggtgggtgggtcacttgaggtcaagagttcaagaccagcctggcaaacatggcaaaaccccgtctctacaaaaatacaaaaaaattagccaggcgtggtgacgtgcacctgtagtcccagctactcggaaggctgaggcaggagaatcacttgaacctgggaggtggcggttgcagtgagctgagatcgccccattgcactccagcctgggcgacagagcgagactccatcttaaaaaaaataaaaaaaaattataggctattttctatcgtgaaagttgtgtattattattgtgaagaagcttattagttttttattggtgacaaatctgtattctaggtaatcctcctcttcccaatccttttggtgatcctaatttatcacaacctataatgccaattcagcagaatgtggcagacattttatttgtgagaacaagttatgtgaagaaaatcattgaagactgcagtaattcagaggaaaccgtcaaattgcttcgtttttgctgctgggagaatcctcagttctcatctactgtcctcagtgaacttctctggcaggtaaaaggaaaataacatttgtatgtttataatttgatttgttattcctttcattaagttactcaccatgtcttacttgtttttaggttgcatattcctatacctatgaactgcggccctatttggatctgcttttgcaaatcttactgattgaggactcctggcaaactcacaggtggatactctttttgtgactggaaacaattaggcttgcccaggtgttagagttaactgaaattgacagtcaccacattttttttaacctattggagttctagtgaatgttttatcttaaacctaggacaagggtaaataacaggttctccccttttcctcagaattttatttccttttttattcttttttctcactgcctaagtttcatacttaataagcctgtttctttagaatgacttttttaattaaggaggagctagcttgggcatttggtaaatatttgaatttcattaatgatgcccgaggattattttatgattatattacatttgttttagaattagtcacttgaagcaacttagtcattagtcacatgaagtataatagtatatgtaaaaagtcttcaggtaagtacggtttccatttttcatggtacttatattctgtaaagtcaccacagacactgagttagcaaatactgaaccattactcctaggaggaaatacagaattaggtttctataagcctctgtttacatttttatcaaccagtcaatacataaccttgttgtatgtgtgtttctacttaaagtcatttaatatattttgttgactcataaagttcacagccaacagctctgtaacttaagcctgaacttaagcttctcaatgcattctgcataaggcacatcacagccttcttgtggttaggaacattagatagcacttcaacattatatacttgggtcattttaaacataaaaataaccagcaaaagcacaaatatgtggaaaatgtggcactaaatacaccatgaagaaggacacttgtttacagtttaagctgaaacaagagagaatgacactcttctggacttcagctaggaacgtttgtgttggacaacttgatatttttgctgctctgtatatgtccacagatgacgaagaaagcaccttgatgattgattttgcagttataaataaagtttaggaagtaagcgaattcacaaatgtggaattcatgaataatgaggggatcaattataattagtttttatgagaacttttagaatgttaacttttttcccccgtaaaaactaaggttatccagcttaactggccctcaaactttcactagaatttttctatttgtttttgggggtttttttgtagtaaaagttgaatatattatctttaatcccaagagttatataatagatgataaattatggtattagttgacagcactgccaggttttagaacttcccttcccacatggaagatagtataatagtttgtttgggaaaacaattcaaagtctatgtcgcagtttgcctcccatctgccaaggtaataaaacaaacttaaaaacaagttctgtaacaacaaaatgcttaaagagaagtaacaatctggagttttagtggggattgcgaaagccagaatttgcaacttagtattttcaaattatctccaaatttaccataatagatttcaaacaaatactgtaaaaatagcattaaaccaaaaatcaattttcgtgagacacaaaagatagtagctcagaattatagtcgtttattcaggcagtattcagtgcccttctaaatatgttcataggatttgaaagcttccttcagagtagattttaatgaaatctaacttttactattttcttttttaaaaatgctgtatttctgggcacagtggcttacccctgtaataagcactttgggaggccaaggcaggagaattgcttgagaccaggagttcaaggccagcttgaccaacatagcaagatcttgcctctatttttttaaaaaagaaagtactgtaagcacttacagttttaaaccagttaatcacatcttagctcttgtttgattagagcaagtgataatggcaaagacatacgtgctagattaaatgtgggaattacacttttgtgtaatgagattagtaagatactgttaaatgaatcactggcccaaacgtgaaaataattttctcataatgagcttttagttcattcagtaaacaatgttcaaatatttatagagtgtctaccatgtgcccagcactgcttggcatcaggtaataaggcaagtgaagatagtattaataaaaatggcatttgagagcagttgatgctaatggggagaaaatatgatatggcagaaataatgatttagcacttcattgttacttgaaaaaactgaaggtaaaagcaatttatatgtagtgtttcagatgaaacagcaagagggcctgaacatggttgatttgtctgaaatgattaagctttgcaaaattgttgaagtaatctgttttgtttggaaatcatgaatgcatttgatggaggaaaaaaatcttactttgactttaaacatactgttaagtaaaatacatagtgtatattagaatctttaaattctcagtgtccaggttatgttttctaattgaggtaaaatttacataacaaaactcaccatttcaaagtatacaattcagtgacttttagtacattcacaatgttgtatagccattaccactatctgattccagaacttttttttttttgagagggagtctcactctgtcacccaggctggagtgcagtggcgcgatctcggctcactgcaagctccgcctcccgggtttacgccattctcctgtctcagcctcccgagtagctgggactacaggtgcccgccaccatgcctggctaattatttgtatttttagtagagacggggtttcaccgtgttagtcaggatggtctcgatctcctgacctcgtgatccgcccacctcggcctcccgaagtgctgggattacagatgtgagccaccgtgcccatcccagaacatttttttttattaccccaaaaggaaacccctacccaattaagcagtcactcaccattccttctaaccctggcaaccactaatctgttctctgtctctgtggatttgcctcttccagacatttggtaaaaacgaaatcatgcaatttgtgtgtctgacttctttcacttagcttaatgttttcagagtccatccatgttatagcatgtatcattactttatagctgaataatattttgttttatggatatatatacaccacattttatttactggcacataatctttttaacacaaaagaaacaaggcatgtttgtgcccctacaatcatgttttaagttagttagttcagggaaagacaggactagttggctttgtattattactctgttgtagtttgggagaaactgaaatgaaatcctgtgttattggcaaatcagccaaattgtactattgcctgtcaaaatgctttgcctgccatgtattctcattattagaattcaaatactgtacctccaaattatgtcactgaatcctaacttgccttcagagatgcagttttataaaaggtattgatgtgtagcaaattaccctcaactacagcagtcataaacttagttataacttttttaaagtttgcattactctcgagtgtcctgaattcacttcaggtaatgtgtttaaattacatatatggcagaattattttggactggtaataagttagtaagagcacagactctggagtcacactgctccgcagctatatgacctcggcaagctgtgtaactctgtgccaattttctcacctgttaaaagttttaataataaggccaggcgcagtggctcatgcctgtaatcccagcactttgggaggccgaggcaggcggatcacgaggtcaggagattgagaccatcctggctaacacggtgaaaccccgtctctactaaaaatacaaaaaattagctgggcgtggtggcacgtgcctgtagttgggctgaggcaggagagaggcgtgaacctgggaggcaggacttgaagtaagccgagatggcgccactgcactccagcccaggccgtctcaaaaaaaataaataaataaaaaataaaggtttaataatagtacctattgtctaatgttagattaaatgactaaaagacattattgagtggcacatagtaggcactcagtatatattagctattagattttagatgtttttattttatatctggttctctttcagaattcataatgcactgaaaggaattccagatgaccgagatgggctgtttgacacaatccagcgctctaagaatcactatcaaaaaagagcataccagtgtataaaatgtatggtagctctatttagtaactgtcctgttgcttaccaaatcctgcaggtgaggatttttttcttataattttgtagaaatcttaatcagaattaaggattctgttttaaaagaagagaatcatgagaacttggggttgtcattttaagttaactttgaagtattccaaatcctcttatctatatggttttattttcttttgcagggcaatggagatcttaaaagaaagtggacctgggcagtggaatggcttggagatgaacttgaaagaagaccatatactggcaatcctcagtacacttacaacaattggtctcccccagtgcaaagcaatgaaacgtccaatggttatttcttggagagatcacatagtgctaggatgacacttgcaaaagcttgtgaactctgtccagaggaggtaaaaaaagccaccagtgtgcagcagatagaaatggaagagagcaaagtaattctttattttataggccagtgtttatgtattaatgatattattaaaagattatgttgaagttttgggttttgaaaaatgtttattcggctgggcatggtggctcacgcctgtaatcccaacactttgggaggccgaggcaggcggatcacctgaggtcaggagttcaagaccagcctggccaacaaggtgaaatcccatctccactaaaaatagaaaaattagtcgggcgtggtggcaggcgcctgtaatctcagctacttgggaggctgaggctggagaatgacttgaacccaggaggcacagattgcagtgagcggagatcgtgccagtgggctccagcttgggtgacaagagtgaaactccatctcaaaaaaagaaaagaaaagaatgtttattctatgtcattttaagctaatgaagggagctttcttttggagaaatttctgtgaaattgcctgaaatgtagtagttctgagagaatgcaaatcaggttttttgttttgttttttttttttttgttttttccccaagttctttatctgcagtaaaagaaaagttgctaatgggtcagttttgtagatttttaaaatttatttcaaatagaaaaagttaaaagtaaacttgagtttgcctacgtaattttttatcttgaaatattcaaaattaggagccagatgaccaagatgctccagatgaacatgagtcgcctccacctgaagatgccccattgtacccccattcacctggatctcagtatcaacaggtaaacaggagtcagtttatgcttttatcccctagaactgggttttatgcttaattttagaggatggctcaattgtttgttgtgactacaaagtaagaagtaggattatctagactagctttgggagcatgatccagaagagggatggtttggagtgggggtcatggtgtaacatgtttgaacttaaccactgtagggttttccttgtcaagaaggtgtccttcttgtgctagtagttaataaaactgtatgagaatttatatcaacataaaatgatcattgtttagtgcaaaggattgtggtgacatttccggtgaggtaaaatcttcacctggattccaaaaacattattaagatatggcaatgaagtaagaagtccttggttacttagccacaggtttcagtgatggtaaaaatcactggaaaaaaaaggatttgggtagatttccataggtgattaaagtaaataaactagtaaatagcaaaagaaatgagatgaagaaacattctaaatgataactttttctttctgaaaccaaaatgtgactaaatcagctcttgtgaggcagtggtactcaaacttgcacaggcgtgagtctccctggaagggttgctccagcagagagctagatgctaccctaaagtgtcttatttcataggtcttcaaggggctggaaaatgtacatttctagcaagttcccaagtgatgctgctggtggtccaggaaccatacttggagaaacatttcaggcattctttcttacatttcactgtgtacatagaagcaaactgaatagttaggaagtacacattcagcgtacttattttcatctatagaaagtaaagcctggccaggcgcggtagctcatgcctgtaatcccaacactttggaaggctgaggcaggtggatcacctgaggtcaggagtttgagaccagcctgaccaacatggagaagccctgtctctactaaaaatacaaaattagccgggtatggtggtggcgcatgcctgtaatcccagctactcaggaggctgaggcaagagaatctcttgaacccaggaggcagaggtggtggtgagtcgagatagcaccattgcactccagcctgggcaacaagagcgaaactcccatctcaaaaaaaaaaaaaaaaaagttaagcctaaaatcttggcttggctgatggagcatgtacagaaaaatgagagcactgtagggttcagacattttaaaaggttaaggaaccaaatccacaaggaaggttaacttcctttgaccctgagaaagctcttatgttaatcatgcctggttactttatcatcttgaacattgttctgtttttaatcagcattattgtgagttcagggttactgctcctatatatcttacatcatggttagtcaatcggatttagcatgtggaagagtcaatagatgctcatagatcattctctgaaaattttttaccaagagcaacagtgggttaatcctttatttgccagacttgagtctaaataatttttggcactaaaaatcactttggccaaagatttatgtggacctacacaatcactgctcttattcagggttttggggtttgcatttacactacgtttttcaagcctttttttgtttttgtttttgtttttgttttgcactatagtagtccaagggtatttacagagtaagtcccaagaataagagtatacatttccagagacttcagaccatgattttgaagttgttttactatgtgaaaagttttaacatacagatcttttctcctttcccagaataaccatgtgcatggacagccatatacaggcccagcagcacatcacatgaacaaccctcagagaactggccaacgagcacaagaaaattatgaaggcagtgaagaagtatccccacctcaaaccaaggatcaatgaaatgcacataattaactggttccatcaagactgtgcacccaggccttacagtccaacctttttctgtgtctggctaatatttaaaactagaaaaactattcctaatcaacatggagtggagagtttattcactgtcttatctgcagaaatttgctgtcaatatataacccgcctgcagtggaaagtgtatagtgttttgtaataaatggcctgatgctaatgtgtaaatggcaaaggtgtatatagtatattaatgttgactgttaattcttaagcaagaaacttttttcttgatgagactcacagatctacacaaactacaaaagttaattttcttgttacacccactgcactctgcaaccagtgttgcctgcctcatggcagttggatcagctcctttacaaaaaagaaaaaaaaaaaaccaacagcaacaaaacagagcccatccatgtcagccacaccaatagtttcatgttaattctttgccactggagtcaattttgctatgagcaatgtaaggctggtaacctttaaattatttggttgatgtggaaaattggtgatgtaacactgtttctagatttttttcattgcctttttattctgatattaggttaatcactttgaagctatagttatgctgtaacatttagcatggcttcacaccaagttagtgtagccaatgaggaaaaagttaccataatgacagcagttgtccgagaagtgacagctgtattactcagagcttttacttcttacacctagaatattaaaatataaaacaaggggagaaatgtgacagtctattttcagttgcacatatgttccttatatataatgtttgacagttcaatctctgggtggaataaagaacacttacgtatcagtaatgggaatttttaaagatttaaaacaaatatgcaaaaatttgctatgccaagatgctggagcataatataagactgtatttggtgtgcttgttttgtttctttggtagagtttattaggtgaatcttctaaaactttccttctgttggatcccagtgacgtggaagtcatcagaaccccacggtacttggagtacctctctgcaccaagatagctggctgattttctgctcagtcacaattttacttgaaagcaagaattgtcctagctccttttccattattccaaaacgtttaacgttcaaagcagggtctcattaaaaaagaaactactggttgatataattgagatattacaatttcagaataaacatttgattaaaaataaggaaatcctcagttcatactgtatttaaaagagaattggtaacttgaatgtgtgtaattttttggaacctgtctaaaaaccaaatacccctgcaaacagatacagcccaccctattctatttaaatattttgctgttttattttatagaaattattttgctgaattcacaaatagaatttgatttaagaagaactttttgtcctgtggtgtgtttttggttttttttttggttactttttttgtcctttttttttttttttaaaagaggactgcatattaaaattcattctgtgcatagcatgcctaggcatgacactgattcaggatttcagtcacatcaagtttttgtgcacagaaagatttgacctttggccctctactgaagattttgagaaatcaggatgttgacactgtaaaagtttcctaacataatcttgtactttttgtatgttttttatatacatgtatatttaatgagcacaagcttggttgtattttttacaattcagttaatagggaaatgttttgtcaaaaggctacacttggaactgaacaaagcagaaacaaaattgagcattgcattattttgtgattaaaaggggcaggtatttaagataaagctttgggtatcttatttgtagtactgtatagtcaacctgtgcttctaggtgttcctgtaggacattttgacaccgatactttgagtgaaagtcacacacggtgtttgcaattccaactgatttttgttttgtttttatttttttgttgttttcttctttgagatggagtcttgctctgtcacccaggctggagtgcagtggcacaatcttggctcactgcaacgtcgcctcctgggttcaagcgattcttccgcctcagcctcccgagtagctgggattagaggtgcccaccaccacgcccagctaatttttgtatttttgtagagacagggtttcaccacgttggccaggctggtcttgaactcctgacctcaggtgatctggccgcctcggcctcccaaagtgctgggattgcaggtgtgagccaccgcgcctggccccagttgatagtttttttaatttaaaagttcctcaattccaagctctttaaacgagtgaaataggttaactttatttggatgagttaggtgtaccatctcaccatctgagaggagatttatatatttcctgctgctccttaacaaaatatgtaatgtacttaaaaactttaacgacttcctagttgagagaaaacttgacatataaaaggctgtgaatttttctgcttggaggaagagcccaaccttggttgctttgaagttacaagcccccttgtgccaggtgaggggcttgtgagtcatttttgtctccatttgaggaagagtggtattcgttgtgactaggagcaagggaaagtggagttatttttgtttgtgcaaattattttctatatttaactcaagcattaatgtataaccagaaatttaaagatgcatgttgttgcaagagcaacataatggtgattttgaggtctttttctgaacacaagtggcacattttaaatttcaagtcttcaaagtgcctaaggattatttagttctccctcaactgattttttgagccatatatttcctattttaaatgtttgcggaatcgccagtcttcctttgaaagaaacagcccccagaattctaaatgacacgattatagaagacagtagaatgtgttaccataaagactgaagatattttagttgtaaaaccatgtgaacaagggcttttgccctattgtatctaagtatttcagtgcacaacttgttaaaccatgttgctgctgtttctaagccctccaccaactgaactttcatgtttagcattgtagaggcagaaataacatactaggttttttttttctttcattgatttttctcctggtgataatttcccagccttgtgtcttttagctgttgtgtatacaaatttagaattaaaatgttttctatttttttcatgattaacttagtgaataacttaaatccttaatcctcgtagtggttagaaagatgaggagacttttttgacttacatttgtaaatgaaaacaagtctgtgaatattcagatgactacttcgaagtaattcagtttttttattagtatttttccagcttatgttttcccatgagctattttactttgctgaattttgtgggtaatttggtggatatatcctgccttatttaggattatagctggataagaaaattgccttttcattgtaagtgcccagttttggtctctagtttgaaggtactacatactgccgataaaggaaaacactcccctacaccccagtttttgtgttaccaagaaaaaaaaaacagtattggtttcatagtaggactcaaccagaattggtcctacatatatgtgagtgttcagtttttgcaaataaggtttttgagtgtgataaaacactacagaagtgctaagtgtattgagaatttgctgctgattgtatttataacaattacttgacgtttgcagaaatttagcactttccctccaaatttataggtgtaagagaagcgggggcaaggtgcaccacattttaaaactgcaaatgtgtgaaaatttatttagagattcagattcctaaaaggaaatttcaccacccaagtcatgcacttcttagccttttacaagccaacagactgacatgaagattgttcacagttcctaagatttagcacatatacaaaaataaaactttataaattcaa

SEQ ID NO: 1597 - DNA, 150946 bp, Homo sapiens; identical to SEQ ID NO: 1596

SEQ ID NO: 1598 - DNA, 17441 bp, Homo sapiens
ctcataacgtcacactgggtccggttcctgcagtgctccttttactcacatcattggcctcctctctgccatcacaggcccctctcacattggcctgcacattttcactacttttttccctcctgcccacaaattgccttgtatcttctgccttcaaagactttctggcccctggtttccactcatccatcatgtgttcttagttcaccttcacagttgactttcttatcttggttaccagggccttctctgccatgagtccttgctccccacatctcctttctggctcactctcaccactgtgtttctgccttcccagccctttgcatgactgaatttcatgttcttgtgggactgtcttctgccctcacaacttgccttttccatgcttttcctggagcaggaaggcccaggatcctgttcctatatctgtgtctcactctgtctctggacaccttctctcatagtattgtcttctcgccaaacttggtcatctccatttatcccactgattcatttttcttttatctgctatcaccaatcactcttcctcatcctccttagacttcactgtatctccgactaacactaactcggactcaaacagggcactgcaacttgatgaacactgtcccagagagtttatctccagataattctattgattggtcttgaatttcccaataacctggaaattgattgtctacttcagccatctcctggcggctggtggctgccacgaacttgtcccattcctcttgctcaagctgggatatcaaacaagagctttgttctcttcatcagaggcctcttcctaagaagaccccagagacagacatatggatgcctgtagcctctgtctcctcagcactgaagtctaggaacttctatatgcatatgtcaaaaaagattggatttctagatttgagaggagaaagaaaataatgagatatcattcccaaaacatttgaggcaaaactactgaatggattattatgggaccatcctagaatcacttgctagactccatcttagaatcacatgagaagtaaaccacacccccacgtccttctgtgaacgggatgtaaaccagagcactgacacagctccagcagggtctgaatcctaagaacttggtgaaccattagcagcatgaacgatgtcaagtattctagtgtccatccctctacccagcaagtcctggaggattattgttcctggaagtatttctgtgttttaaaatagcttagtttgaaaattagttcaacaagactgggtgcggtggctcatgcctgtaatcctagcgctttgggaggcggaggcgggcagatcacgaggtcgggagactgagaccctcctggctaacacggtgaaaccccgtctgtactaaaaatacaaaaacttagctgggcgttgtggcacgcacctataatgatgatggccgtaatgagcagaaaccccgtagtagtccaggcaattatgtcagagagacaacctactgcatatgttctaagacaggttttcccccagtgctaacgttttggaattggaaacgtcttatcaatgacttgcagtagtttaattggcaactttatttttgctttctaattgatattaatcttacaccttataattgaaaggaccttagattcaataaaagaagtaaatatttatcttgtttaagctagttttgcttctcagtcacctacagctgaattcacttagcatattaagttatatagctgtttgctggaaaatagtaattaggcatacaagtgagataatagctttcttgcatgaattacctttgtactatgttaaaaacaatcagttgactatatttgcctgggtctattttgagccttcttttcagtttcactcatctatatatctctcctttgacaattctacccaatcttaacgaacttagctttacagtaagacctgaaattgaatagtgtaagtcttccattctgcttgctttgggtttagcttgctcttctttttctgtttttttttctttaagtagatgcttgcattataaattctacattatctccttttcaaatataagcattcaatattatacatttccctctaaactctgcttaagctaaaatccattagttttgatgctttatattgttatttttattcaactcagaatacgttttaaaaatttcccctgattcttcctctttggcctatacattatttaaaagtctgttgtttaacttctaaatatttaggcattttccaagtatctttcttttattaatttctagtttaattttattatgatttgagatatacattttgtatgatatttatattttccacatttgtaaatattttcagatttttatgtccccaaatatgatccacatgaacattcatgtgcacttggaaagaatgtacattccctgtcgtatagagtttccaataatgtcaattaaatctagttggttgttattgttgtttagttcttctgtttccttactattttttttttgtctattagtttaattagttacttaaagaggtgtttacatctccagctacatttgtgagtttgtccatttcccctttcagttctgcagtctttcccttggtgcatgcacgtttataattgacccttgttatgggctgtggggcccagagagtggaatattatgggctgaattgtactactccaaaattcatattttgaagtcctaatcgccactatctcagaatgtgactgtatatggagacacaacctttaaagatgtaattaacttacagtgaggccattgcggtgggccctaatccaatctgataatgtccttacaagaagaaatttggatacacagagacatcagagatgtacacacattgaagaaatgccatttgaaggtacagcaaaaaggtgatcagctgaaaaccaaggagagatgcctcagaagaaaccaaacctgccaacaaccttgatcttggacttctaggctttagctgtgaaaaataagtttctgttgctttagctacctagtctgtgatactttattgaaacagccctagcatattaatacaactcctttattattatggaatgtccctccttgttctcaagagtgtcttgggtttttttgtgtgtgtcttttcatatacctcttacatgtttgttgaaagttgtacatcttcatcttgtgtaggacagtgggaattgagttaaaatgcttttgtacttggaaatgtgcacacaggtccttctcctaggtctttaatgtgggctttgagttaatcattaagagttagagccaggtgcggtggctcatgcctgtaatagcaactgttcatgagggtgccgtgggaggaacccttgagaccaggagtttgagaacagcctaggctgggcgtgttggctcacgcttgtaatcccagtactttgggaggctgaggcgggcagatcacaaggtcaggagatcgagaccatcctggctaacatggagaaaccccgtctctactaaaaatacaaaaaattagctgggcgtggtggcgggcgcctgtagtcccagctactggggaggctgaggcaggagaatggcgtgaacccgggaagtggagcttgcagtgagccgagattgcatcactgcactccagcctgggcgaaagagcgagactttgtctcaaaaacaaaaacaaaacaaaaagaaagagaacagcctgggcaacatagcaagatgcccatctctaaataaataaataagcagagcgtggtggtgcatggccttctggaggctggaggggtggatcccttgagcccaggagttcaagtgggctataatcacatcactgcagacagcctgggtgagaaagagtgagatcctgtctctaaaaatacaaccaaactaaaaagagttggtttgggtttgtgatttgttcttgctgtgattatcctcattgtttcacacactttaaattcctgtaatgacagctggtgtttaatctggagatttgtttgccagaaaaatgtcttcttcatcctgggcattttagtttccattttcacagtgccttggagaagattacttggcacattcttatttctcttctgtctctcttccagcagcattctcttttactccttttctgaaaatgttatcttggtagtgcaaggcagtgagtggaaggggtgatggctgttctcactatgactcagtcttaggcactgagtgagtgcctgtaatgttagtgcctggcctgctcaggtctctgcccctaccctggatatagtcgttggtccagtgtgtattcctgcccctcttacaggagcagattttgtgtcttggcactttctcccacctgcaacgatgttcccccagttccctaagggcagagatgtttgttgcccttctccccagcacacacagtaggtcttttagtttattgtgtagatagcagataggggagaaggtactctgtggaatttcatgccacctctgtatttttttttttttttttgagatggagtttcgctcttgttgcccaggctggagtgcggtggctgcgattatggctcactgcaacctccgcctcccaggttcaagcgattctcctgccttagcctcccgagtagctgggattacaggcatcaccaccacacccggctaattttgtattttttagtagagacggggtttctccatgttggtcaggctggtctcgaactcccgacctcaggtcatctgaccacgttggccccccaagtgctgggattacaggtgtgagccaccgcgcccagccgccacctctgtattatcactgttttctctctccaggtctgcatcacaatggacatgaagaatttctgcttctctccagtcatttctgtgagagtctggtggagtttgtagagaaatagcctgggagaggtggtgggattttctaatttctgcagaccccaggagcttcacactgttctgccaccctacacttatccctaatccatctttcaattatcctggctgaattcttactggtatctggtgttggatttgtctatcctaaataagcaaggatgtgtttcctctctctcgcatgtgcctgtcaccatagattttggccagctggttgttctacagagttcattcttcaatggatttgaaaatgttgagaagttaatttggctattttccattatagaaggggtagcagcatttctttgagatatctgcaacatggaaatgaaagccacacatctcccttacttctttttatgcctctttccctgcccctctgccctccttctcctttttccttcatacttcttattttatttgccatatgatgacacttggataccctagatggactaataatccttttttttttccattttaactttaacttacttgagaacttgagaataatcgctagaaaatgattttatatttattggagtaaatgttcttctgtaacatattttatctgttttttacttttcttttttgggagatgtttagaaagggacatgcttatgcataaatcatacactaattccttttagagtcttgtttattcttgaaagggaacaattgtgtctgactcatatatttacttaggaatgatgtgaagaggtaaagcttaaactggaggaagtaagtttccgttaaaatgtgttgtcttagatcaccgttctcctaaatctggtttactgtttgctgagagacatgtttttctgcattttcacatttttccctttgactgtgagcaggagatatatgagattcttagtgaagtcattcattgcgcaatggctccaagctattatttattgttgattctttagacaacactctttttagatgctttttagttactccctgcttcctctttcttgttcattaaaatttgctctagaagaacaaacaaaggtctcttatcaattcctaattccatccttgatttggctcatagtttgctgcgcctgacagagccttacagtttgacatttggggtaacactagtttcactgaagatattaatagtttacttctcttttagtttttcttggtgtggatttctgtgacactcaagagggactttttccctcagatgtctcaacagctgcccttttctaagttctttcagatggcgcatgttcaaccaggtttgtaaagcactgctagccacagggtttgcagaaactgagctactgacatagcttgtgattctaacatactgagccccatgagaacccttatttaatatttgtaatttaacatgtacattgaccttatcactgagaaggtttaaaatagtgtccaacctccattcagcaaaacttcaatttaaattaaggcagagttagctaaatgttagctatcctctggaaatactaaatctaagtaagagatactgttctgccttccctttctcacaaaatcttccttaatttcagctgctgtgatacctggctacagcctttatgagcattgcaataaacatgtgtgctgagatcatatactcaatttcttaagttttaaaatgaaatctgctaagaagcaatggtcccttggagagaagagcttggtataaaacataaaatgaatttcccctcctcctagccggaaaaaaaaaaaacctcaaaggtaatcatgtaattcaacaattcattcaactaatatttgtatagttaataacacatgaagttgaaacttcttttcacagacttttgccaagtttgtagcacaaaaaattcactgccagtgtgggggatgctgtcacctctaaatgttaaatctcaccatagcagtaatgtcttgaatcaccatgagatatgaattgtttatggcacagtcattttgacttttgttccaagatttcttagtttcagcaatccagtaacattttcccttatgcaccttccagtctttggcaggacatgatttatggacagtagaaaagttgaaagaaactggaagaaaggaagataagcaattaaaatcaatgtaaaactgtatcctaataatgtatactaattgaagggtctcaaatttggttatattatgtgctaagctttctttgaaaaaagtatgtgctttgttccagggtacatttgaaaaaaaattaaaagaattgaagtcatgtgtatattcattaattcattcactcatccatcctttttccatttaatttatccttttaaaaatatatcatgttttctataagccaggaaatgcaccagacactaggataaaacaatgaacatccaagcttcaaggaactaaaaactttaaaggaagaatagaaattagaaattttaattagttgtctactaacacatcagaaatgttgggagtttatatcacactagtatagttattcacaagcaaaatttgtgctataggcagtcccccaaaatcaaataggttcatctctattatcacacaaaacgatcttgacatctaaaaatgtgctcttaacagctagttctaatttataatatttcccagcaaatttagatgatgatacagggtattctagatataccaataatttagtattcctgtaaataaatattctttacacacagagacagacagacacacacacacacacacgcacgcacacacatgacctgaagccattgaagagtgaacaaagccagacagattctagaggggagatgacacttcaaagaaggtatggcagggcaaaagtttatcatttttacaattgttagccttaggccaattgtagtcccatgtagagtgagtaaaacatcattaaaaaacctgcagcctttctcacctgaataaccagagaacagagttaagagaaaccacagatgctgaaaatgaagaatcaattccataaaatcaaaaacatagagggggtgctctaacttgtgtgtacaatttttttccccaaatctctgactgatgcaagcacaagccaggttatggtaagaacaagacaaccgaactgagacttgacctgctgccccaaagatagagatttaaatttaagtccaactacaccaattgcttgctaaggaaggaaaattggccaggtgcaatggctcacgtctgtgatcccaacactatgggaggctgaggcaagcagattgcttgaggtcagtttgagaccaatctggccaacacggcaaaatcccatttctacaaaaaataaaaaaaaattagccagtcatggtggtgtgtgcctgtaaccccagctactcgggaggctgaggcaagagacttgcttgagtctgggaggtaaaggttgcaatgagcccagatcatgtcacactgcactccagccagggtgacaaagcaactccatgaaaaaaaaaaaaagaaaaagaaaaagaaaaaaaaagaaaggaaaataaacactttcactttttttggaggaatatgtgagaaaacacagacttctccatataactttcacaatgtatagtatataatctcaaatgccttacatgaaaaaccagaaaaatatgaccaattctaaaggaaaaggacaatcaatgcagctcaatataaggatgatgtggaagttagaagtatcaggcaaatattttaaagcagctgttgtaactgtgcttaatgacataatagaaaatatgctttcaaacgatgaaaaaataggatacctcagcaaagaaggacagtaggaaaaaagccaaatgaaatttagaattgagaaatatagtaaaacattttatataaaaaccatctctggacatacttaaaggcaagatttaacaggaaaacaagttagcgaacttgaaattgtccaatatgaagaaaaatgttggataattttcagatcctcaaggacttgtggaataatattgaaacatatgacatatttagaattgaagtcccaaaacttaagagaagagaaagattagggcaaaacaagttgaagatacaataattgaaattttttccaaattgcttaaatccataaatttacactttcaagaagctcagcaaagcctaagcaggtaaatattaagaaattcatatgtatgaataagttagtcaaacttaaaagccaaagataaaaatcttgaaaacagtttttgtgcattacctgcaagaaaacaattatacaaaaatccctcatcctcattataaactatgggggctagaatacagtaaaagatatctttaaattgtcaaaggaaaaagtaactgtcaacaaagtattctatatccagtgaaaaatcttccaaaaattgtggcaaatttaaggcattttcagaaaatgaaaagaaccccttgacaacagataatcactatagctaatgttaaaggaagtttttcaggctgatgcgcaatgtttctaaatgagaacttgaatattattcaagggagaacataaaaaatggcaaacatctggataagcataaaagtataaggtaatcaacatatcttcaaaaaacatttggtcttgcttacaaattaagttcatactgttgcctagcttataaagttctttctcagactgatataatgcacctaaatcaaaccctttctgagtaagtgtataattattgcgaaagatagagcaactatgtagctgaaaaattttaggacacatttaatgaaaactataaaaactacagtttcacttctctgatagactagatacctggaagcagtgtttcacacccattttgatatcatagaatataaaaaaatagatttctaaagtagaacaagatagataaataatagtttatttatagtctgtcaaatagcaacttggatttgtatagctcaggaacttcaatgcataaaacgtgtcagggcatgcaaagaaacaactttaggagaaacaacactgttgtttctttgaagatgttttcactacaagaccattataacctgagataattaggttaaacatattgctttctttgtaagaaatgaggaaatcactaaaggaaggcacttagttagaagcagaatggggagcagcatttggtaaatgaattcaaagggcaaggtggcccttcatggtaataatctatatattggtgctgagattctaagaataagctcttggtttactgaaaggtgatgggataaatcagtgagcctttcatcagtctgaaaccttaaaaagggcttcaagacatccaaatcattagctacaccctgccctcttacagatgaaaatgcagttaatctctggaagaaacaatctttaatttttccttatgaatcccgttattgaggtcaaccaaatttttaaaaatcatcaaatatttcaggaaacaagccaacatatcaataggaaatacaaagaatgaatttggtcaccaaggactttagatatttaaataatcctatgtattataaaaaataatgtttaaatggttttaagaaataaaagaagaaataaaaacatcacatcacaacaacaaaaaacatcaaaagccaataagtttgaaaatacatccctagaatcaaaaactgttatcactgaaattaaaaactcagtgaatgagagcagatgaggaaagcagcaggaaaagggataattagtgaatttaaagatatatctgaaaatattgctaagaattcagcacaaattgacagggacaaaatgtgaagttaggtgaaatgggggctagaaagcaaaggcccactgcacatctaatttgagtcccagaaggaaacaaagagaaattagagaaagaatttggaatggtggttgaatagatcaactacgttttactttacatattttaagtccattttgttattttaagataaactcatttagatttggtgtactttcctaatcaattgaaagtagaaccttaggagaggtaacttacacctctataacaatagaataagggtaagaaaacagatttggaagcatttaaagccagagctttatttattgtctccctgtgtcacaggtataaggattacaagaaagtgtttttgctttggggataatgtctcacaaagttaagaaaaatattaacttacattgtacgagatagtctttagattgtggttgagggagcttgggaacatcaaagttcccaaagactttaaacaccaatgtaaaatcttaattaatccccagaatttgaatctagtttataatttggacatggtaagtcattctaatataattgtttctggatgttataaaaagatatataatattttaatacagaattaaaatgtaaattaaaaaattaaaatcaaataacctaagaaaattcaaaggccatctactgacttttaaaatatgcaaatacattcatacgagagagcaaaagaaagactaacaaaattagcatttacatttttaaatatgtaataacgttaaaaaattgaaaaaccatctgcaatgaccatgaattttaagaggaaagaaattttaaccccaacctgtgcttgcacataccccaataaaaaacaaaataaaatacaattatttcaatgaaatacttttaaattcatttaaaactcattgtataagctcatttgtctcattttgccttggccctttacatgttaatatttttatcagaattgtaatgagtccatgaaaagcaatgatctaaaccatctgtctattgtgatagagaagtttctcctctattcagatatcgtcaaagaaaatcaaggctactattcatgcttggttactcaggaatttggcaatacaaactaatattacctactgaggtgattgttccagatttattttccccagtacagtttttctcttttggctcattatacaatttagtattggataatgaatagtatgtcatgcagtgttgaactagacaactaatgaaagaagaaacatgtttttctaattagatacaaagcccaaaaccattagtctgtagttattccatgaagtccaatgatatggaaattccatatcaaaagttaaatgattaaaaatttaagagaaaaacataactactctttcctagatttagagtctcttttgcactcttattaaccttagcaatgttaactttaaaagaattggaaaaaatatgaccagaagaataagcacttgaattttttcctggagctgtcataattactttaataaggacaaaatgtccagctctggatatgactcatatttagatcatttgtgtttagtgagttcctattaattatatcaggtgtcacctggttgatgttttgtatgttttggttttggttaatgatttgttcctttgagattctgcatataaatgctgcatatatgagatagagttagcccagagtagtttttttctgcaacgaagaaaatatttgtctttctgctggccatttaactgaaattatctttgataatttatagtctcagaacaatgtatattaggttattagtattgaccatctaaaaccacataaacacatctgaaagtaataaaagtaaatatttaatagtgcttgtcatttgccaggcattaacacaagataccatattcagaatatatttaattcatttaatgtattaaatatataatctctaattcttatgttgatacatcatacttttaatccttcaacatatatacatcataatatagtgcatccaatgcaagaattttattagtgatgtagctgggatttgaaaacaggtcctgggtctctagagtatccgtgaacatcgttgccttctagagaaactttttaagaagacattttatctttgaaatctattagtaacacatcaattttagtagcaaaaaaatctattttactaaaaaactattttagtaacaagaaaatctattgccttctaaaacataatgaaaagtagtatagtagggatttttaatgctaattattattgctcccccaaccccattttatagccctaattatgccattggctagttacattaaagtagttaaaccacttatccctctgggcttcagactgctcatctaaactagactttgctgatttctggagtcccttctagttctaaagttctacaactctgcttatttatttgtaatagataatgccattcataattactaacataattctctaagattcagtgacatagacactgcattgacttttctagggtttagtttaatctggaagcctgaattacttggaatatatataatctgtatatcatctctgttctacagatatttgtaaggaacttttccccaagcgtttattcaataaaacattaaaataatggccatatgaaaaattggactatgtttggctatgtccaaagtacattagtataaatttataatgctcaatggaattgatttattttagacaaatttctcacctgttgacacaagattgatgatacttaggagtagcagatatgaataagcatacacagaaacacaagtcataatttaatttgcttccttctgaacatggtttcagagacatctgtgtatatcccaacatcaaactgcaccaggcaattcactgcatgatcttgatcataaaataagcaactaatcttgccatctcttttctttatcattgagatgaatttataatgtatattttatcacatggtgaaattctatagaaaatctctaattttagttgtgtatcaaattttacactttttgtgaagttgtaccatattgtttaggaaccatttaaatagcaaacacagttacaacaagttaggagaaaaataataccctgagatgaataaataatattactaattacttacccaaaatattcagtacaattactattaccagaaggataatattattgcacatccaacgttaagaacaattccatggtggtgagaatctacaaaattgaatagatttcactagtaaacccagcaggtagctccttagatggtgagaggtaggagagggccaaataaactttctcacctatcatgttcctgagttactttccttcgaaatatgtagacccagcttctttttttttttccacacaaaacacacatatgcgagtattctctggtttgaataaatatgaatttttccttttggtttcactgtttatattccccagtattgatcttacttatgatcactgtctgtgtctctgggtttttatataagactgtgaaaccctcaagattctctaataagcttattgacaacacccatttatttgagctgatcttttctgtttctcctcttatataatgtatccatttcctgtgatatagcattgtaattccataaaaccatacatttaaacataaaagaaatgttagagattattttaacgcaatacccacgtgttaaaatggggatattcaagttcacagtcacacagttacttgagagcagagctgatatctaacctcaggtctcttgactaccagactagtgctgccttcggtatccacacttctcattgcatttgaagtactcaaaagataataaataaaccaaataaaagaagttgtacttttagctttaggctgaaagtttaaaacaacagtctctggtacataaaagttacagtacattgtttccactagatatgtgacctaaacacacaatacactgagaaagtactgaaaatagctgatattgaaatataatcatatcaagactaaatggaatgtttatttggtagattattattgagtgcattgttttatgtgctgattattattgctattaattaaaacatctttaataggaatttgttaattttcaaaacattaaaagaagtccacatattttcactcatcagacaaaacagtcaaaattgtgggagtcaagtcagtcacagaaagaatgtggtgatgtcactacacgtttctttttctttctttttttcttttcttttttttttggataggcttttgttctgttgcccaggctagagtgcagtggcatgatcactgctcactgcaacctccacctcccaggttcaagcaatcttactgcctcagcctcctgagtagctgtgaatacaggcacgtgtcaccatgctcgtttttaaaatttttggtaggcatgaggtctctctgtgttgtccaggctggtaccaatctcatgggctcaagcgatcctccttcctcggcatcccaaagtgttgggattacaggcgtcagccattgtgcctggccactacacatgttactaatatgacgaactgaaattatggatccctaagtttagtagaataaaatttcagatttcataaaaagactaacataaaagatattgatcattcttttaggcctcctaagtaagatttaagcaaagcataaatttctgggatattctcagttcaaacacacactctcactgatgtcctgctaagcttcctgatgacattcctttatgctttacatcttggagaaccaatgagcatacatatatacattcatcgtctaatgcgattcatttatttattcagccatttataaattattttacttatcaagcatctattaatttcctgctctatatttagtacggtgtgaggtgctagaaacacaaagattaatagattatgtagaaagattcagcattttatgaggctctgaaatggtaaggaatatgacaacctttaggagaaaagaaaaggccaatagccagagcaaaatcagtgaaaggtatgaggttagaagagatcaggaacaattgtgtaggactctgtatgtaagacaacaaaaatctaatctatccaacagctctttcgcttgatggcgaagtgacgcatgagaacaaaagttgcgtttatctaacaccacacgtatacagcacaagaacaatatgatatttgacttctggtcataagcatgactataggtaggtaatttaatcttcatatagttcgttttctcatttttagcattctaagattgaactagatcacattaaaagatgttgccccacatccctaaactgggaaaagaataaggttttatttataaaagttcaaaccatagacagaaaggcaattaaaccctggaatgcggaatcaaaaatattggttttgttgcttaaactgagtaaaataacctctagaaaaagaaactaactacaggacatttttgaagcataggggaatgacagtgcagttctagtccatgttatttttcaaattatgtttcactatttcataggaagtgaaagtgcctaagctggaagaaaagaaagcaagttagcctctgctgggtaaaatagagaggtaaggtttaaaataagaaacaagatgcttttacaaccagaaaaggacacacactagattcctttgataactataaacttttgaaaatataaagaagaaatacattccttggaaatacgaacaaagtagcagattcattccacaagggcaaatacaaaggaggaactttaaattatttaaaacacctacataaactctatgctacaaaaattcttaccctagagcagagaatggaaatgtaacaagacagagaaatttccttaatacttcaaagaatagaaaagacactggctatgaaaatctataatttttgagggggtttggtgatgaaggcaccatgttaagtttaggcatatgcttatcgcctctgattccagaaatattcaattacctagtcattaattctagactttataaaattaaatctaacgtttcatgttttcttaagtttacatttttatcctattgatattgtaaaagaataaataacaatatgagtaaattgccacaggtatttttcccagtggagatgaatttatcacattatgttaaaaggtcagatttgattgagagtgagcaaagctgtggagcagaaaggcgtgatcccgctagaagttgctgtgtgaatataaacattcatcacgagaaatcaagaaatagaaaggctatgaaaacagaagcaaagttctacatattaaaaccaaagtggcaatttattttatgaacagacattttgcttcattaaaaacattcgctcttattcttagcattcaatgaattttgctttgaatccaatctcctcttttcagtttggcaattagatacataagaaagaaataaaggagataactagtaaaatcttaattctcaaaggcaccctaaatccagcttaccagatctctgaagtggaaacgcgagttctaacggggaagtccgaacagttttgatgtcagcgtagactacatctccagccattgcacagatcaaaaagagagagaagaccacaaatgatgtcccactgaagggacaatcatatttctgcaaagaaacttctgataagtaaattgagatggcaaatttccttctgctccccaagtgggtggtggacttcctccatgaataaatgacaaaaccaatgtgttcagtcttactaatcaaggtagcagatttctcgaatacttgtatgacatggaagaaattactaaccatacagtaggttctcgtttttcagttagttttctgcc

SEQ ID NO: 1599 - DNA, 17441 bp, Homo sapiens; identical to SEQ ID NO: 1598

SEQ ID NO: 1600 - DNA, 10809 bp, Homo sapiens
atcatgtaattcaacaattcattcaactaatatttgtatagttaataacacatgaagttgaaacttcttttcacagacttttgccaagtttgtagcacaaaaaattcactgccagtgtgggggatgctgtcacctctaaatgttaaatctcaccatagcagtaatgtcttgaatcaccatgagatatgaattgtttatggcacagtcattttgacttttgttccaagatttcttagtttcagcaatccagtaacattttcccttatgcaccttccagtctttggcaggacatgatttatggacagtagaaaagttgaaagaaactggaagaaaggaagataagcaattaaaatcaatgtaaaactgtatcctaataatgtatactaattgaagggtctcaaatttggttatattatgtgctaagctttctttgaaaaaagtatgtgctttgttccagggtacatttgaaaaaaaattaaaagaattgaagtcatgtgtatattcattaattcattcactcatccatcctttttccatttaatttatccttttaaaaatatatcatgttttctataagccaggaaatgcaccagacactaggataaaacaatgaacatccaagcttcaaggaactaaaaactttaaaggaagaatagaaattagaaattttaattagttgtctactaacacatcagaaatgttgggagtttatatcacactagtatagttattcacaagcaaaatttgtgctataggcagtcccccaaaatcaaataggttcatctctattatcacacaaaacgatcttgacatctaaaaatgtgctcttaacagctagttctaatttataatatttcccagcaaatttagatgatgatacagggtattctagatataccaataatttagtattcctgtaaataaatattctttacacacagagacagacagacacacacacacacacacgcacgcacacacatgacctgaagccattgaagagtgaacaaagccagacagattctagaggggagatgacacttcaaagaaggtatggcagggcaaaagtttatcatttttacaattgttagccttaggccaattgtagtcccatgtagagtgagtaaaacatcattaaaaaacctgcagcctttctcacctgaataaccagagaacagagttaagagaaaccacagatgctgaaaatgaagaatcaattccataaaatcaaaaacatagagggggtgctctaacttgtgtgtacaatttttttccccaaatctctgactgatgcaagcacaagccaggttatggtaagaacaagacaaccgaactgagacttgacctgctgccccaaagatagagatttaaatttaagtccaactacaccaattgcttgctaaggaaggaaaattggccaggtgcaatggctcacgtctgtgatcccaacactatgggaggctgaggcaagcagattgcttgaggtcagtttgagaccaatctggccaacacggcaaaatcccatttctacaaaaaataaaaaaaaattagccagtcatggtggtgtgtgcctgtaaccccagctactcgggaggctgaggcaagagacttgcttgagtctgggaggtaaaggttgcaatgagcccagatcatgtcacactgcactccagccagggtgacaaagcaactccatgaaaaaaaaaaaaagaaaaagaaaaagaaaaaaaaagaaaggaaaataaacactttcactttttttggaggaatatgtgagaaaacacagacttctccatataactttcacaatgtatagtatataatctcaaatgccttacatgaaaaaccagaaaaatatgaccaattctaaaggaaaaggacaatcaatgcagctcaatataaggatgatgtggaagttagaagtatcaggcaaatattttaaagcagctgttgtaactgtgcttaatgacataatagaaaatatgctttcaaacgatgaaaaaataggatacctcagcaaagaaggacagtaggaaaaaagccaaatgaaatttagaattgagaaatatagtaaaacattttatataaaaaccatctctggacatacttaaaggcaagatttaacaggaaaacaagttagcgaacttgaaattgtccaatatgaagaaaaatgttggataattttcagatcctcaaggacttgtggaataatattgaaacatatgacatatttagaattgaagtcccaaaacttaagagaagagaaagattagggcaaaacaagttgaagatacaataattgaaattttttccaaattgcttaaatccataaatttacactttcaagaagctcagcaaagcctaagcaggtaaatattaagaaattcatatgtatgaataagttagtcaaacttaaaagccaaagataaaaatcttgaaaacagtttttgtgcattacctgcaagaaaacaattatacaaaaatccctcatcctcattataaactatgggggctagaatacagtaaaagatatctttaaattgtcaaaggaaaaagtaactgtcaacaaagtattctatatccagtgaaaaatcttccaaaaattgtggcaaatttaaggcattttcagaaaatgaaaagaaccccttgacaacagataatcactatagctaatgttaaaggaagtttttcaggctgatgcgcaatgtttctaaatgagaacttgaatattattcaagggagaacataaaaaatggcaaacatctggataagcataaaagtataaggtaatcaacatatcttcaaaaaacatttggtcttgcttacaaattaagttcatactgttgcctagcttataaagttctttctcagactgatataatgcacctaaatcaaaccctttctgagtaagtgtataattattgcgaaagatagagcaactatgtagctgaaaaattttaggacacatttaatgaaaactataaaaactacagtttcacttctctgatagactagatacctggaagcagtgtttcacacccattttgatatcatagaatataaaaaaatagatttctaaagtagaacaagatagataaataatagtttatttatagtctgtcaaatagcaacttggatttgtatagctcaggaacttcaatgcataaaacgtgtcagggcatgcaaagaaacaactttaggagaaacaacactgttgtttctttgaagatgttttcactacaagaccattataacctgagataattaggttaaacatattgctttctttgtaagaaatgaggaaatcactaaaggaaggcacttagttagaagcagaatggggagcagcatttggtaaatgaattcaaagggcaaggtggcccttcatggtaataatctatatattggtgctgagattctaagaataagctcttggtttactgaaaggtgatgggataaatcagtgagcctttcatcagtctgaaaccttaaaaagggcttcaagacatccaaatcattagctacaccctgccctcttacagatgaaaatgcagttaatctctggaagaaacaatctttaatttttccttatgaatcccgttattgaggtcaaccaaatttttaaaaatcatcaaatatttcaggaaacaagccaacatatcaataggaaatacaaagaatgaatttggtcaccaaggactttagatatttaaataatcctatgtattataaaaaataatgtttaaatggttttaagaaataaaagaagaaataaaaacatcacatcacaacaacaaaaaacatcaaaagccaataagtttgaaaatacatccctagaatcaaaaactgttatcactgaaattaaaaactcagtgaatgagagcagatgaggaaagcagcaggaaaagggataattagtgaatttaaagatatatctgaaaatattgctaagaattcagcacaaattgacagggacaaaatgtgaagttaggtgaaatgggggctagaaagcaaaggcccactgcacatctaatttgagtcccagaaggaaacaaagagaaattagagaaagaatttggaatggtggttgaatagatcaactacgttttactttacatattttaagtccattttgttattttaagataaactcatttagatttggtgtactttcctaatcaattgaaagtagaaccttaggagaggtaacttacacctctataacaatagaataagggtaagaaaacagatttggaagcatttaaagccagagctttatttattgtctccctgtgtcacaggtataaggattacaagaaagtgtttttgctttggggataatgtctcacaaagttaagaaaaatattaacttacattgtacgagatagtctttagattgtggttgagggagcttgggaacatcaaagttcccaaagactttaaacaccaatgtaaaatcttaattaatccccagaatttgaatctagtttataatttggacatggtaagtcattctaatataattgtttctggatgttataaaaagatatataatattttaatacagaattaaaatgtaaattaaaaaattaaaatcaaataacctaagaaaattcaaaggccatctactgacttttaaaatatgcaaatacattcatacgagagagcaaaagaaagactaacaaaattagcatttacatttttaaatatgtaataacgttaaaaaattgaaaaaccatctgcaatgaccatgaattttaagaggaaagaaattttaaccccaacctgtgcttgcacataccccaataaaaaacaaaataaaatacaattatttcaatgaaatacttttaaattcatttaaaactcattgtataagctcatttgtctcattttgccttggccctttacatgttaatatttttatcagaattgtaatgagtccatgaaaagcaatgatctaaaccatctgtctattgtgatagagaagtttctcctctattcagatatcgtcaaagaaaatcaaggctactattcatgcttggttactcaggaatttggcaatacaaactaatattacctactgaggtgattgttccagatttattttccccagtacagtttttctcttttggctcattatacaatttagtattggataatgaatagtatgtcatgcagtgttgaactagacaactaatgaaagaagaaacatgtttttctaattagatacaaagcccaaaaccattagtctgtagttattccatgaagtccaatgatatggaaattccatatcaaaagttaaatgattaaaaatttaagagaaaaacataactactctttcctagatttagagtctcttttgcactcttattaaccttagcaatgttaactttaaaagaattggaaaaaatatgaccagaagaataagcacttgaattttttcctggagctgtcataattactttaataaggacaaaatgtccagctctggatatgactcatatttagatcatttgtgtttagtgagttcctattaattatatcaggtgtcacctggttgatgttttgtatgttttggttttggttaatgatttgttcctttgagattctgcatataaatgctgcatatatgagatagagttagcccagagtagtttttttctgcaacgaagaaaatatttgtctttctgctggccatttaactgaaattatctttgataatttatagtctcagaacaatgtatattaggttattagtattgaccatctaaaaccacataaacacatctgaaagtaataaaagtaaatatttaatagtgcttgtcatttgccaggcattaacacaagataccatattcagaatatatttaattcatttaatgtattaaatatataatctctaattcttatgttgatacatcatacttttaatccttcaacatatatacatcataatatagtgcatccaatgcaagaattttattagtgatgtagctgggatttgaaaacaggtcctgggtctctagagtatccgtgaacatcgttgccttctagagaaactttttaagaagacattttatctttgaaatctattagtaacacatcaattttagtagcaaaaaaatctattttactaaaaaactattttagtaacaagaaaatctattgccttctaaaacataatgaaaagtagtatagtagggatttttaatgctaattattattgctcccccaaccccattttatagccctaattatgccattggctagttacattaaagtagttaaaccacttatccctctgggcttcagactgctcatctaaactagactttgctgatttctggagtcccttctagttctaaagttctacaactctgcttatttatttgtaatagataatgccattcataattactaacataattctctaagattcagtgacatagacactgcattgacttttctagggtttagtttaatctggaagcctgaattacttggaatatatataatctgtatatcatctctgttctacagatatttgtaaggaacttttccccaagcgtttattcaataaaacattaaaataatggccatatgaaaaattggactatgtttggctatgtccaaagtacattagtataaatttataatgctcaatggaattgatttattttagacaaatttctcacctgttgacacaagattgatgatacttaggagtagcagatatgaataagcatacacagaaacacaagtcataatttaatttgcttccttctgaacatggtttcagagacatctgtgtatatcccaacatcaaactgcaccaggcaattcactgcatgatcttgatcataaaataagcaactaatcttgccatctcttttctttatcattgagatgaatttataatgtatattttatcacatggtgaaattctatagaaaatctctaattttagttgtgtatcaaattttacactttttgtgaagttgtaccatattgtttaggaaccatttaaatagcaaacacagttacaacaagttaggagaaaaataataccctgagatgaataaataatattactaattacttacccaaaatattcagtacaattactattaccagaaggataatattattgcacatccaacgttaagaacaattccatggtggtgagaatctacaaaattgaatagatttcactagtaaacccagcaggtagctccttagatggtgagaggtaggagagggccaaataaactttctcacctatcatgttcctgagttactttccttcgaaatatgtagacccagcttctttttttttttccacacaaaacacacatatgcgagtattctctggtttgaataaatatgaatttttccttttggtttcactgtttatattccccagtattgatcttacttatgatcactgtctgtgtctctgggtttttatataagactgtgaaaccctcaagattctctaataagcttattgacaacacccatttatttgagctgatcttttctgtttctcctcttatataatgtatccatttcctgtgatatagcattgtaattccataaaaccatacatttaaacataaaagaaatgttagagattattttaacgcaatacccacgtgttaaaatggggatattcaagttcacagtcacacagttacttgagagcagagctgatatctaacctcaggtctcttgactaccagactagtgctgccttcggtatccacacttctcattgcatttgaagtactcaaaagataataaataaaccaaataaaagaagttgtacttttagctttaggctgaaagtttaaaacaacagtctctggtacataaaagttacagtacattgtttccactagatatgtgacctaaacacacaatacactgagaaagtactgaaaatagctgatattgaaatataatcatatcaagactaaatggaatgtttatttggtagattattattgagtgcattgttttatgtgctgattattattgctattaattaaaacatctttaataggaatttgttaattttcaaaacattaaaagaagtccacatattttcactcatcagacaaaacagtcaaaattgtgggagtcaagtcagtcacagaaagaatgtggtgatgtcactacacgtttctttttctttctttttttcttttcttttttttttggataggcttttgttctgttgcccaggctagagtgcagtggcatgatcactgctcactgcaacctccacctcccaggttcaagcaatcttactgcctcagcctcctgagtagctgtgaatacaggcacgtgtcaccatgctcgtttttaaaatttttggtaggcatgaggtctctctgtgttgtccaggctggtaccaatctcatgggctcaagcgatcctccttcctcggcatcccaaagtgttgggattacaggcgtcagccattgtgcctggccactacacatgttactaatatgacgaactgaaattatggatccctaagtttagtagaataaaatttcagatttcataaaaagactaacataaaagatattgatcattcttttaggcctcctaagtaagatttaagcaaagcataaatttctgggatattctcagttcaaacacacactctcactgatgtcctgctaagcttcctgatgacattcctttatgctttacatcttggagaaccaatgagcatacatatatacattcatcgtctaatgcgattcatttatttattcagccatttataaattattttacttatcaagcatctattaatttcctgctctatatttagtacggtgtgaggtgctagaaacacaaagattaatagattatgtagaaagattcagcattttatgaggctctgaaatggtaaggaatatgacaacctttaggagaaaagaaaaggccaatagccagagcaaaatcagtgaaaggtatgaggttagaagagatcaggaacaattgtgtaggactctgtatgtaagacaacaaaaatctaatctatccaacagctctttcgcttgatggcgaagtgacgcatgagaacaaaagttgcgtttatctaacaccacacgtatacagcacaagaacaatatgatatttgacttctggtcataagcatgactataggtaggtaatttaatcttcatatagttcgttttctcatttttagcattctaagattgaactagatcacattaaaagatgttgccccacatccctaaactgggaaaagaataaggttttatttataaaagttcaaaccatagacagaaaggcaattaaaccctggaatgcggaatcaaaaatattggttttgttgcttaaactgagtaaaataacctctagaaaaagaaactaactacaggacatttttgaagcataggggaatgacagtgcagttctagtccatgttatttttcaaattatgtttcactatttcataggaagtgaaagtgcctaagctggaagaaaagaaagcaagttagcctctgctgggtaaaatagagaggtaaggtttaaaataagaaacaagatgcttttacaaccagaaaaggacacacactagattcctttgataactataaacttttgaaaatataaagaagaaatacattccttggaaatacgaacaaagtagcagattcattccacaagggcaaatacaaaggaggaactttaaattatttaaaacacctacataaactctatgctacaaaaattcttaccctagagcagagaatggaaatgtaacaagacagagaaatttccttaatacttcaaagaatagaaaagacactggctatgaaaatctataatttttgagggggtttggtgatgaaggcaccatgttaagtttaggcatatgcttatcgcctctgattccagaaatattcaattacctagtcattaattctagactttataaaattaaatctaacgtttcatgttttcttaagtttacatttttatcctattgatattgtaaaagaataaataacaatatgagtaaattgccacaggtatttttcccagtggagatgaatttatcacattatgttaaaaggtcagatttgattgagagtgagcaaagctgtggagcagaaaggcgtgatcccgctagaagttgctgtgtgaatataaacattcatcacgagaaatcaagaaatagaaaggctatgaaaacagaagcaaagttctacatattaaaaccaaagtggcaatttattttatgaacagacattttgcttcattaaaaacattcgctcttattcttagcattcaatgaattttgctttgaatccaatctcctcttttcagtttggcaattagatacataagaaagaaataaaggagataactagtaaaatcttaattctcaaaggcaccctaaatccagcttaccagatctctgaagtggaaacgcgagttctaacggggaagtccgaacagttttgatgtcagcgtagactacatctccagccattgcacagatcaaaaagagagagaagaccacaaatgatgtcccactgaagggacaatcatatttctgcaaagaaacttctgataagtaaattgagatggcaaatttccttctgctccccaagtgggtggtggacttcctccatgaataaatgacaaaaccaatgtgttcagtcttactaatcaaggtagcagatttctcgaatacttgtatgacatggaagaaattactaaccatacagtaggttctcgtttttcagttagttttctgcc

SEQ ID NO: 1601 - DNA, 113943 bp, Homo sapiens
tttctagaacaacaacataggcattttatttcttttcattaagcttcttagtttcttagtatcacaatggaatgatgagaaaacaacaaaaacgtgagtctttgcaaatctctgacaaagagcagagatctcaaggcaattggggcgggggaggcttgacagaagtgccagagcagttccaacgtcacatctctccttggctggaatggtgagaaggtggcactgtcgtgagctgtccttggcaattctgccccatgagccacgtgcgcctggtctgcatgggccaccccgcgggatttcctggtgcctcctagtacctggccacacacccctccgcctgctccaacgccctgggagcaccgtccagtgctcaggtggacccagaagccagctctgctgggcagcggcaagatgtggaggagcggcagaggcaggcagcgttgcttgcggtgggagaagccaaggagtgtgaccaaggcccatctgggagacatctgtggtggaaggtagggctggcgcaggtggcagcagcagaagtccgtgtccccaggcagtagcaggcctagagcttcacagtgccagggggcaggctgtcgttgcagagtctgtagtagcgcaggtcgttgaccagcctgtgcacattctgggtgaatgagggcaggtcctggaaggcaggggcatagctgcagccaacaacacaccaggtcacccacccaccagaccccaacagctacttccatcccagagtgtgcactgaagataggggagcactttctaaaactcaaaacttctattcactgttgcactgcgtgtcacagagactctgtgccaggcgctgtgggagaaaaagaacaagaggaatacgtccctagggcctctcgggtgccagacactgctgcaatcaacatacagacatcaactcactgagtcctcaccacaaggctgccaccaagccctaccagaaccactagtctaaggacagaaagaccaaagcgctgcaccatgaagaagctggccccagctcacactgaagagaccagcacacttgctcctgagtccggcccctcaaacgcagacatggctgtggtgacagccctcttcttcaccatggccccttgaggtgacgcgcacaccgagcaatgtctgcagaacctttacccacggggctccaggccgcccctgcccctcgagagccacccgagcagcagcaaacacagtcccaaggcctgtcccactgggcgcagcgtgggccatggaaggccctgggccagaagtgaggccctgacctccgccatcatgcacacggtgagaccctgctttttttttcagtgtaggtcccggtgaggactcaaacaggcccagcaagccccagcagagccatgagcaggaccaagttcattttcctgcccaaccactattcctcttccagaactccattcaaagcctgcctcttcccaaagtctgcacagatgcctcctatttcctggccccagcagccagctcagcgcctctgtcctgagcaatctgcttctggggagtgtgtgcaggctctggggccagaacacccaggtctgcctcctgcttcgcagctctaccacttccaagttctgtgaactgctcaccttctgagcccccaccatctgtgaaatgggggagtaacaggacccacacttcagaggcttgttagaaggcttactcgagccaagacatgtcacatgcttggcactatgtggtccacagagggtgctgtattggcctgtctaccatgaaagacttggtgaaggctgggactggtgccccagttcctggcccggggcttgagaagcagctggcttcaaacacacagtgcgtgactgaatggaaggtggtgattcttttattttaccctcaaaaaaccaactaagggatgtcttttaaatcagtggctcccaaatgccaaaccagaatttcctgggtagaacacagaagtctgtttctccatttttaataagtaccccaggtgcttctgatataactagatttttttttttgagacaaagtcccactctgccgcccaggctggagtgcagtggcacaacctccgctcactgcaacctctgcctcccgggttcaagagattcttgtgcctcagcctcccaagcagctgggattacaggcgtgtgccaccacacctgactaattttttttatttttagtagagacagggtttcgccatgttggccaggctggtctcaaaccccctaacctcaagtgatccgcccgccttggcctcccaaagtgctgagattacaggtgtgagacaccgcgcctggcctataactagattttgaaaccacagctttaaatcaaaaagttgactgatattgatgtcgttagaagctgatcattaagtattaggatctggcctctagaaaaaggaaaaaacatatccaggggctgaagtgaactggaagaggcttaggagagaacaagtcccaagaaaaggaagaccccaagacaaaggagaacaggatgagtctaagcaaaagcttccctgccacacgtggcaaatgaggaaagcaggcggccaggtttgcaccagtgagagcagtgtgtgcatctgagcactacggtggagccgtggacaagctgcttcacagaggactcaggtcaagaaccccaagaggaccagggagaaagcgatttcttttcctaatttcatcaagtataaaacggtacaaggaaaagttcccagaagttcctatcaggcaagagagaggcctggtcacctgacacaggaagaagagaacaggtgagccccatggggaaggaggtcccaggcactgtcaggctccaacaagatggcctcatggacaccaagagccagcagcacccagctcccaccgaggtgctgcacgggtggggacagcccacctgacagtccctgcacaggtggcagcagtgggacaagagggtgagtactaggagggctcctcccaggacctggcagcaactcagcccaagctgagctggggctggtctggaaagagcccaagacagccggggaacctgggtcccacctctaaccctggggacccagaagtgcagctcccaagcaccaaccatctcagcctgaatgcaagcctgggcacactccaatgctggccccaccggggctcatcacccaggagggagaacggcagggtcctgggtatgaacaaagatgccaagacaaatggaggggctgcagagccaggaactcgggacctccatggctgagactaagaacatacgtgctacagacaccaagactggggaaaaggctgtgcccctcaatcaggctacagcaccaggtcagcaggcatctcgtgagctgccgccaagctgcagggtgggcacagaccacgcccagaggcctcaatgtgccccctccttgctgcacaggtgccaggcttgcgtgcccactctgccctcctcttagcccggcctctttctctcctcacccgatccatcttgaaattccgccccagcacacttttctggttggcatccacaccatcacagctggtcaggaactctgggaggaaggcggcaaagaagccatcaaagtcgactgaggccatgttgtagatggcgatgccaatctcctcctgcagaagatcatgggacttgtggaccaggacctggagcagcacgttcacaaactggaacagcatggcagtccggaagatcttctgcaggcagagagaccaggtgagcagcagccagcccccaggggcctgtcccgggtcccatccactttctgtcacactctccagtgagtaacctgagggtgggacacaggccacaatgcccctgatggaagaatatttccaagagctggggcacttaccttgtggtacagcttctgcttggtgttgagagtctccaagtagaagagattttgtttaaaaaggtggatgtcgggctggagaaaggactgtccgaaagcctaggaaatgagaccaccattttataaactgcaagaccaagcacttctggagcatctaccccatgtcagaagaacaagtgccagggccagggtacccattgtcttgatgcttctggcccaccagctcagacctctacgacgctcctcctaagtctcagagttcatgttttccccaccgggccttgcttcttattatggtctcatatataccttttttaacaaacctctagaaacccatcacaggacctggctttgaagcaagaagctcacacctctagtcaaatccctcagcaatcctggcagacagacaccaaagcctgcctgcctgctcctgctcaagccaagcaatcccctcccttgccctccttcttgcatcccccgtctcaaaagccacaagccctacaggctccttcatggagcctccacctggaggttaagcctctgcctgggggctaagcaaagtatttttaaactgctttggaattcctgggtgtaaaagttactagttcagtccaggcacagaagctcagtcctgtaatcccagcactttgggaagccgaggtgggcggatcactgaagggtgggagttcaagaccagcctggccaacacggtaaaaccccatctctactaaaaatacaaaaattagccaggcgtggtggcggacgcctgtaatcacagctactcgggaggctgaggcaggagaatcacttcaatccaggaggcagagattgcagtaagctgagatcctaccactcactgcactccagcctaggcaacagagcaagacttatctcaaaaaaagaaaaaagaaaaaaattactagttcaggggcaaaaagaaacaccccgcacaccaacacaaagtgccctgctccaacagaaagaatagaaagtgaccatgggggcagtcggggaggccggtggtctgcaggacccccctacaaaacaagtggtgactgctttgtcattctgtccctgggcccctaagctaccagaggaggatcttgtaatccctgcagcagggatgagatctccatgatgaccaatagtttccacttatttactgtttaaagttaggttcatggaagtataacagagtaaacttttgaggtttatctttctatgaattctgacctacctgtggatttgtaccaccaccatcacaaccaagacaggacacttccatcacctggaacgtcccctcacaccctcacccctaaggcaaccactgctcattatctgtccctgtggttctaccttttccagaatgtcatagaatggcatgggatcctaccatgcatagcctttggcatctagcttctttcacctgacagaatgcatgtgaaactcatctatgctgctgattgtaccaagaatccatgcttgcttattgccgagtgccagtcccttagaggcatgcacgagcctgttcatccattcagctgctggatactcaaagtgtttccagctttggcaattatgaaacagcttctataaacatcagtgtacaggttgtgtgaacatatgctttcatttatcttgggtaaaatacttagaagtgagactgctaggtcatacagtaactacacacttaactttaaaagaaactgccaaactgtgaaactattctccaaagtgcctttcaccagccctcagtggggaccaggcaccagcgtgccaaagaagtcttccaggcaaggacagggttcaagagaaaggcaggggaggcgcaaacacttgagtactgcagacctgaggcctcggtgggtgccagggatgggaaggccagggcaagggcacgtgcctgaaaagaactgccacacaagagtcagtatgtgtgtgtgtgcgcgcgcatgcgcacgtgcatgcctgtgtgcatgctgtgtgctagtagggagctggagggagggtggaaatccctcttgcttccccatgaggaaaagcatgcactgaaaataccaaaagagactcccctagctagactcagatgagaacgtcagacacttgagtgcagaccctgggagcgtgcctgacacagccacagagcaggctggctgtctgggcgaggtgatgccgtcccagtcttccacagcaaggggtatttagcccccagacagtgcactctctccaatggacagctgcatctgccctgaaagcgaatgctccctcccagggcagtgtttctcccagtatggtcagagtcagaatcacagtgcaggtctggggccctcctgcggagactcatattcaggcagctccccgctaagaaggccctcggtgactctggcataggcaggctctttacacttggggaaacagcactatgaggtcagcggaactgacgtttatcaagcatctccaagtgtcatgcactttgtgtatgtcatctcatttaacctcacaacaaacctgtgacccaggcaacattagctccactttgcagatgaagaaactgaggctccaagaaattaattaacttcatcaatactaacaggcagaactgagcttcagacccgagactgtggggcttcgaagacaggactcgctgcagtggtcaggttagaggaagtcacctggcagcaaccccgcccccacgttacctgcatgatggcactgaactggggctcattctccatctgctcctcagcgatccccctctggacactggccagcacggtggacttgaagaagtacctccagttgtgatggagcgtccggaaaaggagctcaaacagctcggccttcacatcaggggagggacgctgcaaagacacacagacgctcagacctgcagcttgcggagctgctccggcctgggcccagggcagcaaagatgcctaggagacgcctcgtgacagcaagccgagtgtcaacactccatccacatgcctgtcactacctgcgcaaaagacatccagcccctggagtcctgtcactgcctgtgcaaaagacatctagcccctggagttggcggttcacaccgcgagttcttcaggagagacatggcccacatttgagagagaatgcacgggtcagtgccaagggcccctttttctgatgagcactcagcttttacactagaaaaaagctaccaagtggatgaacaattaggagtatggatttcctgttctattcgacctgtcagatcttcttgcttgttccttttcccaggataaaaaatgctgtcccactaacctgttggtcttacacaaccacggaggctaaagacagacccaacgccttaaagcgattctgctccccagaaggggagggtttaaagaacacttgggagccaggctctctgggccagtctcctctttcccagtagccaggattctgagaggagttagaggagaagggtcaggctcagcagtgttttctcattgactccaactcccccaatcccttattccaaatgtctctgcagaattcaaaattagaaggcccacatatattcagttcagccttgattaaaattaaatagacaccaggggccacaagcatccacagaagaagcctcataggcccagtgcatttcgtaatgcacagcaaccagacctgtcccagtctcagttcagacagttaaagattaactcttatttatacgactattaccaaaaaaactgaaattaaatctatacttattccgggtcttattatgctgagtgcctgcctattttctaagaaggacaaagggctttcctgtaacactgaaaggtttgtttgaatggtttcaagaacttgccttgtatcctcgagaccatgaatgtttctaataggaaagtacatatgttagaatgtttgctatagaaaaccagagtctcttaaaggtataaaatttgccgcaggagactgatcttagcaactgaccctgtggaataactgccatgcttacactagactagctccaatgaactcaatcaatataaaaacactgtaccacaccactaaaggccttcttccttgggagaaactactttacaagcatattaaactaacaaatgaactttaaaacacaatacattttctgtgaaatctcattcccttcccaatctggagatggggggtgctgcacaggggaccgtctgagcccctacctcggcaatgatgggatacacttgctccatgcacagggcgatgatgctggggaggaagggcttgaacacctggcctggctcctggaccaccacctgcaggatcttcagaaacttctccaccacccggcagcctgtgctgccctcgtggaggatgctctcggctaactgctctctacagaggagaaagccacacagtgagcaaccacatgtttctctgggggccagcatgaaaacccatgctgtggcaagtgcagaacaggagcaaaaagccacactttgtcgccagacccaccacttctcccttgaatctgaaaactatagatggtgggtctgtgcttacctggtaaacatgttgaggaaagtctgtatgatttgctcagtgaaaggcacacccatctgtactctaaggcctcgaaacagagtgaggaagaagctcagcatctcatcagtcacatctgaggaaaggggcagagatatcgtcagaggcttgcacacagtgagaaccagaaccctgggcttcatcaacctactcctgaaatctgcactatcagctttctctacagcttcctgctggaaacatttccccaacaccatcagggccaatgatggaaagtggaaaacgattagggacatgctgagaaaatagttctggtatagggaacctccacctggtggctcactacaggaaatgaaggtcatctcgaaccctccctcattgcccgacatccagtgatggtcagagtttcactggagagggatcactttgtgcccacactgatgaatgccaactgggtcaacacctgagtgcttaagccatttccccctatgactaataatccctgcagctgggtcaggggttaagtggttgaaagtggataatgaaggtgtatttaggttgcatggccctggtccattaaatggattaattgcagaaaatactggttacatatagggcagtttcacttccagatctcaacaatcatcttgtgtagtgtgtttcagccctaactgcacgcaatctgcttgcaagaggcaatgaatatttgctgactgagaagtgcctgatatttctcttgtaaaactgacaagactactataatgctgtcatgagagctaggcaagtacatccacagagctagagaggccctctatcactgacagtgacagacaagggtgaggggaacgatctcggcaaatgcaccttgccacaaaataaggagaactaagccaaaaaagctctcttgccttctcttgtaggtgccaaggcccatatggagagctctgctcacttttccaaagggccttggccctagactccacaaataaacatcactgccctttcccctcagtaccgggtttcgttgcacggaacaagtcaaggcctgtactgcaccgactcagtgtgttctacagatctaagtgggtattctggcccttgttagcaccacccaccagtggggcctctgggccagctcctacctgactgatggataaaagctggaaagagggccagggagacctgaacagattcctgcagcgactggtagcaaatctgtcgagacttggtggactcccccgagatattctccacaatatcttctaagacgctgagtgtctggtggataatcagtttggctgcaaatcaagatgagttgcaggttataagctgtctggggagaaagcatggtaagaggagacacaagggagagggaggaaacttgcaaaggtaccaagaagatgatcacacgagtctcactaaaggaacagtctcttgattacaatataaattctcctctctttatgttttagtttttgtttttactattattactgccaggactccagaagcctggaatgtgtgttggggagaagatgcctgcctgcctgcttgctcaggtttttgcctctgttttgcctctggccattggcaacaagtccacagaagaaaaaagataaataaatgtacccccaggttgggtgccttggatttaatcaaatctaaaagatggtgaatagactggtgagaaaatgagtgtcataaggtcacaggccaggacggacacatgcagctcaaaccttgtcactcagtgggatgctactccagcccagtaatcccacaaacacctgccatgcacatgtaatggtgctggctgcaagaacaacctgcctgatccatctttggcctattagccccgtagcttgataaggcatataattactgttattatgttattgacaatacataatgctaaccctgagatgacttttgactccatatggcacacagggaaaacagatgtagtgggccgcaaacaggcagaggtcagagagccctggctatgaaccacaggtgaccatctgaaggctatgtgccatgggcaggaccctcatccatctgggagagccgacaaccccactctggcagtgctgcagtggggattagagacaaggtcccgaacgatgctagcagtgtgccagccatctaagaaggtccaggacggagatgctgccattgttcccagcgcgagtggagtcaccctcttaagatgcagagtttcccaccagcctccccaaagtgacgcccatggctcagcctgagcctagcagactcaaccctggcgaccaccagaggctgagccagagctgggctgagagctgcctcccacttggcagcagtctctgggtcccccgaaccccagtgctcagcagcctctgtgggactgccgcagctttgaggaaggggtacggcagaaagaagacatgctcaggaggcagatggaggcaggcctggccctgctgcccctcatctgaacacgtggatagagagcatcgccccactcacagggctgaggatgaaggaagacgcttctcgccacaggcctggtcctggtcccccagtcacagtgacactggagagtaaaggaaaggctcacccacactgctgagcagggagccgtccacaactacaagcacatggacttctactcagctaggaaactgcactcagggcagccacttcctcaagaacgcacaggcaacaggggaagcagtttagagcaaaaaaccaacagtcaagagaccaaaatctgacctctggcatttaaggaaattcaaacgaggacaaaagatgtatttaaaaaaaatacaagtcaaaaattgaaagcactataagtatataataataggagaatggggtgggtaactgttatacttccatgagacaggacattataaaaccattaaaaccttttttcttttcttttttttttttttgttttcaagaagaaagaggcaatgcagcaaagtggtgcagaacacaggagctggagccattcagacccaagtccaactcttgacctcgcccactttctctacagtcctgagcaattacacctgccaagcaccttcccaatggacagactggcaggccctactcccaacaggcatccagactgagcatcaccaaggatgggacaaacagaagcaatgcaagaggaaatgcgaacacgaacatgcaccactacaccacaacctatggaaacaatcaggcaaaacaagactaggagacatatgacaagaaaacaggcctggacgcttcaaaaatgccaatgtcacgaaagacaaaaactgggcatgctcttctggatcaaaggagactaaagagatataacaaccaaacacaataaaactatcctagattacatcctggattttttaaaagcaaaaaagaacaatttggtaacaactggggaaagtgttaatatggctacattttaaataacattattgtaccaatgtttaatatcttgttctatatagatacaaaggttaagtagtcagagatgaagtgtcaattatctgcaacttaaacagctggcttttaagaaaaagtgtgttgcagaaaaaagcataaatgtggcaaaacattcacaattagtgaatctgggtgagagagatgcagttgttcattttcttattcctttggctagtctgtaggtttggaatttttttttttcaaagtataaagttgagataagaaaaatgaaactttccaaccttaatttcaacactgtggaatgaggataagacatacctcacagggttacagggttacacaggaagttacatgaaataacgtatacaaagtgctcaacccagtgcctgcacacagtcagcatactgaagacgtcattcacatactacactgcaaaccctttcagcacacagtggcatcacacctccctgccctctgagttaagccaaggccatgtagctggctctggccaaggaaatagaggtggaagtagtgttagtttcaggcaagacctttaagaaccactacgcaattcaccacaatcccttccagagtgaacacactgaaatggagccttccacagcctgggtccctatgtgacctccccactctgctgacccaagctggacatatagtacaaacaacatatcctttttcttcttgtattaagccactacacttttggagttgtttgttaccactgagcatatcctcgcccatgcagaccaacataactcccatgtaagataaagtgcggaaaggagaccattacacgtgataaagcatgactccacaacagctggatgcaagccctgggcaagttccttaatcttctagacctcagcttcctcatgctaatcatcaatcaagatcctaacagtaccgaactcataaggctaatgtaagaactgaatgaattactgatttttgaaaaatacttagaaccaggaagagaccaacaccagactttgaaagttgatactggcatagccagagacttgacgatggatatagaatcaccaaggcaagagcctagtacacagtataccctcaatatgtcagctactctcatccagctatgtaaccatgaagcatattttaaaatagaaaagggaaggtaagaaggaagcatggttaaaatggttactttctaaaatattaaaactggtcagatttaggagttactttttccttctttgtattattctattttaatgtatttgtacaatgcacatatgttaatcttcctagttataaaagtagtgttttttaaagagtatagtatttattactatttctgacatttcacaaagcatttttgctgacattccataaatggcaccatctaataatgttctattattttctttttgtgaaaggagctcgtatttttaaaatatttcggtactatttgttatttcaaagagatatttccttattcatttttttccctctttctttaatataaacaagcaaacttcaagtgccattttttaagaaactaagctctttcaaaacctctggaagatctgtatttggaaaaaggttgaaaccaatctggaaaaatagttcttgagcgcattttcccagcgtgtagaggtgaactgctttgtttgcctacacaagcatctgaaatagatcaataaccaccttaagatgtattttatagacagaaggcaccatcaccagtgtcttccattttttcttagggctccagcattttttacattttaaataagagaagggacagtttgattctggaaataggtctggctgctgtcttaactgaattccaaaggtagcaggatcccacccccaagtatgacttcctgctcagcctctgtgggactatgaacaaaaaaaatttacctcaggagcctccggggcaaatctcatctgccacaaagaacaatgcctgcctacctccttccccagctgtcctagcctaggggtcacttactgtcatccagtggcatctttctctgtggggcaacagcactgggcttcaggttgcgatagtcccgggagagtgcagagatgaggctggcgtggttgatggagcgcacgggccactgctgctcattctctggaaggtttggccacggaagcagcaagatgttagagagggctcggcacaccaacacctgggcctacaagagaccccaaaggcatccatcagaggtcagagccaaagaccgtggtgcggcatgcccaacacagccttcagcacccgctggctgcacacctggaaccctagcccccaggctcgtttcttgcaacctgggcaaggcctttggtccaactggaaggcaacttagggaggaagatgaaatgaagtaatagcaccatgtctaggtctagcataacccagagctaacctctcgtttcctctctaatctgatacttgaagtattagagagggaaaaatcacactgcagacactgaatctcaggcattgttcagctggtggcttctgagtcctctgagaagctacttagagcaggacttgcaggagaatccgtgacaatccatgcccctagcaccaggtcacatcctgcaatcacatcctggtgccctctggtaccctcttcaaaccttcctgccctccctcctgttaggtggtttttaaacttctagcttgagcctcctttgaggattctaagaaaatgcacttgcctggcacttctcaaccccaaagaacacacacagaacagtgacaacaaaaaccagactgctttgaatcagaaagaatgcaaagagaattctcacaacactggccgaaattaccaggctgcaaagcagcaaaacctttctgcacactgggaggtgcttttccacgcctcaatcagcacactgactgcctgccttagaatgggcacgatgagaatcactgagtctgtgtcagtgccacacaataagaaatctgtctatgctggtacagcctgtaagctctgagtacaaaatcaaaggccagactcttcttcctcagcttccttgggtctcagtcacacagccctggggaccccgggggagctctggggcctcaccttatcgacaagtcgcagggcagaggcatcagtgattctgttgaatactttctgcactgcagggatgctgatcagaaagacgggccgcacggtggtggccagtgagaccagtaagtggcacgcagatagcagcagcttgtcttggacctgcagagggaagagggcacgtcagctcaccacatccctgtaagactgggattcgaactttgctgaggcagccacaagctatgtgtcattcttggtttccaaattacaccacctaggccctatctagctcaagaatttttcctatgatgactacaagagaagcccatcttctctgtcatgtccacagctcctgccgcagccattatcacctcctcccgttcctccttcacagtcaccagcagccttgaactcaggcacttctcagcttagagtctgcagtggctccctatcagctattaaatcacactccctggcatgtcatccaggtcctagaattcttcacctcactaattgttccagcagagccaagatctccccgagcccccgactcttctgtgccttaacactcaggccagtctctcctactgctttcccttcagcatgcctatcaaatacttggttcaattaccactgttgctttcaaattagcaaaggagaaaaacgtgttacagatgggacctaatgctggtaagactaagataaaaacagcacaccaaaaagtcaaggcaggcagaattacttcgggaaaaaaattactatgatttcccaaagtcacaaaatattcctaacctttaacccttactctaagattacctataacctataatacttactctaagaagattacctaaaagggtaaagctacattcatgaatgtgtgcatttcagaattctttataattttttattttttaagggaggcagcctagaagtccagcaatggctaggaaaataatgaaacatattcctgatgggataggactattttcaaagttataattataaatacaacataaatttatggaaagcaacacattgttattaaaacaatacactgtttaaaaatgtataaaatgttatgtatgactaaaactacaaaaaaattcaaagaataaacacatatatgctctagtaatatagcagacttggaggataacataatagaatctgtccagttttaacatggatataacctttgactcagtaattccacttccaggaatctatccttcaggcccactagcatatgtaagatggacataaaaggaactcatttctagcaataggaaaattattatacatcctcacaaaaaaaaaaaaaaaaaaccactggacattttgacaatctgaagttgctgtacatatgtaaaggaaaatgaaggcatactgttaggcaaaagcagctatatctccagctatctacaaacttagttattacttattacataaaaagagaaaaaagtctggaaggatatacaggcatacctcagagatactgcaggttcagctccagaccaccacaataaagcaaattatgcaataacgcaaggcacactaatttttttgtttcccaatgcatatgttttgtttacactatagtctataaagtgtgcaataagcattatgtctaagaaaacaatgtacatatcttagttaaaaagtagtttattgctaaaaatgctaacaatcatctgagccttcagagcggtaatctttttgctggtgaagggtcttccttgaaagtgactgctgctgactgaacagggtggtggttgctcaaagttggggtggctgtggcaattacttaaaataagacaacaatgaagtttgctgcatcgattgacttcctttcatgaaatatttctctggagcatgcggtgccgtttcatagcattttgcccacagtagaacttctttcaaagttggagtcagtcctctcaaaccctgctgctgcttcatcaactgagtttatgtgttattctaatcctctgttatttcaacaatgttcacagcatcttcaccagttgattccatctcaaaaacccactttctttggtcatttacaagaagcaagtccccatctgttcaagcttgatcctgagattgcagcaattccatcccatcttcagactccgcctctagttctcctgttatttccacatctgcagttactttctttactgaagtcctgaaccccttaaagtcatctatgaggctgggaaccaacttcttccaaactcccattaatgctgatattttgatctgcttccatgaatcatgaatgtctttaatggcatctagaatggtgaatccttcccagaaggttttcagtttatttgcccagatccactggaggaaccaccatctatggcagctatagtcttatgaaacgtatttctgaaacagtaagacttgaaagccaaaattaccccttgacccatgggctacagaactacagaatggatgttgtgtgagcagccatggaaactatggaaactaatatctttgaacatctccatctgagtccttaggtaaccaggtgcattgccaatcagcagattttgaaaggaatctttttttctgagcaggtctccataatgagcttaaaatattcagtaaaccatgatgtaaacagatgtgctgtcattcaggctttgttgttccatttatagagacaggcaaagtagattcagcataattcctaagggccctaggattttcagaatgatacatgagcactggcttcaacctgaagtctccagttgcagttgccccctgacaagagagttggcctgtcctctgaagccaggcactgactcctcctctctggctatccaagtcccagatggcaccttcttccagtataaagctgtctcatctacacagaaaatctgttgtttagtatggccaccttcagcagtgatctagaacttctggagaacttgctgcagcttctccatcagcacttgctgcttcatcctggagatggcttctttccttaaacctcatgaaccaacctgtgttagcttccaactcttcttctgtagcttcctcacctctctcagccttcacagaattgaagggcctgatctggatttggctttggcttaagggaatgttgtggctagcttggtctatccaaaccactgaaaccttcctcatatcaacaacaaggctgttgtactttctcatcactcatgtgttcactgaagcagaaattttaatctcctccaagaacttttcctttgcattcacaacttggctgtttggctcaagagcctttggccaggccgggcgcggtggctcacgcccgtaatcccagcactttgggaggccaaggcgggcagatcatgaggtcaggagatcaagaccatcctggctaacatggtgaaaccccgtctctacaaaaaatacaaaaaaattagccaggcaaggcggcaggcgccagtagtcccagctactcaagaggctgaggcaggagaatggcgtgaacccgggagacggagcttgcagtgagccaagatcacgccactgcactccagcccgggcgacagagcgagactccatctcaacaacaacaaaaacgacaaaaaaaaaaaaaaaagagcctttggcctatcctggcttttgacacgccttcctcactaagcttaatcatttctagatttttatttaaagtaagagacatgtgactcttcctttcactcgaacacgtaaaggtcattgtagggttattaaatggctcagggaatagggaggcctaaagacaggaagatggggaagcctccaatcagtggagcagtcagaacacacacatttatcaatcaagtttgcagtctttggtttgtggcactccaaaataattacaatagtaacattaaagatcactgatcacaaatcgctgtaagatatagtaacaaaaaagtctgaaatattctaacaattaccaaaatgtaacacatggaagcaccaaatactgtcaaaaaaatggtgctgacagatttgcttgatgcagggttgccataagccttcaacttgtaaaaaacacagtctctgtgaagcgcaataaagggaagtgcaataaaatgaggtgtgcctgcacaaccactgcccaactgtgcttaccgcgcgaaggaaaatgtttcagaggtatcacaactttttagtctggaaatctgaatgatattttactttttcacagtgagcatgtattcatgtggaactcagataactaaaaaagtaaagttgtatctgaatgcatgtaggctacaactaaaaaggaacatgaaataaaacagatgtataacagcagaaagatttatgggtctaactctgtgtcatatttagattttctagtaaatgggtataggaacagaaggagagacagagagttagataaaaggtgtaggctttgctgtttcgagaccttggtgctgattagaggtgtgattgcatccatggtagtagagatgagtgtcacgaactgctgcgtgttctgccggtgaacttcactgcaatactgtgctaaccagtgagagtaagcctgcagcgcagccagggactgagcatgcctgcagaaagaaaagaagatgtgattttaaaggttaaggtgaaaatatattagcgttcaactcattttcataggaggtaagaattgcatccactgcatttgctgttctaagacatgggcaacagcatagaaatcatttaccggttcacgtagaacctaaaaactaagatattcatcatctaaacattgccaccgctgactagagcacagaaggcagttagtcaatgtctactgaatcttattcaatctttctgtgacacatgctcacctaagagaaaggtaaattataaaagcaaaatcaaagaacttaagtgatcatgtgttgacttcagaactagtacaaatttaacattcctagctgcagactaaagcgtagacaactaccaggtgtgacagctttataaacagagctttgatgtcagattttggagtttaagcttccactgcaccacacattccacctggctagggaataactgaggcggcaaagactatgtttggtttcagcaaaggctgtactgactgcatcgtacatgcaacaaaatatacatcaaaaaagtatgcaattcatcaaatataataaacaatcaatcttaaacaaggagagacagttgtctcggagcttcaaaacaccaagccttccaacatacctaaatgtaattacctttcggtaataattagtaagttgtaaggtggtactactatgaggtgacacaaagacagtgttcctcatggtttgggcatttattaacgactcctgcctaaatcagtattacattggtggttgtgaattggtaatttttctatctttccttttctcctcattagttggcagtcttctctaaaaagaggctttccctcctctcatccttattttgttaatcactttgggtttttgtttatctgtttgtttacttgagacagggtcatattctgttgctcaggctggcatgcaggggcacgatcatggctcactgcagcctcaaccttctgggctcaagtgattctcctgcttcagcctcccaagtagctgggattacaggtccatgccaccatgccaggctaattgtcgtattttttgtagaaatggggtctatgttggccaggctggtctcaaactcctgacttcaagcgatccttctgccttggcctcccaaagggctgggattgcaggtgtgaggcactgcaccggcctagcctgttaatcactttgaatgagtagattattttcattcaaactggtataattcattattgtccttattctttcttgatgactgaactgtcaagtttgaccaggaagaaccctttcaagctgggtcctgcatcctcttcacatgttcccaacagtcactgagcacttccttacttgctgacttggcaagattgtccaacatcacccccccagacttgagcttttttctccaaggtgctctggagaatggatttgagaaaccaagacctggggaaaacggataggattgctactggattgtcactgtttctaggagctttcagcagacagaattaggatataggcaggtatcactttatttacttatttatgttgctgaaacagggtctcgctctgttgcccaggcaggagtgcagtggcacaatcatagctcacagcagcctccaactcctgggctcaagcaattctcctggcttgcaattctaagtggctggggccacaggcatgcaccactatgtccggctatttttttttttttttttggtagggacagagtctcactatgttgcccaggctcctctcaaactcctgggctcaagcgatcttcccacctcaacctcccaaagtgctgggattacaaacatgagccagtgtgtccagcctagacaccattttaaaagcaaactcagcatcaacaattacagggaaatttgatattaagagccttctgacatgatgcaagaggaaaggcacatcattgcctatgtagtaaccttgctaaaaatgtttaaactgaatctaatataatggaaataattagacaaatccagattgtaggacatgcttttaaaaaaattaagatctggatctgcaaaaggtcctcagtcactctcacacacacacgcacatgcagacatacaaacacaattgggtgaactgttctagactataggaaatacatttaatgtgtggctcatgattagttagaccttggatccaagaaaaaaaaaagatacaaaaacattcctgggacaactgaagaaattttaatatggactatatatgagatgacattattgtatgtattaaattatgtgagggttgataatgatatcatagttaaagagctgaatgaacttatttctaggatacacacactgaaggatttacgggtgaagtgacatgttgtctgtaatttcttttctttcttttcttttttgagacagggtctcactctgtcacccaggctggagagcagtggtgtgatctcagcctcccgggttcaagcgactctcccagctcagcctcccgagtagttgggactacaggtgcaagtgccaccatgcccggctaatttttatattttttggtagagacagggtttcaccacgttggtcaggctggacttgaactcctgacctcaagtgatccgcctgcctcggcctcccaaaatgctgggattacaggtatgaatcatcacgttcagccatgcagtttattttcaaatggctcagcaaaataataataataatcatcatcatcatcatcatgtattgtgtgcagagagggcacaagaaacaaaagccaatttgtaattggttactctaggctaagggtccatgggtgcttattcgcctgtttttcccattttctataggtttgaactttttcaaaattagcagttgggtaagaaaatgtgctagtactttaaagtaagaaaatatagttactgaaagtttgaaattcatagtgaccacacagttattttgtattttacatttaaaattttattttatatttagaatcacattaccctttaagttctaaataccaaaataaagagaaaggacatcaaagtcagccttaggagtaagaatttcagtcaatctagcacatctgtagagctcctcaaggctgaaaggaggggctctgaaactcccaaaatgtgtacaagttgttgtatttataaggaaactggcatctttcttgggagatgctttacaactttctctaaattctcaaaagggaaagcaatatattttttaaaagtttaaaaccaccatagtaagtaagattctctttccatcgtttatctaatctgcagctcaagaatgctctacagcaggagtcggcagaccttttctgtaaaaacccgagtgtatatattttcagatttgcagggcatacatacacactgtcacagctactctactctgctgctatagtgcaaaaccactcccagaccgtatgtaaatcaatgtagctgtgtttcaataaaactttatttacaaaagcagtcagtaagccagatttggcaaaggccatagtttgccaaccccctgctctcatctaaagcaagtcttctgggcagtgaaatctctgggatactgcccatctcctgtccctgtccttccatatgtcactttcctaacagcatcccatgttatctgtagagtttctgtaggtagagagtgtggtctctagatgtcctgcttcaaaataacctggggttcttgtttaatacgcaaatacccaagccttatggccttatgccattctgctaaaatcagaatctctgagaaatgtgttccccaagcattcttctgcatcctacagtatcctacagttttagtcaatgatctacaggaaagactgatggcatctgaggtgtttcccattagtcccaacacacctatccagtctcttcttgcactacatggagtagccacctcctgcctgtgtgactgtctcagcctgtactgttctttcctcctgaaatgcctactccatagaatctccatcccagctctcacttacctaattccactttctccaaccgcctctgccccagacatatagtcaaaaaaatctctctctctttctaggtttgcagtttaagagtttttccctgattcatggcagccactactgttcctttttctcaatcaaattatttggagattgggggcaaggtctttcctaaaaatgcacaaacatcaaactctagacttacacatcaatgaggtcaggtttcaatactgatggcacagcagtttcaatgttgtacaattttatctgagatccgtacagagtgactttgaccaacctgttggcaaagaggcaggtaaacaagaacattcagcttatgaactaagacagacaaaacagacaaggctggtaccagcaaagagcgtaagggcagactttttcatatacaaaaaagaatcaagaccagactttcaattttatgccaaggaaataatctgagatatgcataaagatttatatacaagcatattaactaaagccttattgaaggtgtcaaaaactttgaaaacaatataaatatccaacccagaggaggtaatacaatgcaatatatacaataaaaaccatgcttagaggcatatttaatgataaatattcaggatgttttaaacatgacatggttgtactaaatatacatacagaatacatcgtgaatgttcatctattaacagaagacaggcgggaagaagtgtcaccaaaatatgcttattggtaccacttgttttagggggaggatagagtgggtagattatggatgatttttttccctctatttttctgcatttccaaattatctacaattaatatataatgttttataaatgaggagaataaaaaatagttcttaaaaagcaggcagaatgtggttgctcatgcctgtaatcccagcactttgggaggccaaggtgggaggatcacttgagtccaggagttcaagaccagcctggacaacaaagtaggaccctgtcttttaaaattttatccagatgtggtggcacatgcctgtagtctcagctacttgggagaggctaagtagggaggactgcttgagcccaggaggttgaggatggactaagccaggatcatgccattgcactccagcctgggtaacagaacaagaccaaaatcctgtttgtttgttttgttttgttttgttttaaaaaaaaaactgctcttttggcagtttatcgaaataggatgacgtgggcttttctataaaatttgataatgataaaaccatcttagcttttatttaaaatcatttttaaaaggaaatgtttcagatgggttgatacataataaaaaaaatacagcaaactgtccaccatagaatctatgtggtgggtatatgtgtattccctgtacaattctttcaacttttcttcaaatttgaaaatgtttgataaaactttggaggaggcagatgaaaggagcaaatgtttctagaataggtggaggtgttttatgttcaagtacaattctttcagaagcaagctgttgagcccactggttgctcaagggctcactggatactaacgagcattaaacacaataactaatagctctatctagtaggaaatgggaaatgcctctttcattacagacaggacaacattcctttctctcctcttttttttgagaaagcgtcttgctctgtcaaccaggccagaggattgtagtgatcttggctcactgcagcctagacttctggggctcaagtgatcctcccgcctcagcgccccctcccatagcggggactacaggcgcatgccaccacacccagctaaatttttttgtctttttagtagagacaggtttcgtcatgttgtccaggttggtcttgaactcctggactcaagcgatctgctcacctcagcctcccaaagtgctgggattacaggtgagccaccacgcctggagttgaaagacattcctttctgagtgaaggggaaaaaacccaagacctggctagtttctctctgcctactctgcgtggaaacctggaaatggatgccagggaaggcagtgtttgtctttgtcccagcataacaatcaactaaggaacttgttacaaatacaaacttgtatttgtatttctgattgctggggagcaatgagaaagcaatcaaaaaggagcacttccggtcagtcaagaaagtgagggcaaaagaactaaggttcccaaagtcccacgaagtcctcgtgatcagaacagttattatcagaaaacaatataccaatatgcacctggtgtttaaatcctgttctacactaaaaatgcatttccaaacatcttttaatgtgtctgtgtttagcagttctaatattagctttgttttatgtaaccaataaatgaaaacactgctaatcatactggctattaaggtcatgtagtcataacaagagccttctctcacattttattctaaatgaagacaaaatattaataacaagtatgtttaagcactgggcttggaaatctaagcagtgcagaaagatagggacctatcaaatgattcaggatctttgagacatcatctcactacaaagttgagatgactgacagatataccttttttttttttttttgagacggagtttcactcttgttgcccaggctggagtgcactggcgcaatctcagctcactgcaacctccgcctcccaggttcaagcgattctcctgtctcagcctcctgagtatctgggattacaggcgcatgtccccacgcccggctaatttttgtatttttagtagagatggggtttcatcatattggttaggctggtcttgaactcctgacctcaggtgatctgcccgcctcagcctcccaaagtgttgggattacgggcgtgagccactgcgccccgccaactgaacagataagatatatctatattgcttaacagagtaagttcaaataatggacttatctttggatttcagacagaaaaacatgtcttatccctgctaaacctcagtgcaaatgggcccagtacaagaagaggaggaggaacggactggcaatacaaacgctacggtttggaaagcgcacaacatgtggacccaggaaactgttaaaatccactctccctctcaaagactgtgtgaaccgaggcaaggcactcacatcactgagccacaatgtacttactcaacaataaaacggcaatgcctgtctctcaaagtacagaacaaaatgaaagaccatgtgcaaaaacacagaaaatgtcctactactgtgtgctgtttttattattaatatgaatctggcttttaagggatttaagccccttggctatctttgcttttcagctaagatgtggcagtgaagtctggcatgcatgcacccaggctcctgaggctcacttcccctctgcacgtcaccagtgatgcggctgctgggccagtcgaagcatcaggtgtcttggctttgggctggatccacatctactcagttttgatctaaccaattcaacagctgccttgaaatgatctaaatgtcctgtcacttacatcttgggtttttcgaggggagaaagggaggagggactgctgactgagtagaatcaagtgttcctcaacaagtgcatctgtaaacctggtgtgagacccaagaggaaggagaagaaaaggagcccagtggtgaaaggctgggaaccacctttcgggccaggcgtggaggctacccagctttcactcccgaggccctaatgggactggaaaaaacacaaaaagcaccctgtgcatctagctgcctacttggacaatggagttgactccttatcagtagggctttcttaatatctctttatcctatgaggaaagacatgaagactgacctctcctggtttctcctgggtctacaactgtgtttacatttatacacaagatcttcaaagaaacaataccttaaataacttatcaggcgttttgttatgtgctaggcacagtgctaagtgctttatctcatttaattctcacactaaacctacaggaaacaacatctacttcatattgtaaatgagggacctgaagttcagagaggttaagtaatttgttccctatcagcttgtatgtggcagagcctagatttacccggggccagagcagaagctatttggcaatatgctgcccctcacacaagaaggtaaagctgaactctgaagaaggaacagctccataaggtaactgccagcctacctttccacgactgtgagggcatcattgaaccgtgcagcaaacacatccccgataaagtactcggccaggcggcccacggcctgcagcagggagctcaagtctctcagggagcagtgcagccgccggcagtcgttctccgccgtgatgttcaacctgtgtcctggaacacaacacgccagacagtttttcacaggaagaccacgctttagatactacagataacagctggtccagcaagccacacacagcaaaaccagcagcaaaaccaattcgcgaaacaaagcaacccacgggctgcttcccagtactgagcagggaaactgggcccggtatccacctaacactacacgtttgtgctccagagtccagggacagagacagagttgtgggaaggggcagacagcctggagtgtgctaacgtggagggagcccctgatctgattccttttgaccctgtaaggtcctgacaccatcactgttacatacaaggaggcacacccagggaggcccaggcacttgccaagcacgtgtcacatttccggggcaaggctggtgttctacgctgagtctatgtgactccaaatctggttcctttaggatagggccctatctcagaatgaaatttccatggaccaacagttaggacccgcccctgctaagagaggagaggtacactcagcactccacccctgaaggctgggaggtgacacagtatgaaataaagagtatgggacttggattccgaagacacagattccccgccacttctgggctcagtgcctcatacaaccctcctaagcctcagtatcactattacaagggccatgttaaaatatataaccctctaagctacagagcattgttcagtatttctaattattataaataacaaagaactagtgacttactaaggtctgaaatttccttacttttcaacacaacttcttcaaactgaataaggaggatgctaagatgaaggacaaaacatcctcccttgattcggtcacttccttggtttttggatccctctcttcacaaatgtccacaaaagatagtaagaattttcagagacctgcaggaacagagacctgcaggtctgattcaagtccttctcactgacacagcaggaatgagggtggggtggtaacaccactagggcaccgtaactagggcacctacgatcccagaactccccgggtactttccacacctgctccctccccctacttcagttctctcctgtctcttaggaggcgagactcacactggtcatcaccaaccctcctcctcacactggtcaccaccaaccctcctcccgctgtgctccaaaatcagcttcccagagcccagactaagcttgcagctcccctgaagcaggtgctgaagcctctggaggctctctcctgctaaaaggggagagcctagactctccagtatcaactcagctctctcatggcctcgccaccttctactatgccactatgtcatccagatccactggtaattccccagagcctcgtgtctctgtgcctctgcctagactgctgatcatgtcatcctctgcccacccaagctttgcaagctcctacatagcctccagcctctcaggggcatcctgtctctgtggggcctccccactcctgccttcctccttggcacccgtgcccataaggagataaaccgatgatttacaagtccatctccttactgaccacaaaatccctcgtggtgagcagctatgtccagcagccagcacagcagctggtacagagtgagtgaccgtaaatgtatgaatgatttagatgcaacagaacagacggcaaactagagcaggacagggagtcccaggcagcttccttcctcaccctgtccctgggaatactggcatgtattactgacagtaaacacggatgggtggcacctgcagaaaggaagggtggacacctacaaagcacgtggcaaatgaagtagcaggctgaatgcctcgatccgccaccaacgtcaagggatgaggctcgcaacagtgcctgcgacagcccccaaaggaagacacgaggctggaagaggggacagagggccacatcttaaggagcaggagaacgaaagaagaggtaactcatggaaggacctcagacagagagggccagtgacaaaggctggttttgacctgtcccaaatcacctggtcctgcctcctccactccacaaggacagcagtgccctggcgcagaaacaagatggcagccctgaagaggctgtgggtgcagctaatgagtaagccagctcctccaaccacagcaacagaatgaccatcccacccagccagacgaactcacggaaccaatgaactgagagggattttcatcacactggttgtacgaaagggaacacagacttcatgggctacaaaaagagacagccccaatctctcagttaactgaagtgccaaaattatacaccctctgaatgtcaatgggattttcaaggttatatctatgcaaccaactcccagggttgacttctaaaacctgctcctcctctgcacaccaaccagacctcagggctctgtgggaataaactctaatgaaaaatacaccctgacactgggtatagcatagtacaggcccaaaaagaggggaggccagcttttctttctcagagcaacactgggggtcactgagtccgcttcagcagtccctggcactctccacatgctcaaccttcatttcgcacctccacctccccccaggctctaccctgaccaccagtttccaacttctctatagtatccaattccttcaactaggtacctgctgaatacctgagaacaagcttcttaagtattttaagtgtacaaggggaacactgtatttgttttaaaaaccaaaccaaaacactaccctaaatcaagtttccatttgagtatggtccttaatagacaattactagagagcttaaaagtcgccctgaccaagccgtcccctctgcccagcacttcccctgcacacccggcccttcagcctcttcctggacctcggctgaatgctagggagctcaagggagcccttccatctctggacaacttggtcacaaacacgggtaaagtaaatctccctgtgattgctcatcacccctggcccactccttgagggtagaacacagaacaagccaaagcctgctgacagcatgatagccctggggatgtaacccctcattaccctcctgagaatccttgccatcctgatccctcccctctgaacttgtcctattttgtctagcaaagagcagtacctaggatgacaactatgggtacctagcatccagtacccaggatggaaaacagcttggaagtgctgggtgtgtgttttaaactgtgagtttgaacaatatgaaactgttgacacttgatcacttctgacccaacaaaactgcaattccatacagttccacttcacacatatgtgtatctaagatccatgttcatcaaaagtacagctggttctttcctgttctatctgcaaggcagacaatcgcatgggcaataaataccccaaatcaaattctctacccttgacaccccctccttcagcctataaacctaatttcaccaccacaaaagtcacgcagggcatcaagtaaacttgaggggataggccagtgtcccactgtgaaaagctgttcagatccacccacactttcttctgtctggtcaaggcttagatttccccccaaaagcacaggacatctgcaaggtagaaccttcagatgagaataatgctgaaaggtttggaggcacaaaacatcatggccacacaaaagtcctatcttccacaaaccaagtcattctaaagctgtctaggtatgacctaagccacatccaaagaacagctccttggcaattcactgccctaggggaaaaaaaagtcttaaacataatttagtcttctctttttgaggagttgagggaggtctaaaaattagcattcaggcatttccctctgagagaacaaatcataatcataaatcataaacggacccaagcagaacaaacaatttaagtctaaaaatcttacataaaatgttgtaggcaaaataatcccttacacaggaaagtttgcatgggtaaccagaaaagttaaagggttacttagaggagaaatactgtctcaatgaaggaagatgccaatgaggggtggcagaagtcaaatacagaatggaggctttggggtcacatacggatgtcaatgctgtgcaaggggaacaccaccaatgagggtttcttaacccacataaggtagaaaagacagagggagcaaaggatgacctgccaggagccagagcagcacagagcaaccaacgtggcccagcaagacaagctgtgccttggtcttgacagggaagtggaggcaggctcagcagcaggaagggaaacagtgagaagcacgagatcttctgaatccaactgctctgacaaaagcaaaagtgggagccttccaggctgggtaaccacactgcaggcctcactgctggccaaaatgtgcatcccattgtcatacacggtcacagcaccaggagtagacaagaatcgcggctggcgcccatttacacaggctccagaggagacccaagaactaaaggctgggctagaaagtaaatgcaaatgaaggaaggcccagagcctatcagggatgagagggcacagtttctgctgagggtcatgaggctgactgactggtgtggcatggaggttatttgagggggtaaatggctatgggaaccaggggaaaaaatgtactcagagtttccatttgttaatagcctttgcactggaaacttggcttctgagccaccaaaaattggggaatgctttgtcatggatgagagagctcgttttaaagcaggaaataagcatttttctggcctgggaggttttgccactggagtacaagccaaggatcagtgctgaggatgagatttataaatgatccggacgagccgagttctgtgaaattgccagtaaacaggctttagtgaaagcaagtatgcggtatttcctataggaaaaaataaatcacattatccttctagggagaagagctcagaattatcagctatgtcccagaaatagagtttcagattcactagactttcacctaaagacagacacaacagaatgtaaaaacaccagcttttacaaaagtaaacaggacactgaagggtcagtgtgggggaggaaagaacacctgcttgatttttttaatagatcaagaacagtgtcttcagggtcctgagtacattctaatttgaatagtggtcctgaaggaaagaccacctgggcacgattattcccaaaaatggcttctggaaacatctgtagcacttctacacagccaaatgattttcattagtggtgacagcacattttataagcatgtttgttttgaaagtgtctttttaaagttttgtctttttaaatttcttaccctatctacaaagtcagggcctacattcggggcatgccaaggcccatcagcctcctggggcccactagattatttagaagcttatatagtcatggaaaccagccgtcacagaccaccaaggacagcctcggaaaaaggctcctgtggaggctctgccatgaatcacaagctcatccaggagatgggctgcacactgggcggctctgtgctgggctgaaacaacagttacccaacacaggggctgcgcaccagagccgggacagatcccataagaagcatgctgggaagaaggaagggcagtgagagtggtgcatagcagctgatggggcagggaggacacatgtggctttcagttactggtgttttcagttgacaaaaatgaatgtcagatgttagctatttcaacattttgtcattccctattataccatcatgcgacttgtaccaacaaagccatgggaccctgggtaaattaacatctctgaacatcaatttcctcttatgtaaaacaggggtaactagtaatagcacttacacctcacaggacgatggagagaattaagtaatataagtcaataacacagtgcctggcatgtaatgagagctacaaatggaagctattactattattgttatcaacaaaataacaaagcaaactaaccctaaaccccaagcaggcagggcctgtaaacagcagccaaaagccttttcaaccagctctggtcagagcccctggggccatttgcaacaggtgcagggggcagggggaccacaggccatcagctgcactatggccttccaattctaaagtgagcaggaagcaagaaagcacaaggccatgttctccctagtacacctgctggttgaaaggacataaggaaactaattagaggctttttagtaagtcctgtctctttactccaaatcagtttcttttccaaacacctccttggaatacactgtcatgacctcatcttttacctcccccacagcttttcatcataagcctttaaaaacgttccctgtttcgaagtggggagagatgccagtggggaggctgcagtgaagaaatcatgttccgacagcaacggcagcagtaatgaaatatcagtccgatggttttttgaatgtttggttaaattagaaaataaaaaccagtttacctgaccctgaagtgactataaactgttgtaatcccaaataaacttctaaattgtcctgaagaacagggaactgaaaacaaagaaacaaaaacaacaaaaattttaagccataaatgcaagttttaatagcattttaacattacaacattaacacgtaactatggtgtgaggaacaggatcaaaaccttttctctgggaacctttaaatgcagctaaaaagctatgaccccccttcagtgccccccaactagtttctataattgaaaccgccaattaatacacagaataagaaagaaaacgtattagttcaaccctttttttaaaaaaaaaaaaaaagcaaaggacactgtggtatgactcttacgttcctaatagaggagatcaaaccctgaaatgacctacaccttctagaactctgagaagggaccatatctcccttcaaatccaagggaacctctaccttgagagaaatgtcagctatgccttattaagcacatggtaaagtgataagattggccaaattatttggaagtcagttccctggctcaagtagcggtcagaacgtcataaccggagctgcatctttctttctcaagctgctacactcaccagtaagattaaaacgtgactggcccctaagaaaggcagatggcaaagtacgaagctttccaggagagaacacaagtatagctgggtcattcaatgcaaaagatgaccctatggccaggggcggtggctcacgcctgtaaatcccagcactctgggaggcagaggcgggcagacgacgaggtcaggagatcgagaccatcctggctaacacggtgaaaccccgtctccactaaaaatacaaaaagttagctgggtgtggtggtgagctcctgtagtcccacttactcgggaggctgaggcaggagaattgcttgaacccagtaggtggaggttgcagtgagccaagatcacgccactgcacactccggcctgggagacagcgtgagactccgtctcaaaaaaaaaaaaattaccctaataactgccttgccttgaagaagtgatgaatttaatgaaatctctttgaataacacgcaccacacagggaagggaatcaatccttacaactaaagattccagcacgtatagacacacgcagagaaagctagcaatttgccaagagcgagctttacaaaggccagcttttcagcaatgtaacttctataagtaacagctcccactcggcctggccacttgcaagctactgataaaggtattaaggctttagtcaaattgctattatatccaagactaaacaaggttccaaaagttggtttaatattttgtggaaatgttaatatttgttcagtttgagcatcacttatggtaattattctgtttttaaaaattacatagaggggaaagaggggagagagagagagatccaggggagtcaaccagccatgctctgtgtacagagaaatcgctacactctccactcccccggacagcacattaccagtgtggagaaggcgtgcgtgggcaggagctccatcactttggccaccacctccaagctctgccgtaagtaccgctgccactccgtctgctgctgtaggggaagcacaggagaatcagctctcccagaatcctctcatcttccttgccaacctcaagaccactctcagacataaaattttgaagaaatggaaaatgatggaaccaggttatctggtactataaaaaggccaagctagaattttttaaaaacaatgaattaatttcacaaaaaactacttcctcagaaagtaaatgatccacatagaataagctattttcccccctttgggttataggatacagagatggagagccacttgtgaaatcacctgttggaaatgatcacgcatcaccttctgacacggtccactactgtatccctatccacataactgactgactcagtgccactcagaatggggtccacagccagccagcaaacgcatcccctggtgggctgtcagagatgcaaattctatggtcctcaccccaagcctccagaatcagaatctgctttaacaagctgttccagtgattcttatccatggtgacatttaagaagcaagacacgtcactccccttttgggagatgaggacattaaggctcacagaaatgccacacccagccctccaatctcctccatgcccaaggttgcagagcttcaaacccaggccatctggctctaagcaaagggctctctgtaacccaaatatgaccacccataagctcttgaccatgccgcagtcactcttactttgagaagagcagcagttatttgaaaaattttaaagtgcctaatggtttaaaaaaaaacactggaattgtttccttaaagacattttccttattaatgttgggcacatcagcatcaataaattcaaggctgattttaagaagcagaagtttgcataatgtactccaaacagacttcctttcattctagccttatcggttcagtatcttgctaacggtctccacaagcatccagctagctgttactgctgcccaggttggggagcagaggtgagggtgcaaggcaggggagacagagaggatacagagttctcactaaaccgtttttcattgtgcatatggtttctctacttacatctctagtccacatagataaaaaagcctgtaaaacattttttatggttaataagccaaaagggaccagcaggagattaaaaatttcaaatgtacgactcaaaccagaagactactctggtttcagaacagtcttcggagcagagggctctgggttccaggtccccattctgattgatgtcacaacatgacagcgacaaaaaatcaatcagggcatgccgcttacatcgtcatccagagtctcatcatccaactcctccagctgggcttggttgtatctgaactggattcgattcaacacctctgtgagcaggagcaccagggcatcttcgtacctatgtggcagggagaaattcaacattgaaaggaggctttcagcttagaatttggaaaatgcctcctgcactataaaagaaatggtgtctatgttgatcaccatggaaaaagagcatcgaaattcctgaggctgagtttatgggttggtacgtgtgtgcgcccatggaagagaagcagaggtatttatttaatgacgtaccaggcaccatgtatcttcctgacagactgtttatataacagccttttttgtctctggcaataatttctgtcttaaaatatattttgtctcctattagtatagtgacccgagctttcttttggctactttttgcacggaatatctctttccatctttttacttgcaatctatttgtatctgaatccaaagtgagtctcttgtagacaacacgtcattgggtcgtggctttaaaaaatctgttctctgccttttttaacaggagaatctaatccactaaatgtaatgtaattactgataaggaaggcctcatttttgccattttgctatttattttctatgacttatgttcctcaattcctccattcctgccttcttttgtgtcaaacaggtattttctagtgctgcattttaaatcccttgtcctttcttttactaagtattttcaagttatgatcttagcagctgctctggggatgataggcactgcatataaatattacctaattcaatgatttcatgcttttaacagctgtgagaagtaaatggtatcaatatttttctgatgaggaaacaacaattaacagaagttaaataaactgcccaaggccacaaagctatttcgaacctagggccccctaattcaaaatcatgttctcgctacacataaatcaccaatgaagtgttttgttttgttttgttttgtttttgtttttggagacagagtctcctctgtcacccaggctgaagtgcaacggcgcaatcttggctcactccaacctccgcctccccaggttcagtgattctcatgcctcagcctcccgagtggctgggattacaggcatgacccactaggtctggctaatttttgtatttttagtagagacaggatttcgccatgttggccagattggtcttgaaatcccgacctcagatgatccacctgcctcgacctcccaaagtgtcaggattacaggcgtgatcccgcgcccagcaccaatgggttttaagcctgctccacccaactcccaaaacctaatctttagtccattttaagaagacttagaaactaaaaagagcctggggaaaccctgaccctttgatttgtgtctaagaataatttctcaaagaaatactcagagcggtaggtttggatatttcccacatgtaataagaacccaactcagaagataccaagttataagcaacaattgctaccacaaggaccaacaaactgctcattttcaagaacaaatcatgttgcctaaatactcgcctatcctgaaacgcttctaagataagttaagggactgctcccattcacagagcaaaccaccagtgctggttagtaagctctccacatcaatctgctctccaaagctatgatgctggggctgagactcaaaggacactttgtttcggtctgttaggttctgccagcagggacactggagggagactggaaggcagaagggacaaaaggactgcatccttcctgtgggcttgctgtcctggcagtgctgccccagcaacagacacctggcagaagcaactggttccggtttccagcttcattccacattcccagaactagtatcgtgcaccctcagaggtggaggcaacaccctctcctcaaaggaatggtcccagttcgaaaagatccctcctctgaactcctgtggcagctagatggggccctctcttcagagatctgaaccctagttgctcagggaccaagcagtgatcttccagattttgacagccccagcttcttgcctttgtacttctagccttaggggtgaagccacttcctgtacttatcaactgtgttatctcagtgtttcctctgaaacctatttaatcaatttcctaaaatgaattttctgttcaaataattaagtatggtttctgatttcctgacaggactctaatacaccacccaatctaatacagttgagtactgggacaacatgataaccaaagttaaaagatatccaataccaagaccaaatacagtccatttagtccaggaggtacagcccatgtgatgagaatcagtctacagaccacttacaaatcctcctggattgtcccatttcagattttggtgaccagagtatcttttttttttttaacttaaaaatttaacctatgccaaaattgacatttgtatttatttacttattttttaacataatttcaacttttatgttagattcaggggatacatgtacagactggttaccggagtatactgcgtgatgctgaggtttgaggtataactgatctcctcacccaggcactgagcatagtacccaatagcttttcagcccctgccctcctccccactccctctctatcagtctccagtgtctgttgttgccatcctatgtccacgagcacccactatttagctcccgacagctcgtttcttaactagagacagagacactccctacttgcccatatccagcaatgactccccaactgtatgcaaacgacttaacaacctaacacacgccagccctaaagtagactagcaactgaacagggcccaggaaagaatgccggcagggaaaaaggcactaataaaatctgcaacgtctgtgggaaaattcacccaataaagtcaaaatcccacttagtaaactccatagaaaggtaagatcaaacatttaggcctagagtttatgtttttgcctttgttcaagacataaatttctaaagttacagaagttccacactataaattgctgtgacagatcaaaatatttccacaattctcctaggaaagaaaatctacttcagaccagaggacagatgaattttgtcatctataaattgtcttgctgtgctaaaaggaaatttagagactttctatgcaaatgtaaccctaaattagacctaaaatcttaactggcaattggcaactctggctgcaaaaaaaacccgtatcgcttagaaaattaagtccaagtaggaaccaggcaaacatgcacatagatcactgatctcccaaagtgtcatgtgggaggtggagaaagtatatggctgtggcagacactctggttgcctgcccaatacccattctccttcctcagcaagagagcactgggtattgaggccaactcaaggacaacatctcccctgaagatgggggcggtcaacgagagcctaaaagcagctactgggtgggacttctaagaaagcttcttttgcccaacctatcccacttctcgttcctactgcctgaatcatgggtatgatgtctgtagcatcatccagcatccatctctgaccataagatgatgatggagagggaagccacgcctaatggtagaacaaataagtaagaggattcaaaaaattacttgctactcaaagagacacaacttctcaaggagaagacaatcgacagatgccaacctcaagatgacaaaggtgttggaattatcgatgactctaaaacagctataataacaatgctccatgaggttcctctatggtctgaattgtgcgactcttcccccaaaaagtactcattcatatattgaagcctaaccctcaatgtgtctgtatttgaagacagggcctataaaaaggtaataaagttatgtgaggtcaaagagtagggccttaatccaataggactgttgcccttatgagaagatgaagagacacaagggttctctccctccctttcctcacatgcacacaagaaaggccacgtgagcattcagagagaaggcgccatctgcaagctaccaagagagctcacagaaacagaatctgccagcatcttgaagtggaacttctagactccaaaactaagagaaaataaatttctgttgtttaaggccagcctgtggtattttgttatggtagcccaatctaactaatagagaaggtaaacaatatgagaaagaaacctggaacttcaagaaggaaggaaaagcaagagaaatggcaatgtctgggtaaatctaatagactacttctttcttcttaagagctataaaatatgaatgatgggtacgtgtataaattagaacactgtctggtggggttttccaagtatgtatatgtaaaacctcaatataaagaagagaggctaaaggactctaatctatatggtggtaaggtttccataccacccttgtggtaaaatgtgactctgaaaagttaagtatatatactgtaatacccagagcaaccaccaaaaaaacccacataaagaaatgtggtccaacactcaatagacacactggaaaagaaaactaaatgtgtatgcaactaacagagtctcaaaataaatgaagcaaaaactgatcaaactaaaaggagacagacaaatccaaaattatttttggagaattcacccccctctcagtaactgatagaataagtaggataaagacaacatgtacaggctgggcgcagtggctcacgcctgtaatcccagcactttgggaggccaaggcaggcggatcacctgaggtcaggagttccagaccagcctggccaacgtggcaaaaccctgtctctactaaaaatacaaaaattagccaggcgtggtggcgggcacctgtaatcccagctacttgggaggctgaggcaggagaatcgcttgaacctgggaggtggaggttgcagtgagccgagatcacaccattgcactccagcctgggtgacagagcaagaccccatctcaaaaaaaaaaaaaaaaagacatgtacaaattaaactagaaaacaataacaaaaaggtatatggaaaatccccaaatattcggaaactaaacaggaaatctccaaagaaattagaaaatattttaaatcaaatgaaaattaaaatgtaacattaaaatttgaaggatagccgggcgtggtggctcacgcctgtaatcccagcactttgggaggccaaggcgggcggatcacaaggtcatgagattgagaccaacctgaccaacatggtgaaaccctgtctctactgaaaatacaaaaattagctgagtgtggtggtttgtgcctgtaatcccagctactcgggaggctggggcaggagaattgcttgaacccgggaagcagaggttgcagtgagccaagatcacgccactgcactccagcctggtgacagagtgagaccccgtctcaaaaaaaaaaaaaaaaattttttttgagggataaagctaaagcagggcttagaaggaaatttacagcattaaatgcttatatacaccacagagataagcctataagcctcaagttctgagagttaaataaaattatacatgttaaggcaactacatagtaggtgctcaataaaatatatatgaataaagaacaaatgaacaaagaaatgaatgaaaaacacacaggtgataaacagacaaaattccaagtcaggtaaatacaaaggattgaagcatattcctggatagctttttcaactcaataaagcaactaagactctattcacttgccctgtggggcagtcaagagcaagaactagaaagctgctagagctctgatctaaacctagttcacacctttattgcaccacaatgtcatgtgtaacagtggcacttcctctttattaagcaggttcacccactccaaaaagcaaggagcagtttttctcaccctcactcacatttgtttacagtcctatctaatgtcaccagaatccctacgttggtttgtggccagcacttgccagaagtctagtcacaaagaggctcacagaacatgacacaatgactttaggttgcttcacacactcaggtttcttcaccttcctgtaaaaataagtttctacacaggtgactcccttcacattgacaagcacaaagagccggaagtgagagagaaaggggaggtgaaccaatgcttatttgctgagcacctactgtcagccaaggcactttacgctcattagttcatcccactttctcaacaatctgtgaggaaggcacaaccatccaaaagcacaaacaaggaaagggaaaggaaaatccgggcctttccatgccaccacctcaaaatacagatcaggatgatctaccccatcggccattccactctgcaggaatggctacagaacatttaccccattaacactggggctcaggctctctcaagtccccacagtctctcatcaagaaattcctctcacacctgtaatcccagcactttgggaggccgaggcgggtggatcatgaggtcaggagatcgagaccaccctggctaacacggtgaaaccccgtctctaataaaaatacaaaaaattagccgggcgtggtggcgggcacctgtagtcccagctactcggaaggctgaggcaggagaatggtgtaaacccaggaggcggagcttgcagcgagccaagatcgcgccactgcgctcctgaccaggcaagtgagcatgcagagctccaatttccaagctcctaggaccaaaaataaatctatgtatatttgtgcttctaaatttgtagcctacaatgcttaccactttgttgtgatgaatgatgcaaaacctttaaaccacaggggacaggaaatgagtgctgcctttgtgacttaaccacacctacatttcccatttaagacagcaagaaaacatttttgactacttcctgcaagattagttgcttctgaaatatgattccagaacatcccaacttctctctggtatattttatcagttgacaaacatttgatcacatgtgcatgctcttagttaacataaatgtggtcatcaccagaagccagtgttcttcagcagctgctcctgcaaaacagcatatctctgatatattaagagtctctcatagtctggagtggtgaatgttaagggttacagaaaaaattataagctgaagttgaaatattttctttgtgcagcccactggactaacacatgttctttgtagtctactgtcttagaccactaaggggtatctgacaggacatgcagttccccagacggtggttactatttaacagcactaaccagaggagcttggaggggtttttgttgttgttgttgttttattttattttagagacagagtcttgctctgtcgcccaggctggagtgcaatggcatgatcatagctcactgtggcctccaactcctgggcttaagcagtcctcctgcttcagcctcctgagtagccgggactacaggcatgcaccaccatgcctggataatttttgtattttttgtacagacagagtcttgctatgttgcccaggctggtctcaaactcctgggctcaagtgatcctcccaccttggtccccacaaggagctggaactacacgtgcacactaccatgtctggctaatttgttttttaagtttttgtagagacagggtctcattatgtaggccgggctggtctcaaactcctgccctcaagtgatcctcctgcctcagtctcccaaagtgctgggattacaagaatgagcaatggcacttggcctgttgttttatttttcaaaggcataaaggcattatatgaaagtgttatgtttaaaaaagaataaatcatgaaaaattaaaaagcctcatttaggatgataatcacatgatcaatgagaaaaattcccactgtttcaagtggtcagccagaacaactgacaactgtgacattagacaacagatgccagggcaggcaggtaaacatctgcaggtgggctaaaggcctttagactgtccaggggccatgccacctaacgctacagtcacaaccacagtctaaaggcagtaacatcttctattattcatcattgctgttgtcatcactgtgaccatttactgagtgcctaatacatctagatgctgtgccaggtattttacatacatgatttccttgaatcctaaccatcctgcaagagaagtgttaagtacgtccattttgcaagaggaaatgtgatcagcatataacttgaccaaaagtaacacggctagcctaaagcaaaaaaagaatttaaattctctataccactgctctattagtataatgatctgcaaaagtgtgtgtttaatactaataatctgctagtatatattttctcaacaggaccatattcttcacatctctcatttgtactttgtttttgtttttttaaacagtctcattctgtcgcctaggctggagtccagtggtatgatcttggctcactgcaacctctgccacccgggttcaggagattctcctgcctcagcctcccaagtagctgggattacagatgcctgccaccacgcccagctaatttttgtgtttttagtagagacagggtttcaccttctcagccaggctggtcttgaactcctgacctcgtggtccccctgccttggcctcctaaagcgctgggattacaggcaggagccaccgcactcggccttgtactgttttttaaaaagcattttcatattaatcatttcctcagtttattctcacaacaagcttgagagatatgaaggaatatctaccactaaatatagaaaaatgaggcatagtcccagaaccaaaaagatatgcctatttagcatgcaagaaagattattttggcaaaagtaacttttccttcaagaatctcatttcaaaaacataattacttaaagttggcaacttcaccaaaaacaggatctcctgtgtgtaatacgatttctgatatatgaacgtactacctataatcacacatgtgacctgacaccatagcaacctggaacttattccacaattacaaaaaccatctttgggaacaaaagaacaaatgtttaaacttggaaaataaaattctcaacagaatatttgcatatttatttattttaattttcaatagagacagagttcagcaaatggtaccagtgactggtaccaagagacacaaggagtctcactatgttcccagcctggagagcagtggccagccacagcgtgatcactgcacacaacagttctgaactcctgagctccagcgattcttctgcctcagcctcccatgtggctgagactacaggtacatactaccacatctaggtcctgtttagaattttttaaactcataaaacctcagcaatggaaaagcctttggagttccagcccaaccttttctctgcagtggagtctctcctctccaccttcctccatttggtacatttatggggaaagagtattcactaacaccaccaccaggtgaacacttgcagtgtgccaagcattctaaatatgttagttcgttatttcaattaatgtctcaacaactattattttcatcctcattttacaaatgaggaaacagaagcttccacaggctaagtaccttacccaagtacccctaggtaggaactacaaaaccaggatccaaacataggtctgtgcgattccccgtcatggcttccactcgacagaaccccctcatgcactggttttacaacacaatgaccacctaatctgaaattgctcttataaatactgtgcaaagaagtaggagctataaccaaactgagtaaaatctgcaggcactctgttaagtatgataaagtacttagggctagatcacctagtttgtaatctcatagcataaatatacaaattacacgaatcagttttagtttattaggaaactactctgatcctaaaatgcaaaatatagcttctttgcctccttcatgactgcctgctcactgtgtgactgggatgcagtcacctactgagactatgatgggtatgtttctgctaagaaaagctgccacatttactttccccatatatggatgctgccattattttcctggcatgctgaatctccaccttcccctcctcttctccccaccctgtggcacaaagaacatattgtacaggaaatatactctcttcctgcaagcaagaaaaatgggtttgagaaacatatggggggggaaacaaaccattccgcattctctgttttttaaaaatacaacaaaaagtgcaaaagcaattatctctggggtgtgggattatgtttatcttccttacattttcctatatcttttcctagatttaaaaatgaacacctttttcttaacaggtatttattaatttatttaggaaattttcaaacacatacaaatggggtaagaacataatgaaccccaagttcctaggaactaactccaacatcaatcaccaacacatgggcagcctgtttcttctctacaggaacccacttcccttctacccccactgggttatttaagcaaatcccagatgtcatatcattttatccaataaatacttcagtttgtatctctaaaataagggctattaaaaaattaagaacattaacacaaatgcactaaaatataaaaaattagtaatacatattacttttaaaattttaaaaagtcttaacaaaatacttaaaggagaaaaaaaaggaaatgctcaatggcattattgcctaaacagcttacatgactcagcttcactgaaaaggtccaaatgcatggctgtctcttaggccactagaataactggcaaaatgaccatatctagttttcagtgtttgaggagtttacctgttgagaactgcttccttgtctccaagacgacttttaattttacttgtcagatagtccaaaaacagcgtccagatatccaaacaagagaagtaaccttcatgagtaggctatggtacaaaaaaaatccagacaatgaaattatttaatgctactattccttagaaacacacacatgccagtgtttaattccagcagaatgatgaaatcataagcctagattccccagtttcctggtaaccaaaactggtggcttttagtcggtctataccattgggccctcctgaaccttacaagacaagggtaccatggaacacatcatgagggagatactgtgcagcataaactgagttataaaataagtcaagcaaaaacctatcttaaaatctgagactggtagagagggctcttacagatcatctagtttaaatctattttccagagagaaatcgagattcagagatataagttgttcaaggccagaggtaaaaacaagtccctttacccccagccaatgctctttccattacaaaccattacgaaagcaaaaatcagtttcagtggctccaaaggtgacaggttcacacatttgaatgtaaggaaagtaacacttgcagtcttcctacagaacagactgaaaatgagctcattaagtctgaccctcagggcattatcccatttgcaaaagcaagggtgtcaaacgtgctaatagcaacctccaaccaggtgctgatgtggaggaacaaagtgagaagtctttgtaggatcctagtagtacaatgaagaccactgcactagttaactttctcaagggctctgagactctatttcatgcaaagtccaggcaacacaatctccaacagctactccttcccctatgcattcaggttcaacttgtggctccaaaccctgatatctccactcaaatgctcactacctgaaagactcctttggttttgctggtggctgtctcactggaccacatatttggtgacaagatcaaatatgaaaataaataataacatgaccttcttggatcagtttctttccattgctgatccacatggaaatctagacgtttacaagggcatacatggaggtgcccaagaaataactaacaatgggtggtggtatccagtgggagttctgtacctaagctgaagtctgagacagaataagtgtaacttggctgggcgtggtggctcatgcctgtaattccagcattatgagaggccacggcaggtggactgcttgagaccaggagttcgagaccagcctgggcaacatagtgagactcggtgtgtatattttagaaaaaaaattaaaataggaaaggaaaggaagaaaaagaaagaaaaaagaaaagagtgtaacttaaaaagccaggcaaattccaacttcacgacccaaagggtagctctggaactagacaggaccaacctcagaaaacaaaatgaccaagtcctgtctctacctcatacttggcaatactgacaatatccacgacatgaagtgaaccaggagaataaccaggaaaaacaatgaataagccacatggaaatgatacggcagccagaccgagtggctcacatctgtaatcccaacactttgggaggcccaggcgggtggatctcttgaggtcaggagtttgagaccaccctggccaacatggtgtaaaccctttctctactaaaaatacaaaaattagccgagcatggcgatgcacgcctgtgatcccagctactcgggaggcttaacaggaaaatcgcttgaatccaggaggcggaggttgcagtgagctgagatcgtgccactgcactccagcctggacaacagagcaagaccctgtctcaaaaaaaaagaagaaatgatatgagtagtccttggacaggccactagacttgcccatccaagagacacactcttgtcctaggttcaacttgctgagcttccctcaagtcaatcaccaaggttatccctccttggttcaaaactatccactagccccctcaaaagagcacagctcatcagatgcatatggaagtgcctttgggaaaggttaccacataaatccaagtattatggctccgtcaaagtactttataattatacatataaacttcatgcatgtgaattgaggacttgctatatgctcaaggctgggggaaaggtgagcagacacaccctgtataacctgaagcaccacctttcacatccattcctgcaggccccactgcgagggcttgtgcactgcccacaggccgcccatgacctggcctctgatagttgctgtggacatggttcattccggtcatcaagatgatgggctggctccatttttgaagtcgcctaacttttcaaaaccttcacagacccatttttaaaatggacctagaccccaatttacttttcagattccagggctacaaatccaggtttctttaagaaactaatgataccattctatcttccaagtggtttacagtgtttagttttcatttgcattggtctatgtgatcttcataagtcttggaaagtgaacaaatattttgcatcttccccttttacagataaagaaaccaaggctcaaaagtcaagtccagtcgtatcttgcccaaggtaacaagacaattaaggaacaaaatcagaactagaaagtggatcttggccaggcacggtggttcacacctgtaatcccagcactttgggaggctgagtcaagtggatcacctaaggtcaggaattcgagaccagcctggtcaacacggtgaaaccctatctctactaaaaatacaaaaaattagccgggtgggatggtgcttgcctgtaatcccagctactcaggaggctgagaggtagaactgcttgaacccaggaggcagaggttgcagtaagtcaagatcgcaccatcgcactccagcgtgggcgacaagagtgaaactctgtctccaaaaaaaaagaaaataaaaaaaaaaaaaaacaaaaggaaggtggatcttaaggctctgtggtccacagccctcccccccagggtataccatctcaggcacagtttcaggaagaaggggcaaaatgaaaaacacaagaacaagaaggaagtggtgaggacgcactaagcttaggagcattaagacagagacataggtttatagacagccaggaggctcagcaagcaaagcaaggcaggaggcagcagacacctgctgagcactgctacctggaggcgctggcggcagggcatttacagaaaaatgcaggaaaagaaacagaaaaggagaaacggttaaagaagatactagcaccatcttctgtcttatgactgttcttcgaaattatgttcatcagtacagtcatgtaccatataacaacatttccatcaacaatagactgcatgtgtgacagtggcccaattcaagataacccctgtatttttattctaccttttctatgtttagatacaaatccctacccttgtgttacagctgcctacagtattctacacagtagaatagtagagtagtactctacacagtaacacactgcacaggtttgtggcctacaccacctagcctacttgtgtgatggactctcccatctaggcttgcgtaagtgcactctatgatgtacacacaacgatgacatcacctaacacattcatcagaacacatccctgtcaattaagggacgcaacacacgactgtactaaaatttgtgaattttagaaacaacaggcaagaatattaaatatatttatataaccctctagacgagagaaagacacattttcccacattacaggtaataaagctatgagagagtaagatcatacttgttagtgaacagatgagaacttaaagctgtctcttgagatcatttaatttcttattcttaagtcttattccaaagacctcccctataagcaggccttggtcctagagtgcaccttgccaccttttcaccattctacctccccagcaaagggctgtctgccctggtttacccacagtaagctgggacagtgtacctttcaggttcctgtccctctacctaatgctcagaatctgattctgtctggacgtcaaagacatacctactcccacaggtggccagcctgctcccagaaaggaaggtcctcatacaggagacaggagagcagaaaggagctcatctgacgattccaggtacagagaggaggaaagaagcttgtggtttgcttcatgagcatactttttccccaattactttcccaatatataaatataatatataaatatataaaaccaccattttcaattcgatgacacataggagtctactgaaagaatcataaaaaataagccaggggaaaggcctgaagatgtccactgcagtctattttcttaggtgaggaaactgaaatctaagtaaatttaaggtttctccaaggacacagaactaatagaaataagcagacctcaaacacaaaacttttgggtccaatccaaagaatcaggcataagacatgcctactttaaaagatgtttcactttcttctatactatacacaccagaagaccccattttacatagagagtgaaatgtcaagacattgtcattccatctcccccaagtaagcctcctgtttctggcctcagaactggctcctcagctccctcatttctgttacgctatttaacactcactcaacattctctcaaatcctcttttttcatggtctcctttaaaattcctctggatgtcccaaaactgttccacctctgatgcttctcccctacatcctcaccctcctgcagtcacttcaagttctcctgaggactatgacctcggcacggctctcctcatgctctgcacgcacttgcccctctacctgacacctctgagcttcttcaagttttggccttccctcccctgctcccaggactggctcatccttaccactgggtcctcttctattttcacatgccaagatcttccttgagaaaggacagctttcccaacaaacccctgctccaagtcatatacacaaccctcctagcctagacccttgcctttcctctagacacattaagctacaacactagtggttaaaaaaaaaaaaaaaaaaaggctacttctaaaatcaaatgtcctcagtgacccattagtttcatccctggtacatatcaactaaaacagctatctgtgtacatccaaaagcacgtacaagaatgttcactgcaagatcagtaagcactggaagcagccaaatcagcaggggagtgaacttgcaaacaatgacttaacaacagcacaacgaaaatcaacacatgactgccacacacaacgcaaacgaagctcacaaacacgatggccaataaaaacacagataaaacatacattatgtgctttcattcagagaagctctaaaacaggcgaaactagtctgtggtattaaggtcaggcctggggttacttctggggagaaacgaggggaagtgattggaaaggacatgaggagatttcctggttgctggcaacaatgtacttcttgacttaggtgatggttacatgcatatgtcaatttggggaaaactcatctaactacacctaagatttatgcacttttctgtatgtgtgtcatacttcaataaaaagcttattttaaaaacacacagctgggcacggtagctcacgcctgtaacactggcacttcaggaggcccagacaggaggctcacttgaggccaggtgttcaaagtcagcctcgtcaacatagcaagacccaatgtctaccaaaaactttaaaaactaagataaaacacacaccaacaggcacgggggataggatgtgatagaaatatctaaaattgtactgtggtgatgtttggacagctccatgaattcactgaacatcactgagttatacaattacaatgagtgaatttcatggtatataaaattatacctcaataaagccacatatataattttatatattttttatgtgtgtgtgtgtgtacacacacatactagaatgactagggtcactagaatgtaagtaaactcaatgcaggcaaagactgcttgtgaaggttgtatgtctaaatcctggaatacaataggagctcaaaaaatatttgtgagggggagaaaaacttggacactaccaaaacttaactcttgagagcttcactatatataatcttcttgaaggaggtttcagtggcagttacagaacagaactaaaggccgtaatttcagacttttcctttcttttgctttgttcacataatagtggtcaagagccctgactctgggttcagatcccagctccaccacttactaactgtatgactctaagcaagttactctttgtgcctcagtctctttacctgcaaaacagagatgacaatggtaatagaacctacttcacagggatgttaggaagattaaacctgtgactcttcacataataagcattatattaatgtttggaaaataaagttgaaagaaaaagttctttcttctcaaagtaacaaggtaataaaccttttctctggaagggaaggatgactttggtgctttacctgatgaaatgtgtacttgaacaaaagtgtcaaaaactccaccacagggaactgggagtaagactcgattcttcttaggtgaacactcacaaagagccgaagaaagtcagtaaacttctcgatatagctaaatgagacaagacaaaaggtgacaataagaaacccagccacctccttagaacttaaattcaatccaaagttctttcagtacagaactatacaaatttgtaatatattttcttttaaaaatataaaggcctgcaacaattacctacaggacaggcaacccttcattccattaaccacctgaaacatagcagaaaagcaactttaatcctcagacactgtctgctaaggcttcttataatctagtgcgctcacattttctaagtcatttgtgttgtgacccaattaaagtgaagggaaatgataaaaagttgatgggcagatcactgtgtcatttcaatctggcaagtctagaaggctggttttctttccgggaggccaaaatactaaagtgaatggtgctaaagacacaaaaacaaaaccaggctacgaagggcatggcatccaggtaagatgtactcaggcttgcaacttaatggccatttttccccctttggttcctggtgctaattaaacacagcacaacccaatactctaaaagtgatttcaaatataagggaggaaggctattagaactgggcaagcctcagggactttagtctgatgcttccgttttgcagatgaagcccagagaggtaaagtgaccagcccaaagtcactcagccaactcatggcagaacaggactatcatccactcccaatccagtgctctttcttttcacttcacagtgaatccccaactcatttgtattcacaaaatcatttcacagaagagtatgggtcacagctgcaaggataagagatctctgttattaaatacacagcacatcatcactctcacatttcagaaactgtcattttaagcccctaaataccaaaaggtgattagaaaatgagatggccataccttcataaatcacatttcagagaccaacacaaaaaggtaaagacatactaggccttagctgaaaatgaaataatggctaaaagcaattctgaagctcattactgcaaaagctatttttcaaaacagagatatgtgaaataataaaagcagagaaaactactactcagaaaagcaaaactggcccggaaataaaatgtcccatgttgctcctgggacctatctccctgagggtggccagcctgcctgcctgacctctatgcggccgagcttatttgcagctttttaaaaaatacatattaatttgttttgataaagagaatggctgtctctgtggatcatggggccaagtactcgaaaaacagtaaggcactaaaatcaactgtttttagagacaggaacatacaaagacacttctctctggtgtcatcaatcactaatactcaagagtaggaactccttcctcactcacttatgtaccgcatgatagttttacatggatattcaaagtcaccacccagctgactgttctttaggaaggtgcactcaattccctactacccatttaaaaaaaaaaaaaaaaaaaaaaaagccatgggctaaatacagaacaatctcaattttactttagtatctaacccaattttttaaaaatacaaacaaggctgttcagtagctaaaactacagattttatttcacctcattttctttcccttgcccaccttctggtacaggtgctaatgaacagtagaaagttaggggaaaaggcagtagagggaaagagaagccaaggatctggttagcagctcctaaacaactgagaatggactgagctgtttagaattagtggtaggggacccagagccaggaagcaagcacacagcattatttatgtcacctttctgctcccaggcacctctcagctttcacagggcaataggaagcacaggattaaaatgtaaaaccaagagcacaaaagttacacgtaacaacatcagtacatagacaatccataatgacatttctataccatccaaatggaagccacaacaaagttgtctgtgactacattatgattaaagtcaaaacaactgatatttgatagttgatacaagcagctagatttttaaattaacatatgaagagatagacatgagacacacagatcattaaaaaaaaggtaatacagcctttcttaaccacagacagaaagaatatgaaagtgtgaataatgatgcctttgaattcatatggaaagctatcaccaaataatttttaagaacatattaccatatcagattgtgttcttatacagagcaaacatcacggttttacaataaaccaaaccaaaataatcttatgtaccaattttttaattttagaaatattttacaaaactgcccaatttaaaaagcactacaactttcaactttatgcacttgattttatattctgctatttactctaaggaaaagaaaatagcttaattctatatagcttaataacaaaggacaatctaaggaaaactgagaatattagcaacttttgctgccatgtcatctgtaaatatttactaattcgatacgatttattgcttgaaagtccctaaaccgtcaatctgattgttcataatataagtttccaaattccctcctgttttcatacagcagcagttgtaagatacataaatgacctcatctgcaagagacataaatcatgaaaccctgcctcagagtactgtgatggagtcgtcttttagagtgcttttaaaaaaaaaaaaaagtaggtcattgtaggctccacttgagaggacaataacaaagaaacacagctgtgtgctacattaacctgtgcacacattaacatccctcctatagtttgatgaaaacttgccattggtgtaaaactcacaataacaacaacattcctgaatactgcaggatgttcacttgggaaaagtcaaatagtaaaaactgacaccaagtgacaaaaggcgattataactcctgtacctccacggacctcttctcctgttcttggctacgcaggagcagcagtctcagtccctgcaccacctcagacctgcaagcaaatagtaaggaaaagggggcaagaggagtagaagggaggacaggagatggatggggagaaaagacaacaaacctacacaaggcacaagcatttttcaaactcagtcacttcccttaaccacccaagcccttccagctaatctcagacttactggcacacacctacctttctgttcctcaccaggagccccatattctgaaatcaaagaggattacagatgccatgcagcacagcatggtaaacagtcagggccctttcttggggcacaccagctccacacttggtttcattacctctcatcgagctcttctagcctgctcttcactgtgtgggcattgttatccttggtgattttctgcaggaggtagaaagtctgctggaacatacgcagtaaatactcctcaaattccataggcacacagttcttggacatgagttcattgatgcaggacatggccaggacccccagccggccgcgctcctgacccgagacacagttctggctgctgccgttaactgacgccatctttctggcccggatgtcacagccaaatcgtgcaaagtggaagatggtggtaaggagggatggggtgatgctggcagacagaggaatccaactgaagagatgggccaggcactccaaagccagggaacagatatactcactctccacatcaaggatgggaattggctgattcaacagtttggctgaactgggactctgcaacaggttactcagtaagtcacctgaaaataagaaaggcttttaagctatccagcatcaaatctcttacaaatgactttaagtaattctccttcaaaaaaatatatatatatatgtatacatatatgtatcagtttagttacctatgaaataaaaaaataaaatctatatgctcaaagttaaacactaattaggaaattttaacagtacagcaaaaataagataattgattatgattcttagtgagggggatctggatacaatctttagtgttttgactcaaatttagttttagtgagatttgtacaacagcagtttcccaggagacataagtgaagagaagatgggattattctctggctgcaaaaccccaaatccactcaagtttttgttttcttgctactgttcccccaaatcatgaccttgcttttgaaaagcatgatacatgaccattaaataaataaacaaataaaaatccctaacaccacatacaaagttgggcaccaaatgaagtaaagacttaaaccaaagataaaactttaaagttaacagaagaaaatataagagtatttgaaatataagagagaaaaagactccttaaaactaccaaaaaagaaaaccttaacaaaaaatactgaggaatataacaaaattaagattttctaatcaaggctgggcgcggtggctcatgcctgtaatcacagcactttgggaggccgaggcgggtggattacctgaggtcagtagttcaagaccagcctgaccaacatggtgaaaccctgtctctagtaaaatacaaagttagccaggcatggtggtgcatgcctgtaatcccagctacttgggaggctgaggcaggagaatcgcttgaacccaggaggtggaggttgcagtgagctaagatcacgccattgcactccagcctgggcatcaagagcgaaactccatctcaaaaaataaaaaataaaaataaaaaaagagttcctaatcaatgaaaaacattaagggaaagttaccaggcagacaacagactgtgagaagatattcacaatttctaacatcgaaaaggactaaaaactaaaatctatttttaaaatgctacacatcagtaaacacaacaaccccagtacaaaaacaggcagttgatatggagagacaattttcagagaaagaaactccaaagcatatgaagagatttcaaattcattagtaatcagaaaaagcaaattaaaaggagtctgaaaaaatgttggcaaatgccagacgtcaagtacaaggaatggatgcaggaaccttcacaaggcggtgcaggaagaagggccattctgaggaggacctggcactctggagtcctattaaacattcacatatcctttcacctgaccattctcctggtatgctcccaaagcaaccctcacacgggtccatgaagggacaggcgtgagggggagagctggaggcagtctggcctcctccttggcgggagaggatagggaatgcagagtcaggtatcatatcacacagtgagcagaagtagaggactaaggcacagacgggcaacagcttggagagaccttaaaaagatacagttaaattaaaagtaagaaacagaatgacagttttactataccacttacatattaaaatacatggacacaaaacagtaagttcttacaagaacatgttaccaaacagaagacagaggttatctacattaaaatggctgttgattacggggaagggagtccacaaattcaaaactatttttaaaggaatactaagatgttcttttcctttttcactttcattatctccaagtgtacaatggagctttccagaggctacatcacatgggatattgcaacagatgaaatgcagaagctgcctttcactaagccacatgttagagatttgcaaaactgtaaaacaacaccactcttctcagtgaatttttctgtttgctttgaaaaatatagttattttttattaaagcatattatctgttaatatgtaatgggttcatcacagatatttttaaatgaattaatgactatttgtacatttttctcagtttttctatcagcagatataacttacaaagtgttttgaggacctcagtaattttttaagagtcaagggaccccaagacccaaaattggaggaccacggggctactctgtggacctggaccagtaatgtaatcagggaacttgtcagaaatacaaatcatcaggccccatcccacacctactggagtagagcctgaaggggttggggcccaggaatctgtgttcttataagcactccaagtgattcttatgcttgcttgatttttgaaagcactagactaaaggaaatcaaacaaaatgaaacaggggaaaaaaagctataaaattattttagagaagacaaaagaagaaaaatatttaaaactataacaacaggccaggagcggtggctcacacctgtaatcccagcatttcggtaggctgaggcgggcagatcacttgagcccaggagttcaaaaccagcttgggcaacatagcgacaccccgtctctacaaaaaatacaaaaattagccaagcatggtggcacatgcctataggcccagctactcaggaggctgaagtgggaggatcgcttgagcccggggaggtcaaggctgcagtgagctacgattttaccactgcactccagcctgggtgacagagcaagactctgtctttaaaaaaagaaaaaagaaaagaagaaaaaaaactataacaagaagaaaaatttcctgaaatttgacatgactctacaacatgaaagggttttatcctgttccaagaaaaaaatgatgaagagtgatcaatactaagaatgtttaaaatgaggaagcagtgtaggcagaaaaagtacagatacaaaggagaaaacacctcagtcagacttctccacagtaacattcacagcatggggacattctctcaaacacgcaaaaactcaggtaactccacaaattcttctcaaggaggataacagacaaagaaaccacacagataaagagataaatcaaaataaagaattaaggaatggagaagctgtagcaaaaggacacactggcatcaaattacatagagactcaagactaaacagacgtaggaattaagagggtgcgctagctaactttcccatctttcacaaggaagaagtctcaaaatacatggtctaaaattaaacatggtggcggggggaggtgatacataaaattcaaacatgtagtacaaaattgatttttatcattttttcttaaccataaaggtatcttttagaaattagtatttcttgtagaaaaagcacctcaaggtcagcaattccttaagtttaacaatttttgttacgtttaggtaaaacctggccgggcacagtcgctcacgcctgtaatcccagcactttgggaggccaaggcgggcaaatcacttgaggtcaggaattcgagacaagcccggccaacatggtgaaaccctgtctctactaaaatacaaaaattagctgggcgtggtggtgcgtgcctataatcccagctactcgggaggctggggcaggagaattgcttgaacccgggaggtggaggttgcagtaagtagagattgcaccactgcactccagcctgggcaacagagcaagcctccgtcttaaaaaaaaaaaaaaaaaaaaaaaaaaatcaagtaaaatgctgggtactgtggctcacacctgtaatcccagcactttgggaggctgaagcggataaatcacttgaggtcagaagttccagaccagcccggccaaaatggtgaaaccccatctctactaaaaatacaaaacttagccgggcatggcagctgccacctgtaatcccaactactcaggaggctgaggcaggagaatcgcttgcccctgggaggcggacgctgcagtgagccaagatcatgccactgcactctagcctggataacaaagtgagactccatcaccaaaaaaaaaaaaaaaatcaagtaaaactaaaatttaaatgttattaaaaaatatataatctgatgccatttttgtctttttatctgtcttatctctgtgtagagatgtctggagtgatcaaatattatttgatgttctttctatgtaagatactgggtaaatgtttacattttattttgtactttacagcactaggtctcaaatgtttgggtttcagaagtcctcactcttaaaaattactaagcatcccgaagagaaagctcttaggagcattacttctattgatatttgccatattagaaattaaagctgagaagtgtttaaatatttaattcatttaattacaaagccatcatgttagcataacatttttaaatgaaaaaaactgtattttacccaaaaatagtgagaaaggtagtacagtttttctatttttgaaatctctttagtggctggtttaaaagataactagactctcccaactgcttctgccttcactcttttgcaatagattgttttcactgaagtatgtgaagaaaatgcaactccacacagatatgcaactacaaatgaacaaagggctttagtggccttttcaaataactgtgtctattctatcatattagattaaagtctgatgaatagtcatttctgaagggttaactgcaatgtggaatctggaattaacttttttattcatatactcatgagagaatgggaataaaaatgacaaacaatgtcttagtatttttatgaacacatacctggcctttgggactccctaaaagggtttgggggacttccaggggtccccagacttattgagagctgaggtcttatgctaacgctggaagaacatgaacaagttggctagcctttctcagcctcaacctcctccgccattataatgaggattttgtgaattcattaacgaagggtttaagttctattcttaaaagtggacttatcaagttgatttatgaggagccaaaaaaaagaaaagtagatttaaaagctgtccctagcatgtggctcagaagactttttccagaatggatgctaaaaggaaaaaaaaaaacaaaacatctataataatacttatggtaaaagcagtaacagccaccatctgctgtgtgactacttgcttggccctatactgaaaactatatatgcatattctcatttaatattcacaactctaaggtgggcattattacccatatttacagaccattaaaataactaaggcacagacagaccaagtgtttccccaagtccctctgctagcataaggtagaaatgaaaccaaaccagggtctggcctcaaaaccaatgtttccttccaaaaaccaagttaactggaaagattatgcaaccaggaaaaatgagcaataagaaagctaatatttaaatacagaaaaatattcctaattgttctcctctgtattaaagtgaaaaaataaatatggaaaaatatgtatggcctaaaatcatatgtaaaataatagcatgtgtataccatgactacaagcatagaaagacaaatatgtgaagacaaagactgaacaagattatgcaaaggcaaaaactgtttaggtggatatgaatgatctgcgattacttttgtcctcaaaagaaagaaaatagcaggaccatggtcatggaagtcagcatctgctaaggagtgtaccacaactcatttgcctaaaaaggttggggtgagggaaagaacctgttaaggctatttctccataaaaacgattttactcaaatttaaatgtttcaaggtattttagtggatggcggaagtgtttttcaaaaattacaccgtaatcaaagtggaaggaatcagcacaaaacagattctgcttcatgcagcagcacttccaatgcaaacctaagagagctttatcaagttctctatggaagagggtagcttgattacaaaacctgtgaccctggcagcgatacgcaccaatgcccacagagctgtgtagacaactctggtgcatttactgacttagaaggaatgaagacatggttggcatatttgtaattttttttttttttttttggagacagggtcttgctctgtcgcccaggctggagtacagtgatgcaatcatggctcactgcagcctcaacctcctggactcaagccattctcccacttcaaccctcccaagtagctgggactacaggcaggagccaccatgcccagatatatatatattagagatggggtctcactatgttgccaacacaggtctcaaattcctaagctcaagtgatcctctcacctcggccccccaaagtgctgggatttacaggcctaagccaccatgcccagccctgtaataaactttcgtgcaaagctttttaattattgaaacttcatgtttttcctatcagttgtatatttactaacttaagagttttccaacctcagcactactggcatctggggctagatcattctttggtctgctgtgtaccgcggggtgtttagcagcatccctggcctccactcactagatgccaatagcacttctccagtcgcgttaacctaaatttctccagacactgacaaatatcccctgcaggacaaaccacagctctaactgcagccttggccagtaaaatgggggaaaactctattcaaggagcccctggaggagaaaataagatcacaggagttgtaagtgaccctcccaagtcccacctttctataggtagtatacaaggaatacatgaaaagatttgcatgaagatatgcaatctgttaagagtttgggaggaaacagaagactggcctcaattcacactctctgatacatcctcatcctgaagaacttttcatcatcacgtatgtacagatctatatttgaaactatatatcatgtgcatgagaaagatatggtcccttaattttactgcagagcaatcaaagctaactcagaattgctgtagtcacataatctcattctgtgcacttttttccccaatggtccaggcaaagagaagtgaacatgagaggagatgaaggaagatgaggctgctcaagtgcagcaggaaggaacagcctcagcaggcgggggggcaatgtccacatcttccctcatttatcctcagaggaagctattccttttttaaagtcaaggacatcagcggtcagagaaggtgaaggatccactcaaggtcacagagtaagtggcagggccaagactccaaaccaggggaagaaggaagtggacagaattggtgagaacgaccaagaaagcaaagctaggacaatgaccgtgcacctagatttggaattctagggttctggtaggggttcatgtccccactctgctcactggcgatgcaacccctggcaagcttccttgtttgtaagcaagagacagactagtctgatctcgtgaggtgagtgatcactattgcagccagtttaggagttaaggtaacaatttgggggaactatgctgagaaataaaccacacacactccttcaaacttttttctacatccagactattaaaggagttgttgcaggaactagtccctgggctttgttctttaaaagtaataagacagaaaattacattaaaagaaagtatatggggaaaaaaaccccacaagcctcaggtggctactaaacctaagacacagggcaggagagccccacaggggctgagctaaggaattcatttggttgcttcactgggccctacagtttctcagaacaaattttctctagaaaactgatacggtcaagaaagcaaaacaactttctggaagttttactgcttaacttggcatcttaagcgcacaaagacagttgaacaaaagcatcaaaatgaatggtgattgcatcatcagcactgtccaaatagtggggcaagatctaatgacttcacttacattaccataaaaagaaagaaaaatactgtaacaaatgaacatgcaatttttttttaaaggggaactttaccagcttaaaagcttacataactccctaagtgcccccacagtctcaatttattttgttatttctcaaatactaaaatccaacacttcaaaaaattttaagaggcaattctcaagaagtaggcaccacattttaggttttgttacaagcaaatgtcaagttagttcatattttattccgcttagccgcataaaacctaggcaacacatggaagaagtaagcacatatctctggtttgtattatctgacattccccaacatggccctgaggaaaacagagcctatcaaagtataaactgagttagctcagaacctgtttggatgaagccaacagaaacacaaacaagcatttcttctacagtaaactgctgttgctaataaaccatgctagcgagtattcaactgtctaaaataaatctaactcaaaagaactaatcttggctgggtatggtggctcacacctgtaatcccagaaatctgaaaggctgaggcgggtggatagcttaagctcaggagttcaagatcagcctgggcaacatggcgaaaccccgtctctacaaaaaatacaaaaattagccaggcatgttggtgcacatctatggtcccagctacctgggaggctgaaatgggaggattgctggagcccaggaagtcgaggctgcagtgaattgtgatcacaccactgcactccagtctgggtgacagaaggagaccttgtctcgaaaaaaagaattaatatttgcaaacagaatttaaacgaaaaaacaaacttaactgtggatactccaagacattcgttcactcataaaatcaaatctctgaatcatttccaaatgtttctttaatctccagataccgcaacatataaatctgctgagccacctcaaatatctacctaaagaataaaggtttgccaccaaatacaaagttccatttcctatgagcttataatgcactctagaactctataattgtttgtaatctaagcagtatgacaaatggctctctaataatttttaatccaagtaagataatgaaaatttgtaataattagtgcactatgagtactccccaaaacttccagatagatttttcaattctagagtaactctgtaagaatttcagcttccacatactaacaacaggctacataaaacagcttgggcttagagacgtctgacttccacagcctatctccttgaaataaaggagaagatgtggaaatatttctcattagccacatcaacctttacagtagaggaagctatatgtgtcaattcacaggatgtactctgctggaaaagcatttgtgatcatttagtgtaaacagcagcatttagaaactaaaagttcctgttcagatgcaatttcctctttccatccatccttgaaagtagtcatctttagaagaactacactctgaattttgaagcagatattaacataactgtggacaataactagcaaccagtaaactatttaatagcctctgcaaatatgccccgctttaccaaatgactcttaaccaatgttgattcaatgctaactactgcatagtctccactatgcaggcagagaggtctccactatgcaggcagagaggtctccactctgccttggccaacatgaatccagtgaggaagaaagcactcaatattcctgttcctatgtcctctcctgcaggctgctgcccacctcctgccacccctacagaaggacaagcagacgtttcaagcccaaaggctcctaacaatctcagcacaagcacataaccatgacattcaggaaaaataaaaaaatgagggaaacaacctaggactatttttttaatgtaatttttaaaaacagagatagagtctcactatgttgcccaggctggtctcaaactcttggcctctagtgatcctcccacctcagcctcctcagtactgaggactacagttgcaaatcaccacacctggcccccaatacatttaaaaagaagaatgccttggctggcaggcagaccataccactttctcctgaggtcggggatggtggtggagtggcagcagtaacactgtgtttgtcccagacagtctccaagatacctaccaagaaaggagaaacagagttataagagaaataatgtccagcatataaaaatcatatttagagaaagtttcttgatacctctgatcaaacatgagtacttgaacatccctttcttgaccatgtcctcctccagctagcggctgtgcctctcgacttcacagctatcttctggctctccactgcttcactgtggccttgtggtgtggcctctccccactgttgcctccagcactgctctttgccagagtcacctggttgctgcatgcactcactggtcacttaatccccatcctccttgaccacactgtggcattacaggccattgcctaaacccttctctgagctggtagcaccactctttcctggcttttctctggtttctttgaactcaattctatccctttcactattacttccatcctctgcccatgagtcatttaaacacacgtttccccaggttccctgactgacctgcttctcctctcatttcactctcactgctagagtgactcatccactgctatggcttcaatatattctgaagcctctcaagtctcctgttcttggcccaaactcaccttgactatatacaccaagctctgcctcacacgatgggggcttcagaaacaaggcaaggcagtaacagacctgcatgtccacctgcttcctggacaatgctacgtgcatatcccaaactcaacttttcgttccccacaaacctgccaccaatcctttttcgttcctcatgcaggaaacaggctggaaatcctggcttctgctgacctcatctagcctcacctgacccaggcttcagctcacccgacagacgcggccttgctatgctcaactgtctgctgttccttctacatgtgtccctctcaacctctgacctgctctcctcctcccaatttcaacatcacctttccaccagactaaatgccacctgtctgtcgctcaaaattccattcagctgtcacctccttcaggaattcctgcacataaaacatacctctatttagctcttaaaacatctttaactgtttacttgtgtctccccactcaagtgtaaattacctgagggtgggaactgtgttttcttcctctttgtacccgtacagaacccggaacataaggtgatcacaaaggcttttgaaaatatcttattctcaaatttttcatattaaaacctgaataaatcttgaaagcattatgttaagtgaaaaagccagacacaaaagatcacatattgtatgcttccatttttatgagaattccaaaaaaggcaaatccatagagacagactaagtagattagtgaatgccagggattgggggagaggagaatggggcggggtgggggagggtactgctaatgggtatgatgcttctttttatagtgatgacaatgttctggaattagatagcggtgaaggttgcacaacctcaagaatatactaaaagccggtcaatattgcactttaaaatggtgagttttatctcaatttttaaaatatttaatatactgctgggcactgtaggacacagaggtataaaacatggtccctaacattagaaatttaacatttagttggggtgtcaaaaaatgtgctttgagaccaggcacagtggctcatgcctgtaacttcagcactttgggaggctaaggcaggaggatcacttgagcctaagagttagagactagcctgggcaatacagggactctatgtctagtaaaaatacaaaaattagccaggcgtggtgccgcatgcctgtagtcccagcttctggggaggctgaggtggaaggatcgcttaggccccaaaatctgaggctgcagtaagctatgttcacatcaccgcactccagcctgagcaacaaagagacatcctgtctcaaaaaaaggaaaaaagaaaaaaaaagtgctttgaatgaataaatactctgaaggtttaggtttacccctggggctttagggaaggatggggggacaaatgccaagttctttttctttttcttttttttttttttaaagagacagggtctcactctgtcacccaggctggagtgcagtggtacgatcataggtcactgcagcctcaaactcctgagctcaagcaattctccttctttagcctcctgagtagctgggactacaggcatgcatcatcacacccagctaacttttttgttttgtttttttttttttccagaaatgggggtctcaatatgttgcctagtctggtctcaaactcctgggctcaagtgatcctcccacctcagcctcccaaagcactgggattacaggtgtgagccattgcactaacccaagtttactttaaatcaatggttctttcagccaactttaagtgcccaccacatgccaagcactaaactggagatataaagaaagttcctagacatccaagaagaagcctggataaaggagttagagataaaaacttcttttcactacaagattccctcaagtagcaagcccaggctcccggcaccctcagggcctcacggccaggcattgcatacatgtctccctagcaaacaggtatcacagcagcacacagcagccaccccagtcacccagggcactcccctctcctcctaccttcctgtctcatgttgtggtttgctttctgtttattcttaccctttacaccttgtcatgaggctctcatcaaacagaaaagacaaaatgctacatacaactacaacctagtgcacaaggggctggctccacaccatgtctcacttccttacccagaacgggaaattttcatatcctcctactccaacttctcctgatcttcaattcaaattattttaaatagagtgcttgccacccacctaacttaccatgcagtgatcggcactgtaggtatactcctatgacctggactctacctcactgatcacagttacagtgaagaccacttcgtgaaagactacgaggaaaataaggtacaaatctattttgtagtcctactgtgtgctagaccctgggctataggtgttgggaacgcagcttcccattttcatgctatctcagaaacagcgcaaacaactgctcaaagctgctgagtgccaaggcctgaactctgggtgcctgcgggcaggcctctatctctgggcactaccatactgctcacctgtcagtagcccaagcactgtctgcacctggtccagtagcagcttccgcaactcctccttccgagccacactgaggtcctcacggggacaagccagctcttctgaagttgtcttcaacatgatcagcccaaggggggttgtcacaggggactggatcaactgccaggaaaaagcatgttctgagcagagtgttggactaataaagtacaaagaggactcagtagcattaaagctatgaagcatctgtgtgtgtttaatcttacatgaacataaatcaacacttcagaaacatcacttagaggccagctccaatggctcacgcctgtaatcccagcactttgggtggctgagacgggcggatcacctgaggtcgggagttagagaccagcctgaccaacatggagaaatcccgtctctactaaaaatacaaaattagccgggtgtggtggtgcatgcctacaatcccagctacttgggaggctgaggcaggagaatcgtttgaacccaggaggtggaggttgtggtgagccgagatcgtgccattgcattccagcctgggcaccgagagcaaaactctgtctcaaaaaaaaaaaaaaaaaagaaacatcacttagaggatatttaggtagctctttttaaccattcaaaatacattctcatcatattttatggacaaaattctaataccatgaacttaaaaacagctagaaaacaatggtcttttatacctaacatgacaatttttatacatgtccagattcctaacacagcctttgttactttgtctagtagccaagttttgtgtgtgtatgtatataaattatatctgtattagtgattaagatgtgtaaatcaatttgtgatgtcttttcaatatgcatgttgttaaatcaactttacacttctaaactttgcatgcttcagaaaagttcatgattaaatatagcagagcaacaccatacatacatgtcattaaactaagattagttaggattttgcaaatacccatgtagcaaattaagttgctgtttctatcacgtgtaatagtctctctaccataagaaagtttaactaaacaagacaaaaaaagtacgccttcaacagcaaagcactacttacatcttcctaatcatttttacaaaattcaaagcattactattacacttattttttaatttccagaaatgataaaagtaaacaagttgccactaaaattatctgttgagttaattgctacaatctataaaagagcagacaatttgaaaagcacttcaagtttttccttaatcttaactttaaatgtagttaattccctgacacactttttttttttttttacttaagctaaaaaaatatataaactttagggaagagcagaacactcaggaactgcacccatacagactttatattcttcacttcaagaaatacagggtacgggctgggcgtggtggctcatgcctgtaatcccagcactttatcacttgaggtcagcagttcgagaccaacctggccaacatggtgaaactccatctctactaaaaatacaaaaattagccgggtgtggtggcaggcgcctatagtcccagctactcaggaggctgaggcaggaggatcacttgaacccaggaggcaaaggttgcagtgagccaagatcaccccactgtattccagcctgggcaagagagcaagactctgtctcaaaaaaaaaaaaaaaaaaaaagaaaaagaaagaaatacagggtacattcctttcccttagaaataactctccctatcacaaagcaaggaaaagctcacccctaaagaacaggacaagtactcaataatgggaacttaaggtaaattcaagtgtcttcagaagcagcactaggtaaccagcagcaatgaatgatgtgtttaaaatgctctctataaattcaggtctcttgaacactaaaactttgtatattctccacaatttttatcttcgttttctacaaattgggcctatttctaacactgacttaaattcagatcatgcagtgtagggaggacaggaaatttctcttcacacaatgaaatagaactgatccttggtaagcatctctttccatttggagacctttggcttatcagtctatattctaaaagattcccattacttcctccttttcctttctttctcctctacctcttttgtctctattttcccctccaggctgcatccttactctctcagctggaaatgactcgtaatgccaaatatcccatttggcaatatacaccctcctataaatatgaaatgctgtgcttcccagatataaaaatcccctacgatatggaaaatctatctgcaagctctccttcctctcaccatttaggggaaggggagaaggtcaggcaagaagccagatgaaaaaagaaagctattctttacttgaaaaagagcttgataaaatgtataatttttcctctcattagctttgtacccaggaagcttttgattaaaatagtgtctccctttaccatcttcacatctataatttaagcctgtaacataggtaatctctgcaatttaacagacaataagctcctgcaggttgaagaacaagttcaggtttctagcgtgaacttctgaaaaggttccattgtttttattacacgacccaacagaagaaacagcaattctctcctatgctgcttgccccttaagtctctagccccacgtacaatgtgaccacaggttctgctcaacagacttcaggaatttgaagaacaggttctagaaccattagtgttatgtgtgtgctgacgtatatgcaggcaggtgggaaggaaagcggtcggtttcaatttcgattacttctccaggagcctagaaagggtataaccaacccaccgcacgtaaggctgggttaccaaatcaacccctctctatctggttatggtggtcaccacaattataacaaaaactgcatagataccacccaacaaactgtcacagcgtttaaaaaaaacaaaaccatgcaccccagactgcaaacacaacatgagccaaaaaaaaacccttgagatgatttactcaaaggatcaagtgatggtgaaatggattccagaaccagtttggcattatttaccaatacctgaagaaaatgtttacagttagccctccatatccatgagttctgtatccaagggttcaaacaaccacagatagaacataatcaggaaaaagaagaaaaaatggctgcatctgtagtaaacatgtatagttttttcttatcattatttcctaaacaatacagtataacaactatttacagagcacttaccttctattaggtattagaagtaatccagagatggtctaacctacacaaaaggatgtgcataggttacgtgcaaactatgcctttttatatcagggacttcgacatccatgaattgtgatatccaaggaggtcctggaaccaatcccccacggatacagagggataactccactatattatcagaaatgtcagcaattgggcactgatcattgagtactgatcattcttgacaaggcttatatgccattgtctagttcacaagaataaataagaagcaggacataacacaactggaaaggatttcaaagatcacttagtccaaccctctcattttacaaagaaagaaagggaagcttacctaagtggcaggaggtgctaaaatcaaaggggactttaggctaggggcagtagctcacgcctataatcctagcactttgagaggccatggcaggaaaatcacttgaggccaagaagtcaagaccagcctaggcaacatagtgagactctatctctatttattaaaataaaagaaaagaaaaagaagactttacacaaagttgggtgcagaacccaaacctgctgcctcacagtctggctccttctactacatggtgtttcaaagtcacgaaagctacatgaggttaaaggagtcaatactgaaggggttgaaagcgggaggtggtggagaacagtggacaattagcctttttaaacctccagaagcccttcacctaaaagtgctctcttccaaatccatcttttgttacaaataattatacttcaaatgtagccaggaaacgttctgttcttcatcaaagggaccaatcccagcggtggaactgtggctccaccttacctgctatcatcaggcctgtgactctccgtctcaaggtccctctcttcttgtcacaggacgcaccactaaccaacccaggaataggttcacttagactcccaaccctcttggtctttcctgtctccagtgggcttccctgacgcccacttaagagagccttggagagggttaccataaccgtcctcaacttggattgaaggcaagtgtattggacagaacgccagggaagtgtctcccacctcgtgtccccccagtccaggcctactggcctgcttgccattcctcaggtcctgtgcacttcctattctctctgcccaaaatactgttcccctagatacccacgtggtgcacgccatcacccccactcaggtttctgctcaaatgtctgtccccagaaaagccttctacgagcatcccatctaaacacaacccccgctagtttctttccccttccctggattgagttctcatcatacttataaatacctccaagtgtgtacctgtttattgttcgttgatgccctcatccccgccctgagatcataaattccaggaaggcagggacttggtctttgttcattactatatcccctcatgtgcttagtgttcaacaaatagtttacttgaataaaggcatgaatctcctttgcagtaacaacccaataaatctctagataaatgaagcactgtacaaaacaaaactaaatgaagaatttttgtgcccctttgagagacaatctgagagaagcactttggatgctgaattctttttgaattgctgcatcattaaaatggtttgtatgaagagcaggcagaacattagaaaatgatattgttctggaaaatcctacagtcactgagactataaacaattttcaaagaactttatttctataaactgtatataatacccacttcctgcatacccaagactagctcaatacatgaaaatgtttccaacttgatcacaggattcaaatgagcaacagcatctccctcgtagcttttaggtcccagttactcccttctgacttccaaatcctgatcccagatccacacttcctaatgtctcattagttattacaaagaaggaacacacaaattttaaatgcattttctatcaaactgaattcaccatcttctgcccaaattcattccccttctttcaaccctggcctgaaaaatctatctgagccagaaaactggaagtcattctagattcctcccttctctcccctctcacctattgtcactggcctcctgcccccatcccctgggtgcctcacctccacccaccaggtcgtctccttttggctcagatcctctacaccctgcctctttccctctcacctcgcccctctgcaatccagaccccagctagccatcattccaccataaacatgtagccatgttttctccctccccaaaacttttcattagctccctaggaaaaactacgaattgcacaatggaaccccccaacccttcctggcctggcctctgcccatcaatctagccccttactctgccacttcaccatctcacatctcagcccaacaacaccaagtctacatgctatgccaccatagcactctgcatatacttccacaataattaccatattgttgagtaatcactgtttgcacagctatttcccccactaaacgccgaaactactgaaagcctcacccttgtacccccaacacctagtacagcacctaacaggctttcaaatactggctgaacaaactgcacaagaggttaaaaagagattaagtttttctcccccactttctccacctcacaaagatacaatatgtcttataaatataaagtgaatgcgataatcagtcctacaataacctcactactgcagttccaaactgctaatcttaaaagtcctcttcaggacaaggaaataatcacttcaacaaacaaactattcacaagataaagtttccttaggcatatccttacctgtaaaatgttagtaaaaaagtcgtggtagaacatgggccaatcctgacgtccaatatcaacaataactttgcagagcttgttccggataaagtaaggtaaggttttatggtgagccaaaaggagtttgggcagacagctacggatttccatcttatcctgagatgggaccccaagccacattttattgatcagattctgaaaaacaaatatacatcttttaagttaacaacctatacacaaaaataactgcttttcatcccacaggtagctattatcacttcaataaacaagaatccctctttaaataaaggtttggggcaatatggcaataagaataataaaagtattcaaatcttaggacacaacagtcccattcctaggaagaactgccaaataacagaaacaaaaagctgtatgtgcaaaaacttttttacaccactgtctctaatggccaccaaaatataatgacagaagcaacttcaatgttcaaaaacaggagcatgccttggtgaataatgtcataaccacatgtggggatataaaataaagtggggaaaagtagaatacaaaatagcatgggcaatatgattacaattagattttttttttttttttgagacggagtctcgctctgtcgcccaggctggagtgcagtggtgcaatctcagctcactgcaagctccgcctcccgggttcatgccattctcctaccacagcctccagagtagctgggactacaggcacccgccaccacgcccggctaatttttttttttttttttgcatttttagtagagacggggtttcaccttattagccaggatggtctccatctcctgacctcattgatccacccgcctcggcctcccaaagtgctgggattacaggcatgagccactgcgcccggcctacagttaggctttttaaaggggggcacagaagacaaggattggaagagaggtgataaataaaactttttgttgttggggatgatggtattatggttattatttctcctcctaaaatgtttttatttaattatctttcctttatcaatgataacaggcagggaatagttacatgttaccacaaatgacctacctacttaaccctaaagtcaaccatccatcttacctttctagtgtggaagatggaagatgccccaaacaccagacaactacataaagacagtatgtgggacgacatcccagagctgagctaccctctcccagcacattacagctctagtctagtgctaatgatatggcaatagaactacaaaatccttttcagaagagtataaaattactgacaacttacctcaaaaactgttaaactgtacatcattacatagtcattcctagtgctggagagaaagtacaggcagaatctccaggctcctatttgctgggcaaagttattaagaagctcctctggaaaagttaaatggcaacaaaagaaagctatgaaaatacatgaaattagacaagactgggctatcttattattatttaaacatgtctctctgcatataatgtaaatgatgtcaaaaccagcggattctttaagatagaaagaataaatcatacaatatttttctgcgtctgaggtgaccatggacactgacaatgttttcagccacctaaaagccaataacctcgctatggatatttctctaggcagagaaactttcactgctaaagttcttatttaagctaatgtgtggctggaatgttctaagagtacccttccatcttcttaaaactgctagctaacttacttcgtctgaatatgagctacattctagggcctcgccattcctctacaaatcttcagtggagcctacattgttcacacacacaaaatgacggctagaaaggcagaaaaagaaaagattaagactaattctacaaagataggaaaggaaaaaaatgcaagagaattcaaaacggctaactcttcatttgggttggttttattttaaaacactgccaccaaaaaagtgaatcgaccggtggcaagagcaacgatgacgagtgttgcggcgagtagccctgtccacacatcacgttggttagaaacggttttcctcctcctgaggctgctgatggcatcagccagaacccacaaggcagcaagcattacggggctaccatcatgtttctggacatgctgtcccttagtcaccttgacctgctgcactggtcatgaaatataatccaaaaagggtaaaagtgcaaaggcccacaaccttgagagattctagaaagcctttggaaaagcagaacacacagcagcttcttctaatcctcaagtcattgctctgctagttccctacaacttaagctaaatgcaacgacgcagtctcattaaaaaatccatggaaaggccaggcacagtggctcacatctgtaatcccagcactttgagaagctgaggcaggaggactgcttgaggccaggagttgaaagaccagcctgggcaacactgagaccctgtctctacaaaacaatgaaaaacttaactagatatggtggtaagtgcctgtagtcctagttaatcaagaggctgaggcaggaggagaccttgctctgttgcccaggctggtctttaactcctggcctcaagtgatcctcctgtctcagccacctgaatagctaggattataagcatgagacaccacgcacagatggctatttaaagaaaaaaaaaaactcgacaacttaggagagtgtcaaaatgaacatgctttggtgtgcctgaagctttagcccaggaggccgaggttgcaatgagctatgatcacgccactacacccagcctgagtgatagagcaaaatcctatctcttaaaacaaaacaaaacaaaaaaaaaaaaacaaaaaaaggccgggcccattggctcatgcccgttaatcccagcactttcggaggccaaggcgggtgtatcacgaggtcaagagatcgagactatcctggccaacatggcgaaaccccgtcactactaaaaatacaaaaattagctgggcgtagtggcaagtgcctctagtcccagctacttgggaggctgaggcaggagaatcgcttgaacccgggaggcagagcttgcagtgagccaagattgcgccactgcactccagcctggcgacagagtgaggcaccatttcaaaaaaaaaaaaaatccaagccttttaattttagatcatttcaaagagggctcgtggggctatgaaaccatgagctcttaatgctatgaccaaagactgaagttctctataggacgccatagcactcaatggtgctgttttcctgaggagacataagaaaaggggggaaacatatttttgtagagatggagtcttgctatattacccagactggtctcaaacccctgggctcaagtgatccacccgccttgacctcccaaagtgctgagattacaggcatgggccaccatgcctagtcaaaaacattattttaataaaaataaaagttaattacaaatccataaaaggaagctaacagcctgccctaataattaagcaaaggtttctgtgaatccccaaagtgaagtcaaaccagactggaactgaggaactctgggctctgttctagactctgagtctgaccccaggtgagtcactgctcccccttgatgcttctgtttcctccactctacaatgaccacatggtctcgaggtccctgctaacagctctatcaatttctagagcactagtgatttacctttgctggagggtgggtggagccctttgaagaaaaggcttccttcctttctctgaccaaactaggaaaagcctagagtttatcccaagaccatagaaaagaagcaataagtagtccaagtccacacactcaaataaagctacaatgactaggtacaaagagaactgaactaagacaagcctactgtatagaaacaaacccctggattcccctcagcctgcactcaaatttggcatctggagcatttggctacttaaatctcttttaagatcagattagaatatgaacatgttcagaaggttctacgtttaattcatgaaatagaaggtgagaaatatttgatttacaaaccaaaaattaaaagaatcaaaagcatttcaattataatctaaaacaagacttcaaagaatacagtagagtgtcagaatatcgaagactaatggccaggcacggtggctcacacctgtaatcccagcactttgggaggccgaggtgggcagatctcttgaggtcagttcaagacccacctggctaatacggtgaaaccccgtctctactaaaaatacaaaaaattagccgggggtggtggtgggcacctgtaatcccagcaactcgggaggctgagacaggagaatcgcttgaacccaggaggcggaggttgcagtgagccgagatcgccccatgaactccagcctgggcaacagaatgagacgccgtctcaaaaacaaaacaaaaaaatttttttttgagacaggatcttacattgcccaggcagtgggaagcccccaaaagtaataccagttatgggatttctgggcactattaggttcagatcagacgtctgcacagcaaaacatgttcattttgacactttcctgagttgttactgtttctctttaaataaccatccaggtgcagtggctcccgcttataatcccagctattcaggaggctgagatggaaggatcacttgaggccaggagttcaagaccagcctgggcaacatagcaagaccctgtcccaccccaccctagacgcccccaccaaaaagtcgcaggcttcttatatgaaagttcaacaacattgctgaaattaagatccacagtgatggattttctttcctttggtcaagtggaggggtttccccagccaccagccaacagaaccagagcgaaaagagcaagaattcaagtggaaagcacgcagacttgaccagtcacggctacgaacaactccttcctccctaccagggcctcctcattataaattcctctttacaagtcaatgctccacttacctatctcacgttttctttcattggttgtacaatcgtgaaaaaattctgtcatcagactttccaatgccctgagagaggcttcttcagatgcctaacaaaggaatttgaaaaaaaatcaataagctgcatcttcagttccactgttcctcagttccttctaggtcacattcaacagcaagagcaatttacttcctcaaaatcttggttcaacattcttcaaatgcatggtatatgccagaaaaaactgaagggaatttcccagctggctcaaaacccaacgttgttgttgcatcctctataaattcatgctactgtgcagctgattttcaattatgtatgctaagaaaaggggaaattcaaaattcaactctggaataatgattgaaagcaaattagcccctggcccttcctgaatgggcagagcagagagattcaagaaggccagaactcctcatagactattcatccctgatacatttcccctgtgtctgaataatttgtcatattttgattcacagcacttatatcaaacagcttcatggattctcaggggtttggggggtaaccagggagagtggtttttttttttttaagagacagggtctctgtttgcccaggctggagtatagtggtgcaatcatagctcactgcagccttgaattcctgggctcaagcgatcttcccatcccagccacccaaagcaatgggactacaagtgtgagtcattcactgcaactggccatggattcttggaggtttttgaaggcattccaggagtcatacagtcaattctcaatctcacgtgagcagccaacagagattaaagtgcagctgagagccaagctaactagggattcaaaattagctcctgtaaaccacaggcccacagtgagagccagactctcagcagaactgctcaggttggaaatgagaggagaggcagctcaaggcccccagtacccatcccctccctttggggttcatatggagccccaaaacccacttcctttattcttactcaagtaggagtcgcaggaatgaccttgagttaacactccttcacacaacctgcctgcaaaaaggtaaccattcccaaaccatttttgagtcatcactggtataattctaccccagacataatcaagagccagcagcagttgtgattatttaattatctcttaacttctttcttcccacctatctcccttccccatatcctctccatcaaccatggactgagacctgactataaaaactgcattttaaaacaacaagcccacactcaaatgtgtcacatgtcaaactgtagtataccagcggcctccgtcgggtgattgactttgtgaagactgaggaacaaattttcatctctgaggaaaaaccagcacttctcagtaccaattacagaggctgaatcagacttgattcataagcgtgtgcacaccaaccaacacacacaagtgcactcactacacagaacacagggccacgttcctcccacactgaggtcacagaatgatggctctgcaatgacacctgaactgcgacacactgaatgatgaattattgtacaatactttgagcgcttgtgagtgagagagactttcttccctgaactttgtatttaggataaagattagcctagccccctactcctctttcagacttccatatcggtttaactaaaaaatatccttggcttgcaagccaagctgttttattaaaaactatctattttttcaaacccaaaaataaactgaaaagtgaagctaaaataagactgcaatcttctaaaatgtttcaagtgtttgtgttgatcaaaacagcctcactgttctcactgactttataaataaatgctataaatgcaaacctctaaaatgagtgtacataataaaagaacgccgtagtctgtttcataaatcgagtctggtgtgccatttcatttgaaaaaaggatttgctatttaaaataaaaaggctgtgggaagatgcagaagaatcaaaaaaaatagcacatgttaaaataaatcaatagttcttctggagccaaaatgtgttcctggaaactaaggacacatctgcaaatcatatctctccataacttcttgtgttgaatcattttaaagtagatcctgcagcaaacttgagcttatcacatccaggcaatcaaccaccaccatttatttagtactagattcttgaggaagagatctgagaaataaatgattactggaaagttcctgataatctccaaaaagaatccaactctgccaccattcccagtcccatctaccctttactctctgccccaacccaagaagttacagttcctgcagaaagtggaaggacaaaagtactcctaagaatcccagatgggctggcccaaaggtactgagttatctcactggactgtttgcagtcagttacagatccaactccttgttctactctttcccccgttctcactactacacttcactagtttaaaaaaaaaaaaaaaaaaaaaacccagatgcattttcccattaaatgatggctacatgaaaaaggaagctccaaaaccaaatccggggcattaccaggtgtttctcaacaagaacaaataagtgctgtttgcatttttaatcatttctatatctgtaacaacaatacctgcctcacagggtgatatgagatccaatcaggcgatccatgtaaaactgctacataaaccataaggaattatctaatctgtagttatggctgatctcatttttatttggtcttagataccaaatgaaaacagaccaaagcaaaacaacaaaagtggtcaggcctactttgaaactagagactcatgccctcaggtttaagggctttctcccaatcatatctagtggggcttttcagactagatttcaaaatgaagctatgtaaaatgtataggcgggaaaaatcaggaggccaagaatttgctaacatcacacaatcagaacagaggtagaaaagacatagaaggcacattcaaggatactggttcaaggatactggagaattccctggctcccgtttggcaacaaagccaccggaaccttggccagctgtttcaagcaagtggtgaagccagaaagtagattgggtgagttaaggaattaactgcaagtgaggaagaggtaatactccaagcagattacactttcaagtaatgaaagggacaaagaacataaaacaaaatccaagtgccatcgtgtggtagggagacaaggcttccattcccaaaggctattcaaaaactttatctcctgcgctgcattaatttatgaagaataagaaaatttatctgactgcctcctaccttgtgcttgggatttaagcctcagacagatcttgacaaactaaggaaaggtaagataagtttaaaactaagtgagacacattcacacacaaaaattccagttggattgtagatacagagtatcttcacgagctaggggtagggaaaaatttcttaaacagaacacataaaccactaaccataaaggaaaagactggtaagttgaaatgttcatcagatggcacaatggagagagtgtaaaagaaagccacaaaataggagctatctgcaatatggaaacagggaactcatatcagagcataaaataacttcaacaaatcagtaaaaaaaaaaaaaaagacaaaggacttcaatttttttggacaggcaaataattaattataaaagagggtattcaaaaagcctataaataagtgttcagcctcattagttatcaggaaaatacaaatttaaaataagatagtgctacacatctaccagaaaggctaaaatttaaacgactgacaataataagtgttgatgaggaggctgagcaaccagcacatgcatgtactgctggtgggagtatacactggtacaaccactctagaaaactgacagctaaacatatgcatatcttatgaccctgcaattctactccttgatatatacccaacagaaatttttacatgtataccaaacgaaaacatacacaaatgttcacagcactattatacacaatacccaaaaagtcaaaagaacccaaatatccgtcaccactggaatggatgaatagtgatttcttgatagaggagaatattataagacaacaggaattaatattgctacatgcaacaacacagatgaatctcacaaacacaatgtagagtgaaagaaaccaaaacacaacctttcattattcactttatattaattttaacaacaacaacaaaaaaaagccaggcatagtggcccacatctataattccagctacttggggggctgaggcaagaggatcactcgagcccaggagttcaaggctgcagtgaggtatgattgcaccaatgcactctagcctgggcaacagagcaagaccttgcctcttaaaaaataataataataataatttaaataagtaaaacttatctatggtgttataatcagactagtggttaccttggaggaggagggattctggtaatagtctatttctttatctgagtgttagttacacaaagatgatcaactttacaatttatctgcttctgtgtaaatatatactgcaattttaaacacttaatgttttaaaatcctcatttctaaagtccaggttggtgttatcagactctttagaaactgtattttagctctatcagcacaactatggctctggggactggcaataagcctgcaggtaacagtgtgagcatgaggctcctgatttctaggaaccatctcttgtcttcagagctgccaggatggcagcacaaggtattacaaccccataagcctatgcttccccaagagttacttggctcacctcaatagcaaatggcacatacacttaaaatccttgggcaggatgacgaattaagcttggctcagaatatactcttggagagctctgcatagatctaaaacaaacccaagttttctgttccagaaacagttaaaactgcaaaggtgataagcttgcaactgtgcctgccctgactttatctgctccttttactttgctgctcatgggtcagcagttcagagatctatgccattgactcatttattaagggactactaagtccaccaagacccataatcacctaaaaaaattaaaacttggaagaagcagaagggtgacataatttgagatcgcctttgcttcttccccatattctccatccacagcaaacaccatcaggtctgcggactgttgcttctcactcttttgcaggtttgtaccttctccctcaccactatttctacggagccctaatcatctcctgcctacgttactataattgcttttacctggtttccaggttttccaattccaatccaaacagtactttaccgccagataaattctcttaaatatagatttttctgccccagttattctttttttttttttttttgctaaagacatggtctctgttgccaggctagagttcagtggcatgatcctagttcactgaggcctcaaactccttggctcaagcaatcctcctgcctcagcttcaaatagctgagactacaggcacatgccaccacatctggcttttattttcatttttgtagagcctgggtcttgctctgttgccgaggttggggttgaacacctgacttcaagtgatcctcccaccttggcctcccaaaatgctgggatcacaggtgggagcctctgcattcagcctaatttttttttttttttagagacagagtgttgctgtatcaccccagactggagtgcagtggaacaatcacagctcactgcagcctcaaacccctgggctcaggcgatcctccccacttcagcctcctgagaagctgagactataggcacatgccatcacaccgctccaattattctaaacctagctttaattctggagtgactaagcaactcagctatttgttggagaaatgagaattcaatactcactaagtaactgatattgcttaaattaagcccctgggatacaatgatgagtaagacggtccctaacttcaaagaactgaaggtggcctagcagttacatcctgtagtcctggcgtacatataaacagcctcagaagaccaaagagaaaactaactctatctgaaggaaagaaagcttcaaaggggtgatttgggttttgaagagcaaggaagtttactaggaggataagaaggaaagcatgcctgattcaatgtcactcgccataggaagccactccaatctgaacactcatggtctcataagcgagtacctagccccatcctgcatttgcttctgagactgcaatttatagtttaaccttcatgaattttcctacacagattacagtacagatcaggtcatttacatcttgtgtctttgtcttgtaatcagtactacagaattttgcccttggtgctgttctctggtcatttcagaatggcaaaagttttaaaatgcaggctctagggtcaggttccccaagtttgaatccaaatgtgcagcttgaccttggcctagttatttaatgtgtcactgtttcttcttgtgcacaagtggggacagtaaaagtacctaacatattgggtcattctgagaattaaataaaatgtaaaatacatagtaaacacaatgtcaggcatgaagtgtgggctgaaagtcactgttcatacgtcatagatattaggcttctctacccagaacatcaactgtctggaaagatgctctatctagtatgtctgtattttctacaatatctaccatgggctggtggctcaactatcttaaagaccaaattcaagacagtaaaaggaacaagaaaactgttggtatcactttcagtttctcaagaatactggtaattcctccaaattgaagatacatgtgactctttacattttcccctttaagggttctgaccataagcagacttctgctcacacgcagattcaatctgtgttgaaaaacaggagactgctaacactgagactgaaggtggataataaggtgcttttccctaagatgtagcagctagaaggtggtttcctcaaaccctgattaaatctgtaatatgttacctaatggcctctaaaacaaccccctctaagcataacctttttacaaaattaatcttggggaataatgactattttttaaattttttttaaataaagatggggtcttgctatgttgcccaagctagtcttaaaacccccaggttcaagcaatcctcccacctatgcctctcaaagttctgggattacaggcatgggccaacatgcccagccaaaaatgactattttttaaagacacttctattaagctttttgccatcctttcccagagcctcattttgtataatctactaggaggtgaatcatatgggtctcctatattcaggttcatgggctcatagataccaaacctcaacaaaatgaggactagtatcccagagtgccattcaaatatccctgtggcatatctagaacagtgtcattaccctatttgctgtatataaaggtttcgaagaaaagtgattctatccctgctgccaacgaaggttaaaaagtatgcaaaacatatccggtgtgttacaacacatgcgattagcaaagatattcaaactcatgtaaactttctctgaaagctaacaggattaccatagatgtctaaactctcagatcatcactctcacttccctacacccttcaccactgcaaaaaaaaaaaaaaaaaaaaaaaaaaaaggagagaaaaaaatctttgacctgtaggcctgcacacaagtatgagatgaaatactaagcttaaaataacatgcatgggaaccagggcgagtgacatctacctatccccctcctgaagtcattcagctcaaaaagccagaaagctagaaaagtgcatcaaggaagccccagtcaggagaacgacattcagaacaatgcttcctcccatctctccctccggtcactactgctcttttgcatcccagcccgtagatattttccttttccttttgttttctggaggcacaggtcttgctctgtcgcccaggctggagtacagtggcacaaactctatctcccgggctcaagctatccttctacctcagcctcccaagtagctgggaccacagctgcacaccaccacatccagctgatttttgtattttttgtagagctggggtttcgccatgttgcccaggctggtcttaaactccagggctcaagcgatccgcctgcctcagcctccaaaagtgctgggattagaggcacgagccaccgcgcccagctgacacttcctttaaaaaaaaaaaaaaaaagcacagcatattgaagtggaaatctcactttattcctctatttaaaaaaaagaaaaagtggtgaagcccactgaccctccacagtctagcagtcagcagggcaatcagggaagcccagagacactggatgactcgctcaaagacacacagccagtgagcagccagccagaatctcagccccagccacacccatgtgagttcctttccttagcctgactgtgataggacagcgtaaggccaagcagagggaagaccgaggtacaaatatacattgatgtaattcattctaaacattgtgtacaagagttgcaggagaaaaaaaaatgtcttctactgaagcaaacagacaaccacagcatgtaacaggactgctaaggctgggcaggcgcgcccacccctctattaacacaatctggaacaaagtcatcccctcgcatgagaaaggcttcttgttttcttgtctgcagcttagatctagacataactttgcacaatatcttcacacagacatttaatatttgattaaaacatacactctggctgcatctaaacataattttagtcattaaaaagcacttttctgctttaatctaaaactaccataaagttgatcgatggcagaacattcctctattatttcttgggtttgcacaaagtgcccagtcagattgtctgtctcttcctctaattactgctgaggaccaagagttagaagcaagatgactgccgggtgtctgggccaggaagttcaactgatcccactgtggcagtgataacatggaagcagcatattttctccccatggagaccagttagaggaaacatctttgtatacagaggatggtacgttttatgctgggaaacctcatccacatagtattggagaatgcataaaaacaagactcatcaatcagctaccaatggagaggtgcaccagtttctttctttatttttttttttttttgagactgagtttagctctatcgcccagctggagtgcagtggcacaatctcagctcactgcaacctccacctcccaggttcaagcaattctcgtgtctcagcctcccaaggagctcggattacaggtgcccgccaccacacctggctaattttttttgaatttttattagagacaagacttcatcatgttggccaggctggtcttgaactcttgacctcaagcgataccgcccacctcggcctcccaaagtgctgggattacaggcctgagccagcgtgcccagcctggtttcaataattttaaacaacaaatctaaagactaaagagcatgacaagtaaatgctacacctgaccacagattgatcctggactggagggaaaaaatgctatgaaaggcatgactgagccaattgacaaaactggaatacaggtggtagtaggttagatcaaagtactgaatcaatgttctattaaccgaagatggtaactgtaccatagtcatgtgggagaatgcccctattaagaaatatatgatatagggcaatggaccatgacaaaggcaacttactctaaaattgttcagaaaaaaatacatgtgtgtgtgaatgtacatgcatgtacatgcatatatgtctatatatacatataaagagggaacgtgcaaataacgttaacaggacaaaatattaacggtaggtgagtttgggtaaagggtatgagagatctttgtataacttattccttgaaatctttctatttgaaatcattttgaaataaacagtttttaaaataccatccactggccggtaccctctaccttgcccctggctgctcccagctagctaggcatatgggaaagagaaatggagaaaaggatacaataggaaagaattattctctcaggtgccaggtttattttcaccacagttacacagcctagacattaaaatgtttgcatctactggttgggcaacaaaccatatccactaggagctaaaatacatatattttatatacttatttatattccagtcagaaggcttaattaaacagccaaaaaaagtaaatgataaaaatagttattctgcagaaactgtctaaagtaagtaatacagccaagagtaggctctgtcttcacagtcccatctgcttccctttcccaggtacatatcccaggaggatggatgtttatatctgcatgcctagtattaaactcaaaagatacttactgggcacattaacacaaggcaagctaccaagaaatgctaaaacacgatcacagaatcttaagacagaagtaaacaaaccccagagcacagcaagtccaatcttgttctacaatgaggaaaatgaagctgagagagagcatcctcccaaagtcagctagctgtgggtcaagtgaagacaggggcaggccaccagagctcttgcccagtgacagctcctacaccccttgaggaagcacagaggagttctgctccaagggttttaaggatgatgaatgagctggctttacctggcattggatgacatcaggtaatgaatgagtatgaaactgacgaaccactataaaagcatgctgcaaatctaacatgatgattaacgctactgctcaggtgagtaatttcatttcagctgctattaccacctgtgctatttaagagcaagtctcttgtaaaaccaccttcatcctgaattattcccaggtagacttggcattttaaataagttaacataatggctgggcgcggtggctcacgcctgtaatcccagcactgtgggaggctgaggcaggcagatcacctgaggtcaggagttcgagaccagcctggccaacatggtgaaaccccatctctaataaaaatacaaaaattagccaggagtggtggtggcggacacctgtaatcccagctactcaggaggctgaggcaggagaatcacttgaacccaggtggcagagactgcagtgagcagagatcgggccactgcactccagcctgggtgacagagcaagactccgtctcaaaaaaaaaaaaaaaaaaaaaagttataatattatttgactttggtaaaaatctctagaccacattactactgggaactggggtagcataatcatcccctccaggttccactcggttgctataaagtctcaagaaaccaagagcaaaccaaagtctaccatcctctttgtcaatggcaaagctgcaatgcctcgcccttcccatttctagttggccttgccacccgcctccagacctagggacaaagaatggtgctagccacaaaaggaaggtaggacacagctaaggacaggcttctcttaagggtaagcaggggagagagttcaagcacaaagccaggcagtgttctgatgcagtgacctcacactgggtagatgtggaccaatggagtgaggctctccctggtgtaccaatcagataaatcactcctatggaaaggaagaaatgagagggtggagacaggaccagaagaatgtgccccaatactgctcccacctggtgtgcagtcaaaacccccctgaatgtaggctaaagcaagaatgaggggacacaggaaggttaccctctacataagcaatgagaaaactaacaggtttgttttctctaatgggaaacagtgctgccactgaggggtacagggccaagcatggcaggcagagaaagtaccagattagagccagtcctggctctactgagtctagtctgtggcactgtgggcaaaccccgcaagctcctggagcattcttcatctgtattggctgatacagtcatctctccctcactgtaagttcttcttacgtaaactccatgtgtgggtctccttttataaaggcaaagtccccctaagttgccaccagcttgtccctctgaatacacctagtgccacctttatacttttttaaaattcatgttcagtcacgttcctcaaaggctctcaaaatatcactgccaattgccaaagggtccttaagtatccctgcaaatatagataatgttgccggggtggcagctgctgggggatctctgagggcactgcattacgcaggaagtgtgggggcgctgcacaagcagagatctgtgtcgggaggaagtgactcttcatggccaataggttctcaatgctcctcccatccccgcagatcattactagccacaaagggagaagacgctgcaaagcaactctctaaccagggactttcatgtgcccgggttccactaataaactaaaacttgtacaatataaaaaactatattgtaatactggaactatacacagttccatccctccaccccactggcgaggcactggattagaaaggcaaaacagtggtagtggtgactgtggtggcagtgagcagcaagaaagcagatggcgcctttctggagggagtcggtgcacaggtgaaatgaaacaggtactcggccaataaccttggccttgctcacatccctggagagagaagatgataactctacatggggttttccatgagccttcaatccccgcacagcaagcacgcatcacccgtcccacgattctcaaccaattttgctagaagtgactcagtccgtctctcagctctgccccttctacaggcaccagcccaaagccaagactgaccagaaatccaacacccttcttcttcctgggcccttccacccccaacaggtggctgggtacgcttgtcctgggaaggccttagcatgaactgaagggtgtgggctgtggaatcagggcaggtcgcatctaatgatgacttcctgattacttatctgcttgcccctgagcaaattacctaacctctcggagctcaagtttcttcacttgcaaaatgaactttcaacagtactccccctcaccaagtagctatgggaatgacatcaatggatgtaaatcccttagcaccctcatccataaatgagcaaaactatttcactagatatttcactggtgagtcaatgagcttaaaaaaaaaggaacaaaataaaaatcctacataaaaaattagctaaatgctcaaaaacatcccaagaatgccaaatgccttttcactttcatttttatatacaaatcacctctcactgctgcaaacgaagaatgtaagaatgaaaacgtgtcccacaggcctccatctgtgttcaggacagtaagagtttgggactagactcatgattctagcagcaaacactttttttctttttaaagaaagaaatattgcatagaaccccaccatataaagcagactaaatgagaaactgcttaattaataagggtagaggagggggtctcaaatgcctgtctgtactcccaaacctagtgtctgtgacacctccaagaatccctatgggcctacagagcaccagaaaagccctgcactaaagcccttcccagctttgtgattctggttctaacaagtctagaaagtttttcgggggtaaaaaaagattgctaaaaagactggtcgtacattctctctcaagtatctttcacctgcaagccccatcaccactgccgcccagggtctttgctacctgaccaccaggggtgattaaaccatttcatcacctggccctaacctagctgacttactgtccccacctcaccatccacagccacccacccaccctctgcctcagccaaacccaaactcacccttttctctccacataacagttccatgtcttcacacacaccatttcctctatctagaatgctcctgactcctcgaaaaggtccccaactctgtgaagcctaatgcagttcccccttccccaccctcagagctcctcactccttgtgggcttcaacatgacaccgaccataatgaactgaaattacatctttcactctcatacagggatggcaagacaactggtgccacctcagtgggggccaagacaagtcagcaatatttatcaaatttcaaacacaaagacaacctcacccagcaatacacttttggtgatttttcctccaaagcttaggtgtaaaggatcttcatgtcaatgccgtttgtaaaacaaaagaatggggacaacttaaatttccatcaaggcaggattggttaaataaggtacatccacactgtagaacacctactaactatgaaaaatagtgaataagctctatacatatatgtatatggaaccatgaaaactactcacctaaaaacacatttccccacacccaaggatcccagtcaaacatggccaggcgtggtggctcacacctgtaatcccagcactttgagaggctgaggcgggcggaccacttgaggtcaggagttagagaccagcctggtcaacatggtgaaacctcgtctttactaaaaatacaaaaattagccaggtgtggtggcgtgagcctgtagtaccagctactcgggaggttgaggcagaagaattgcttgaatccaggaggcggaggttgcagtgagcagagatcacgccactgcactccatcctgggtgacagagagagactcgtctcaaaaagaaaaagaaagagagaaaatgtcaaacactgagaaagagatgcctggggatcctctctgcttgtccttgtcatcccaaataccactcttgctcttaagcaaaactccgcacatttactaaggtcttatgtactagacactgtcacaaacattcattctttaggctggttatttttttgatcacggaagaacttgcacttacctgcaagttctccaatttgcactccaaatcaaggtaaatgcctagaagttttctgtttattccaccatggaatgtgctgcctgccattcactggctttcactctctaagccccatacttttcctgtctttgtctctattttaggttccatcctaccccaaggtctataaccctctgtccactggcagtaactattggtataaactatttcttcctagtggctggggcatgggacatcctggccaattaaatatgctgaatttaagactgctgccacagatggatttctattttcaaaatacagattcaattcaacttttacttaatctatgtcatctttttatgcattcggagataaggaaggaccatatagtgtatgataatttatataaaatatccagaataagcaaattcatgagacaggaattagatttgtggtcaccaggggctggggcaagggagaaaggggaatgactgcttaatgggtacaggtttcctctggagtgatgaaaaagtgtgaaactagagtggtgattcttacacaacatggtgaatgcacttaatgtcaccgaactgcatactttaaaatggtgacgttttatgttatgtgttgccatagtctggatgtggtttgtctccacctaatctcatgcctaaatttgatccccaatgttggaagcagggcctaatgagaggtgtttgagtcatgggggtagatatctgataaaaagattaatgccctccctggcaaggagttcggggggtgagggtaagtaaattctcattctcctagttcctgagagctggctgtttgaaagggcctggcgcctctcctctcactctcatccttcctctcttgccctgtgatctctgcacacagattccccttcaccgtccaccaggagtggaagtagcctgagtcccttaccacatgcccaatcttgaacttttcagccaccaaaattgggagccaaatacaccttttccctttacaaattacccagcttcaaatactccttcagcaacacaaaacagactaaaacatgtagtattttaaggccaaggcgggcagatcacttcaggtcaggagttcaagaccagcctagccaaaatggtgaaaccccgtctctactaaaaatacaaaaattagccgggtgtgatggctaacacctgtaatcccagctactcgggaggctgaggcaggagaatcacttaaatccgggagacagaggttgcagtgagctgagatcacgccactgcactttagcctgggtgacagagagagactctgactcaaaaaaaaataatgtgtattttactacagctttttgaaaagtaactaacttacgactggaaaaaattaaaatatgttaagccactatttctaatacattaatgtaaatataagggatacctaaataaagcttaagggatctgtctcctataaacagacaaaaaataaaatctaacttgttgataagtttcctacatagacacacagaaaaagatactgaggaacaataatgagaagccattatttaacctattaaattagcgacaattttcttaagattacccaacgctgatgaggatatttatctacagctgatgggaagaataaactcgtgtaacctttctggaaaacatgtgatgaagtgccttaaaaatattcagactaggccgggcgcggtggctcacgcctgtaatcccagcactttgcgaggcccgggcaggcagatcacgaggtcaggagttcaagaccagcctggccaacatagtgaaaccccgtctctactaaaaatacaaaaaaaaattagccaggcgtggtggcgggcgcctgcagtaccagctacttgggaggctgaggcaggaaaactgcttgaacccgggaggcggaggttacagtgagccaagatcacgccaccgcactccagcctgagcaacacagagagactcttaaaaaaaaaaaaaaaaaaaaaaaattgttcagactacatctaagtttattaaaaaaaaaaaaaaaaaaaaaaaaaccctcatacccttgggcccttctgggaatctatcctaaggcaattttctaaaatacatacaaaggttttcgcaaagacattaatcacattattatttaccatggcaaaaaacagaacaatgaactgcttaaaaatccatgcaattcggtattataaagccactgcaaatatttataaaatatttaatgatttgaaaagccacttatgctataaagcggaaaaggcagaagaaaaaagtgcatttacagtgtaatctcaaccatattgaaaaagtaaataggaaaaaagactagaaggaagcaaatcaaaatgttattagagattgaatccaatggtggtaatttttttttttaattatcaaatattctagagttcaaaatactttttacaatcaggataataacaactaagcaaaatcaagaagtggcagagaagattttgtgtttctacagtagcatcagcacctactttaattgtctagcagtactagaataaagaaggcacagaaactgagctaaattattggtcacaaggccaggaacaacggctcacacctataatcccagcactttgggaggccaaagcaggaggactgctcgagcccaggattttaaaaccagcctgggcaacacagcgagatcctatcctgatacaagaaaaaaaataataattttaaaatttaaaaaaaaaagaaaatttttaaaaaataaattgttggtcacaaatgttggagggcttggctgctgcagttttgttgtttgttagtaagtacctatgggagaagagcttacaaaaactccctatactatttctgcaactcttccgtaagtcttacattatctcaaaattacatatttaaaataaataaatctggccaggcgcagtggctcacacatgtaatcccagcactttgggaggccgaggtgggtggatcacctgaggttgagagtttgagaccagcctggccaacctggtgaaaccccatctctattaaaaatataaaaattagccgggcgtggtgtcacatgtaatcccagctacttgggaggctaaggcaggagaatcgcttgaacccagaaggtggaggttgcagtgagctgagatcgtgccattgcactacagcctgggcaacaagagtgaaactccgtctcaaaaaaatgaaattaaattaaataaacaaaccctttttataaaaatgtttttatttaaaaggacatgagtccgtgacacagcctcaggaggtcctgatgacatgtgcccctaaaattaaaaaatccttgatagatcactcaatttatctttctctaaaaacaaaatgcagatgaataatttcctggacaataacaaagcacttggctcactacaacctccacctcccgggttcaagcaattctcccacctcagcctcctgagttgctgggattacaggtgcccaccaccatgtccagctaatttttgtatttttttaagtagagacaggtttcgccatgttggtcaggctggtctcaaactcctgacctcaggtgatccgcctgcctcggcctcccaaagtgctgggattacaggagtgagccaccatgcccggcctttttattttgagacagtcttgctctgtcacccaggataaagtgcaatggtgcaatctcagcccactacaacctccacgtcctgggttcaagtgattctcctgcctcagcctcccaagtagctgggattacaggcacccaccaccacacctggctaatgggtttcacttatgttggccaggctggtctcgaacgcctgaccttgtgatctgcccaccttggcctcccaaagtgctaggattacaggcatgagccactgcacctggcctcctcatgaattttttaaaaggccttccctgggccgggcacggtggctcactcctgtaatcccagcactttgggaggccaaggcggtggattacctgaggtcaggagttcaagaccagcctgcccaacatggtgaaaacctgtctctactgaaaatacaaaaactagtcagacatggtggtgggcacctgtaatcccatctactcgggaggctgaggcaggagaatcgcttgaatccagaggcagaggttgcagtgagccaagatcacgccactacaccccagcctgggcgaaacagagggagactctatctcaaaaaaagaaaagggaaaggaaaggacagaacttctcaggtctgattattaatgagtttagaaaccaacgattttccttccagctccatttggcttataaaatacccttaacttttcagggagccctagaccagagatctttttcattataaccttcatataaaacagcagcaggctcctctaatggaaatgaacctattgcatatgctaagcctaatgggcttacctgaattaaaactcaaagaaatcaagcaatcttcctttttgttgatgtcctgtaatatggaccagctaccactgtgccctcaagtcatactactttttctttctttctttttttttttgagacggagtttcgtctgtcacccaggctggggtgcagtgagccaagattgcaccattgcactccagcctgagcaacaggtaaagattccgtctcataaaaaagaaacctagtgatctagaaaaaaacatgggccttggagttggaaccttagaactgaatcctggctctgtcaactcactaggtaattctgatttctgtttttttggttttttattttcttagcccagatgaagagaacactaggtaactttggagaagttacttagcattacccaccctgggcctcagcgtccttatcttcctcaactataaaatgggaacataatacctacctggcagggtggctatgagagattaaatcaaataccctacgcggtatgcatgagggccccttaacgacgactagcacagagtgcaattatgaaacacagaccttttctctctctatgcccatttccttcccttcccattagcctctttcaccccctcacttctctgccctgtgtctttccttggttaagatccacaaagacctcacctcacccactcccactcctcattgttcctcagcggttctcccagtagcaattagctttggggctccccagtaagcacaccaccccccacagcacttgttctgacaacttcccttgctcacctgctgcccatctccacccaccgggggaaaaaatacagttatctgagcttgctggttgcatggattttggaaatacaaggtgttactgcattcatactctatttcactcttaccaccctctccaaatactattactatcatttactaacctcaagggcccaccttgacctgcttgggtttatttttacacctgactcttaattactcatgtatctgctgaatgcttactaggcactaaagaggcgaagcagagtaagacgcactctgctatgggctcttaaagagaaagaactaatcctcctcacccccaggcttggagtgggaaggaggaggagtggggaaggaggcaagagatccacattttgctcttgaaacttctgaactgtctgacactcactgtaagaatgtagtcttggccgggcgtggtggctcatgcctgtaatcccagcaattggggaggctgaggcgggtggatcacgaggtcaggagatcgagaccatcctggctaacacggtgaaaccccatctctactaaaaatacaaaaaattagccaggcgtggcagcatgcacctgtagtcccagctactcgggaggctgaggcaggagaatgcttgaacccaggaggcggaacttgtagtgagtcgagatcacaccactgcactccagcctgggcgacaaagcgagactccgtctcaaaaaataataataataataataatgtagtcttgtcattcttatattaacaaaaacaaacatatcaaaataataaaagccaaaaaataccaaactataatcgaagatgacctatgataaactagcagctggaaagcctcagagaggtaatgtttatggtaaccttgagatgtcacataagtttcatttgcaagaaagaaaagggcgctagagcagagggaacagcatcagcaaaggcagacaagtattaaagtgcactgagtgttctgggaatgacaaatggtttgctgtggctggaaaacaaggtgtactttgggaagtctttcatagatactccaaataaatcactttaagtatttaatgaaccatcttcatccttactgagggacctcaaagtaagtaagaaacttaaaattcagggcccatgttactctaccatgatgaaaacttggtctcagacaacagtgggaaccctctgctctgaatgactggggttcacgtggcatgatcacatctgagctctatgaggcagctcagcagtacggaagatggacagagggacgcagaacctggaagagaggaccggtcatgacagcaacaaccaaagcaagagacaatgacagcttgatcaaagcagagggaatggagggaaaggtcagggtcaggacacagatacgttagcagcagcatcaacaggtctggaagcaggggggcgctatagaagaggaagttaaagatgactcaggttcatcatttgactagctagaaaatgaggtcattaacagaaccagggcaagacagaggaggcactaacctgagaggaagatgatggatttggtttaacacacatttaatttgatgttgtcagaacactggatatctacagctggtgagggtttagttttcattggtacacgggtcatagctgaagccatgggaggctaaaccaagagactaataccatggatgccacgggagccaagaagaaaagtgtttcaagaaaagaaaaggagatcagtggctgccaaaggccacactgagaggtcaaatgacctaaggattgaaaatacgcattaaactgaactcagcacacagatgttacacataatcttgaaaagtggtaaagacaaaaagtctgctggctgggcgtggtggcttacgcctgtaatcctagcactttgggaggctgaggccggaggatcacttgagcccagcagctcaaggccagcaggggcaacatggtgaaacctcgtatctacaaagaatacaaaattacccaggcatggtgatgcatacgtatagttccagctactcaggaggctgaggtgggaggatcgcgtgagccccaggagatagaggctgcagtaagacatgattgctccactgcacaccagcctgggcgacggagtaagaccccatctcaaaaaaaaaaaaaaaaagtcagtcagcaatgggttgtagaatgaatgacagggggaaaggagaggtgggaggttgaaaaagtagaggtagagtggcaaccacactttcaggaattcctaccctttcaacacagcctgtgctatcacatcttccttggcttagacagatacatttgacaatgcaactacttaagatcttcaacatccttctcgtgcccagggccaactaccttcatgtcaacagcgccacaactgctcacctacctacagagatagccacatcccatatttcatcagcacatggcccatctcctgtcatctcttcctatcagtttacatgttatcgcttccattcctaccaaatccaaatcaccaactgattaaaactttctactactctcaatcgccaggttacaggcttccaaaatcagcttgtgcttttccttcttcctcatctcttaactctggaatcagttttaagtgacaactcccttaccaggtcttcctctcaaccactaattacacatgcaagaacaggcaggcccttgtcacatccacacaggcatggtgtaacatctggtttcccacatctaacctatacacagcagattaagtttcctttaaggaaaaaccatccaacaagagaaagccaaactccctagggtagtactggagaccctccatcatctagccacaaactaccttgatagccttctctccaactacttcttcacatccttctcttctgaaacttccaaacttctgaaactgctagggagcctagtttactccttccctaaagctccctttgaacacccaagacctcaacaacatccctaccacaatttaattgcccactatgccaagaattgctctagactcttgggatacatgaacaaaagagagattccctagctttatggagctaacattttagcaggagacaacaaaagaccaacctcattaataatattgagtatataaaatgttaaaaaattgtacaaaaagagaagtaaagcaggatgtcagggactggaagtgctgaagtggcattaccattttaaacagggtggtgagggaaggccccactggaaaagtgactcgaggcttaaaggtttagtcaagcagattctcagggagagcacggtccaagcagaggcagggagccaggccaaaggcctggagcaggaacatgcccagaaggtctgaagagcagtaagaagaccgagggagctgcagcacagccagtgagagctaaaggaggtgagctagaggggagatgtgacccgtctcacaaaccagcttggatgtcaagcagacagctggagactcgagaactggagctgaggagagagatgttgggttataggtgtcctggatgaaggcactaagttcgaggcctagagtgttccggctatgagatgaggaagaaacaacctgtgcgacaggaggaaaaccaagaacacaccttagtgtcccagcggccaagtgacgaaaggctgaactgcagaaggggtactccacttgtctgacactactgacagatccagtaagatagggactgagagctaaccactggatttagcaacactggataagcaacacttatcaccttgataagtgagattaagagagaataatgccaggcgtggggactcacatctataatcccagcattttgggaggcctaggcagggggatcccttgagcccaggagttcaaggctgctgtgaactatggtcactccactgcactccagcctgggcgacagagcgagatcctatgtctaaaattaatgagcaaagggaaagtgaggaattagagaccaagtacaggccactccttcctggggttttgttgcaaaggggaaaaaagaaatagggcaataactggccaggaaagtaggagtaaaggtttcagataaaaaaaataccatgtttgtgtactacatgtatatgtgtacataggtatgcatataaagccctagaaagtcctacgcacccaacaaatgtttatttccttcactctcacttcacacctatcattttctattatctttgttgctatatatgtgacctttgtaactgtctgcaagaaactttcacttggaaggccctttctttgtcccagtgtcaaactcttcctcatccttcaagactcaaatataccttcctgggaagccttccctgactcttctcagccaatctctctcaggtcagtacctatgcaatctttgtaccaatgcccctttgcaccaacacattcttctactatcacctgtatcacagtctcttgtattttcagagtatgttgacttatcttccccactaaactgactcccagagggcaggggcagtattaaatattaccctggaagtgtaacggttatgagcagtgactcgctgtgtgaccttgggaagttgcctaacctctcagtgcactgaatgtcagctataaaacatgaaatgaaagctgcctttaagccaggcatggtggttcacgcctgtaatcccagcacttcgggaggcccagacgggtggatcatgtgaggtcaggagttcaagaccagcctggccaacatagtgaaaccccatctctactaaaaatacaaaaattattcaggcatggtggtgcgcacctgtagtcccagctactcgggaggctgaggcaggagaatcgcttgaacccaggaggtagagactgcagtgagctgagatcacgccactgcactccagcctaggcgacagagcaagactgtctcaaaaaaaaaaaaaaaaaaactgcctctacctcctagagttgtttgggacagtaaatgggttcataggttcatagatgtaagatgcctggcatatagaaagcaatacacacacacacacacacacacacacacatattaactattatattgttagattgtaaccacagtacctagggttgtaaacttcatagcaggaagtcaatacattatttcatgattatttggcctggtgtggtggctcgcgcctgtgatcctagcactttgggaggctgaggcaagaggactgcttgagatcagaagttcaagaccaggctggacaacatagcaatccccactctctacaaaaaataaaaataaaaaaattagctgggcatggtggcatgggcctgtagtctcagctactgaggaggctgaggtgggaggattgccttgagaccaggagatcgaggtcactatgagctgtgactgtgctgctgcgccccagcctggacaacagagcaagaccctgtctcaaaaaataaataaatatataataaatataaaaaccaataacaaaaactctggcttaatctacctatttctttatactacattaattttgctgaccacattttggttttatcaggtgatttgaaccatatcatatactaattttttcagaagctattcaagtcatttcttgacaggtaactttttctccagactttctctaatgctgtgactgacatacaaaacctctgggtactgctgaacctttccctgccatctccctgcacccccatgtcttctttgtacctctgagagcatggggtacaatgcaatgctgtggatgaacaagtggatgacatgccatgtgagtggctaaatttcagttctgattctgcctccattacaggggccactcacggtaactgatattaaaaaaataaggctaggtgtggtggctcccacctgtaatcctagcactttgggaggccaaggtgggcagatcatctgaggtctggagttcgagaccagcctgaccaacgtggtgaaaccccatctctactaaaaaacacaaaaattagccgggtatggtggtgggtgcctgtaatctcagctactcaggaggctgaggcaggagaattgcttgaacctgggaggcagaggttgcagtaagccaagatcgtaccactgcactccagcctgggtgcaaaagcaagatgccatctcaaaaaaaaaaaaggaaagaaagaaagaaagaaaacaaaccttagcaggcaattcaatttctaagcaactaaaaaagaaatgctaatataagcaaaaactcaattttgcacacaattttcatattaagcaacagctcgctcaatactaagtaataatttctcagcaaagtagtgggaacctctaacatgtcacaccacttaagaatccatgggaatgcaacaaaaaatgatttaatcaaatacagttatagtatgctagctcttcctgtaattctatactgcaactataaatctttttaaactggttctaaatgtgaaggtcaacagggatagtgtaaacaaaattccccatactccctatgctccaccactatctatctctaagccaaacaacatacaggtggaagactctcctgatcttccttcccatgaggcagcacccaaagagcacaggctccggagtacagcactttgggtctaaatgccaactccaccacttgtcaactaggaatcacagagcaggtctgtccatctcccgctctggcaggaacagccatagtggaacctagcagagttggtggggtttactgatactgaatgactaagagaaaaacttggccaggcgcagtggctcacgcctataataccagaactttgggaggccaaggcgagtggatcacctgaggtcaggagttcgagaccagcctggccaacctggtgaaaccccatttctactaaaaatacaaaacaaaaaaaaaaactagctgggcgtgcctgtaatcccagctactcaggaggctgaggctggagaatcatttgaatccaggaggcagaggttgcagtgatccaagatcatgccactacactccagcctgggtgacagagcgagactccgtctcaaaaaaaagaaagaaaaaacaagtaatgagtgaagaatagctagcacatcaaagatgcttaataagtggtagtttttatcacattacgccactttcaagtcttattagagttgaagatttaaaaagaagatgttaaaagggctcaaacttatgccaactaatacccttaaaagtaaaaatgttaagtcagcaagaaatggagaggaaataatttcctggaataaagagctgggatcccagggaaaagaccctccgcctgtaagacaccagccaggcaacagtttccttacctttgggggacagggcctaccctacccaagcccctgaccctgggatacctacagatgaaccactgtgtcagtgacacaaaaaggacaatcctattcacatcaactatggccaccccctgtgtacttaaataactgaggtctaggtgacaaaaactttgacttgcaacgtacctcagaaaaaatgcacatggagttcatgaagccaactactttacaattcattactcaaaggtggtcattcccatgatgctctactgactgccaattaaaatgaaacctcaatacaagggtgctgggctagctcagtcaataacaaaattctgtccaagggtcctaaagcaatgctgtaagtttcccaaggggaggaatgtgtgtcttgttcatctgtacatgccctaggccctggtatatggtggtggctactgaaaattcacttgtaagatttgtacacccatattcacagcagtattattcacaatagccaaagggtggaagcaacccaggtatccaccgaaggatgaaaggatatatgaaatgcagcacatactcacaatggaattcagctttcaaaaggaaggaagctctgacacacgccaccacacggatgaagcttgagaacactgtgccatgtgaaataaggcagtcacaacaggccaaatacttcatgactccacttacatgagctacctaaagtagtcaaattcatagaaatagaaactaaagtagggcaggggagagactgaaaaaagacgggtacaggttgttttgggaaaaaacctttggagatatatggtggtgatcgttgcacaacaatgtgaatgttcttaatttcactaaactgtacacttaaaaatggttaaaatggctaattttaattatgtatattttactacaattaaaaaacaaaacttaagtatattgaggccgggcgcgatggctcatgcatgtaatctcagcactttgggaggccgaggcgggtggatcacctgaggtcaggaattcaagaccagcctgaccaacatggtgaaaccccatctctactaaaaatacaaaatttagccgggcatggtggcgcatgcctataatcccagctactcgggaggctgaggcaggagaatcacttgaacccgggaggcagaagttgccgtgagctgagactgcaccactgcactccagcctgggcaacaacagctgaactccatctcaaaaaaaaaaaaaaaaaaagcattactgaaagaataaatgaaggaaggaatgagtgctactttcattagccactaaatgttatacctcatacctctagattactctttagagaaatcctatccccaaatttcatagttgaggaaattggaactgagagcttaactgatttgccacaattcatactgtgtaatatatatgttaaaatacatagactcagctgtgcacggtggctcacgcctgtaatcccagcactttgggaggctgaggaggacggatcacttgagctcaggttcaagaccagcctggggaacgtggtgagacctcatctccacaaaaaattagccaggcatggtggcacttgcctgcagccccagctacttgggaggctaaggtgggaggactgcttgagcccaggaggtcgaggctgcagtgagccatgaacgtgccactgcactccagcctaggaaacaaagcaagaccctgtctcaaaacaaataaaaataaaacacatacactatacgtatagcatatactgtacggtgctgctcagcattaatggtgtactttacccagctggttgtaagctccatatctcaggacctacacactacccacaggccccttgaatgtttcgaaaattccacaggccttaaggtctgtatcacaaaagatgcagctatgtccctttctctattataccactaacttggcaggggtaaaatgggtgaaactgaggagaacagctccactcctcgaggtgctcaaccacaggctaggtgatccagtacttaccaagggcttactatgtgccaggagctggagcagataagggttcaaacaatttggtctttgaaggagctgtgtataccgcaatagacagataaggctcagaaataattacaagagcaaaaaggcaaatgcttaacaaagagatgtgggtacacacatttaggggagtattgaaagtatcggtctagaaaacgtggagatgtggatacacaaagagatgtgagtacacacatttaggggagtattgaaagtatcggtctagaaaacgtggaaggtagcttcagcagagatcagagcatgtagaatagcagcctcagtgtcaaaagatcacgaccattcctgactttgccatcacctgtgcaagtgacctctgtaaatcgctctgtttcctcatatataaacctacagctagatgagatgtttctcctacaatcacccagctctctaagtgtattagagatgcctaggttcaaagtcagatgcctaggttcaaatcttaacactgttaaaaagtcgcttgaccttgagctggggaattaattgctccgtgcctcagtctccccacttccgaacagagggctggtgtgatcattaaatactactgcactgtcaatcacttcgcgcagggccttggcaagtagtaagccctcaataaacgatagttattatccggaggagctgcaggaggcaaacaccagatgcaagggttgtgcctgctgcgctcccagggccctcccaggcctgagccatcatccctggggggatgggagcgcagggccggggctgcacactctgcacgcatgtgtcaccggccaggctccgcacgcgcctctccccgccatggggagagcagcgatggctcagcagccccggggcccattcccacccttccggtagggcaccccaggagggaagggggctccaattccacttaccatgctggccggggagggggcggctcagatgagctggttcttgggcttcggacacgtcccgctcgcacagttcaggtcatggtcccggcagactcgggaagtcccccacccatgcaaagacaaccccttccccaccgggccccgaggggaccctctaaaaagggcagggccgcccgggtcgcctcatcgggggaccccgagacaattcatccagacccacccgcccctccccaaggaaactgaaaaagcaggaaatgaggctcggatgccggcgaggagggcagctgctcgggacccccgcccgggcccgacccccgcgggggaggctgcgggcccaggcaggggctccccggcctccgcgggcagaggtggcggcggccccggccccgaggctgaacgggcggaggctgacaggcctcgaccgcgcggcccaggcggccggctcaggggagaggcccgggggcccgcgctgtcctcgcagcctcaacccacacggccactgccgccgccccctagagcatccttgcgcgcgcccgccctggagccgcccgct

SEQ ID NO: 1602 - DNA, 113943 bp, Homo sapiens; identical to SEQ ID NO: 1601

SEQ ID NO: 1603 - DNA, 136473 bp, Homo sapiens
caagtgtgggggcgtagtcaggcgtgggggcgggccggcgccggcgccgcggtcggcggcagcgctctcctaagctctcgcggctgcgcttcggtcccggacccgggccacccacggggtagtgggtgctcctcggccccggacattgcaagccccagaaggtaaatttgcgtgggagccgcgcacctggagcgcgagggtacccatgatgagggcgggaggctggatggcgacagaagggagcgtcccgcggcgagtttcccaagaaagctgaactcgtcccaagtttcttgtgcctcggcttgcactcagtgaatgggtggcgggctcatttgctgcgggtggtcttttggcgcgggagggacgcggaggtgattggattaatccgcctgggcggcagcccagatttctgccgggaaccgcgcaccgcagtggtgcagtttttgcccgagaaagggcgggtaagtgcggtgcagtcgtgtcctgcgcagcagcagggggaccgccggtctgggagcacgcgagtcggccaggcgtccccggttgtccagaggcacagtttcctaacttctttcctctttaggcaagactaactcggtgttgctcctcccggcgctgacttcgaggcccggctatggacggcgagagcgaggtggatttttctagcaacagcataacccctttgtggcggaggcggtcgattcctcagccccaccaggttctgggccggagcaagccgaggccccagtcctaccagagccccaacgggttactaattacggatttcccggtggaggacggagggacgctcctcgcagcgcagattcccgcccaggtgcccaccgcctcggacagcaggacggtacataggagccccctgcttctgggcgcccagcggagagcggtggccaatggtgggacggcatccccggagtacagggctgcctctcctcgacttcgacggcccaagtcacccaagctccccaaagcggtgcctggcggctccccgaaatccccagcaaatggcgcggtgaccttgcctgcgccgccgccgccgccggttctgcgccccccgcggactcctaacgcgcccgccccctgcacccccgaggaggaccttactgggttgactgccagcccggtgccttcgcccactgcaaatggccttgccgctaataacgactctcctgggtcaggttcgcagtccggccggaaggcaaaggaccccgaacgggggctctttcctgggccccagaaaagttcttcggaacaaaaactccccctccaaaggctgccctcccaggagaacgagctcctcgagaatccttccgtggttttgagtacaaacagccccgccgccctcaaagtggggaagcagcagatcattccgaagagtctggcctcggaaattaaaataagtaaatccaacaatcaaaatgtggagccccacaagagactcctcaaggtgcgcagcatggtggagggcctaggaggacccctgggtcacgcaggggaggagagtgaggtcgataacgacgtggatagcccagggtctctgcggagaggcttgcggtccacgtcttatcgcagggcagtggtcagtggctttgattttgacagtcctaccagctcgaagaagaagaacagaatgtcccagcctgttctgaaagtggtgatggaagacaaggagaagttttccagtctgggaaggataaaggtaaaagtgggcaggagtgtggcacgccattcactaagcggaaagtaaatgtgttgggagtggggaggaggagcgtagaggaaacccgaagaagtcattccgttttaattctgtgttttgctcttgattgctagtgtacatccagctcttggccactttgatgctggcaggcacagccgagtttagtgcaactttgtgggaagaagtgaaattcatcacttttaaatttctaagctcaggcagaattgggggggacaagagtgaaatatggcagattattggctgagtgagtctttaccacttttaaaagagatagctgaaagggggaggagcatgttcagaaccgcactctgcagtcaagttgtctggagtttgcttagaggtttcagtcaatgatagctgttatcacagctgattcagaaaaatactgattcctgtttgagcctgttgattattttttgcttttacttactgaattttgagtggttactacgcacttgatgtcattcaggtagaatgtgaatttgaaaatcagttgccaggatcacaaaagacataaatattttgtcatcttttttgttgcttgtttttgtcaccgtggcctttggttgtgttttattcccgttgtatgcccattcatccttgagtgcatgtaacagattggcagctgaaaacttaaggttagggtggacactgtgtggtattgctcccctatattgtcccattagctgcacttattaaaatattgtcaaatatgacataaagaaacagggaaaactgaagaggggtattttggagtgtgtgcttccttccacagaaacaacacaggtttcagcaataaggcagattctttttggcagccacattttttcttggttaatcagagcactggaaccagtctatataaatggcacatatgcaaaacacaagcaagcctgttttattttagagcccgtggtcttaaagaaaataaattacataacattttatgtgttttttccaactctgcaagtatagcaaagttcaatttaacagtgatggtgaatcacgagttgtaaaatgagctgacctgctagttatttgaggattctcaatctgttttgacagggtgtgggggatcttgtacattttatttcattgtttcagtgaattgtagtgatcaaatgagtgaactcctccagggctcagcttctgtgcgctcttggaaatctaattaatgtaatgactaaaaaaaagtatttttacttaaaatagctgtattttctatttggctcattcatacatagtttgcttttccttttttttttttttttttacttttttttgtctcttagaaaaaaatgctgaaaggacaaggaacatttgatggggaaggtaagcatttaattttccaaactttcattgctgtttcaatgtggaataccaattataagttgaaatccaactgcagtaacaaaaatgcttacgatgagaaatatgtccaacttcttctcaaattatacagtccaaagcttctcactaagctaaatttttatctagtaatactaatggtgaatatagttaatggcattttttataggctgataactttttcagtcgatgtcctgggatttttaattcttctctaccttggctccatccccatgttcctcaggaagggtaagagcaagatctagctttttagttaaaaattctgattttggcatttagatctgaagtcatatttctttaggtcacatttcctttgacttagtattctgcccatatttccacatttgattatcatttctgacttcctgtttccttattaagtttcagctttggggaaactctaactctcctggctgacaaaaacatattcttaagacttttcaacccatgtagtatttttattaaggatctcaaaaaaaaaaaaagcagcttcaaccaggtgttcaaaccctaatcagattaatggacttttttaaatagatgggtcaagcgtcagccaactggaagagcatgaagggagcagtcccagctgtagcacttgttgggctagagggtcatggtggtagtgagggtagttaaatttttgtcatgttttgaagtgtgaagattttccaaccttcaaagaataataaagaagggagtgcccctccataggtcaagcaaatgtacaatcacccagagttataaaatatgtagccttaggtgattgtcaagtaattccctatataatttttataaagatgagtttcccattggaacatttataaatgacttatctataaaaattcattcaccgcaccaatcttaggaaatccagatatagtatttagctggttggaataagttcatctccctaattttataattgaggaaaccagaagatctgagaggtttggtaacctgtctgctgtcacacctagttacacagccagtagtaggacacagatcgagttcttagtccagtttgctgcttcttatagcactctgactatgaagtgaacagcatctacctaatatttacctaaggagatgctttacattccctggaatttgatatttattttgtgacctctgcctaagagagtttaaaatttttagattttttttgaagtcagagagtagacttcattataactagttttacgttatttccttttataaggagctgtttctgtgtatcctctcatttcttctcaaatataatgacctagaaatttttttcatgtacatacatatgtacatgaggaatgcaggattcttacagttaatgattaacaagaatgtaactaaagaagcagtgtgtctaaatggtgagaatctgtgatattagagccaggcagacctgggttcctgtcttgctgttcctgttcatcagttaagtgatactgagaaaaacccttaatatcacagggacctcactgagccacctcatgtgtgaaatgaggttaataatactgttgcctaagttgttgtgaaaatgaatgagaaatctgtcaacaatgttatgcatatatactttgtgccaactacttagtactttgaagactaggggagactcagcctttaccctcataatctgctttacatagcatgacaatcagagaccagtaaaatcttgaatagactccagtgttactttagtcatagtgcatacagaatattctgtagttgatgagaaaaggggcagatgcatgcttgttttggtagatgggaaagtcagttcaaactcaaaatgccccaaaccaaactcataatcttccccactaaacctgaatctcttctggtgttcccatctcctactttctggttgtgaggcctgcagacctaggaaacacccttaacacctccctctctctgcccccatatccggtctttcaccagtctgttctatgttatgtagctcaaatctccatcatctttcgttgactaccccaatagcttcttagtctcctaggtagtcaatgttttgctgtctaatctaagcaagtctttccttttcatggagtcccattgtgttcaggaaagaaatgctatcatgacagtgtgaaagaaactcaatccttttgtactcagggtgaaatccagtttttaccattgcctacaaatatttccttgatttggactgtctggctcatgtctctaaactcaccttgtacactgtggccactagacatacccaagcttttgccacgttgactttccctagttcttttaagatacagccatgcatcacttaatgatgaggatacattctgagaaatacacccttgggcagttttgttgttgtgcaaatatcacagagcgtacttaaacaaaccagatggtatagcctaggatatatggtagagccaaacctgtacagcatgttactgtactgaatactgtaggcagttgtaacacaatgatatttgtgtatctaagcacaggaaaagtacagtaaaaatacaatataaaatattaaaaatggtactcttctataggactcttaccgtgaatggagcttgcagtactgaaagttgccctgggtgagtcagtaaatgagtagtgagtgaatgggaaggcctagaacattactgtacactattgtagactttacaaatactgtacatttaagctatattaaattttaaagaaacttttcaatcattaacttcagcttactgtaacttattttgtaaaatttaaaaatttttgaatcttttcaactctggttttaatacagcttaaaacacaaacacattgtacaactgtacagaaatgttttatttcttcacatacctattccataagctttttcctattgtaaaaaattttcatttttactttttaaattcttttgttgaaactaaacacatgcattagcctaggcctgcacagggtcagaatcatcaatgtcactgttctccatctcaacatcttgtcccacaagaaggtcttcagggacagtaacatacatggggctgtcatcaatgataacagtgtcttctggaatacctcctgaaggacctgcctgaggctgtttcacagttaactattttttttttttttttttggtaagtaggagtgcactctaaaataatgataaaaagcatggtatagtaaatacataaaccagtaacatagtttattatcattatcaagtatcatgaactgtatataattgtatgtgctatacttttgtatttttggcagtacaatcggtttgtttacaccagcattaccatagacatgtgagtaatgtggtacactacaacatttaagatggctaggtgataggaattttttagctcctttataacatatgggaccaccgttgtagatgtggtttgtcattgatcaaaacaatattatgcaatgcgtgactgtattatgtttcctcttatgttcgcattatagcttttgtgtatgcttttcctgtagctctgtagcttctcagctttcagaccttagactttcctcattgaccaaatatctgactgccagactagatcacaccctactgacagtctgttctcacctctatataaatccttcagtttgtaggtatgtatttgtgtaagatcattatgttctcaaacttatagtgacttgccatcacattttgagtaaaaatcaaagtcctttaatggctgaggcaaggccctacatgatcagccctctggtcacccacaactcccatcttcttcttcttttttttattttgagatggggtccagtctggagtgtagtggcatgatctcggctcactgcaacttctgcttcccaggttcaagcagttcttctgcctcagcctcccgagtagctgggaccacaggggtgcaccaccacactcggctaatttgttgtatttttgatagaggcaggatctcactatgttgcccaggctggtctcgaactcctgacctcaagtgatctgcccatgtcagcctcccaaagtgctgagattacaagtgtgagccaccatgcccgccggcctcaactcccatcttctgtactttccccccatttccttgtactccagccatgcagtcctccttgctgctcttggtacatacagacataccaagtagactcatgccccagggctttgcacttgctgtgtccctgatgagatgctgtttgggcactagttcttcatcagagtcaacatcaagggccttttctttgtagttttgatacaggtggctcactttctcacctgttctatgtctttacttaattgtcactccagtgaggccttcctaaactaccctacttaacatctacatgccctcctcccagcgctttctaccccccttccctgtttcatgtttcttcatgacacttatcagcatcaaaatactatcaaagttatttgcttatttattgcagttctctcatgctttagtatcagctcctgaatattgagatttttagtgtctattattgtatttcacgtgctaagctgttgccggttcctagtaggtgttttctaagtaacagttgaatgaataaatgcatgagtgaatttgacagtttttttaattaaactgttagctcatgagaggtggatgagggcatgagagctcatgaggcatcagaggtgtctttcttttgttttccattttactctcagcccttggcacgtcatagatacacaataaatgtttattaaatagataaatgaatggtgatggaccttaaataaaagataggatgtaatttaacctaaattacagtgatttaacaggcctgactgtccttcatgagtagtggacagagacatggaaactgcttctgttggcattctctgtatgggctggtccccttcccctgcagttgagtttgagatagagctatgtgaatgagaaaatcacttttctgtaattattcttcagggactaaatctgtttgtctctctgtttataaaattggaggccaaacattgggtacatatgatgtttatttagaacaagtaacataatgattgagaacaattagtgacacataggccttgttttcttgcagaaaatgctgtcctgtatcaaaactacaaggaaaaggcccttgacattgattctgatgaagagtcagagcccaaagaacagaagtcagatgaaaaaattgtgattcaccataagccattgagatccacatggagccaactctctgcggtgagtgtttatcttcttttctatctgtggtaggaaaaaaacaagttttggaaattatgtgtggatttggcttttgttcttttctgccagtgatcctgtaactaaggagaaagactctttttagattgtgaaatgtttctcggaactctgcccgcactaatgagaacatgaactttgacacttctgatcaggaaaattaggtttgataaaataaagtgctatgagattgatgtactgtgacctctggaaactctttctgcgagatctctctttttgttaaatatagcctgcactttatcataattatggctatttacatatatatgcgtgtgtgtttatgtatgtatgcgtgtatatgtacatgtatgtatgtacctgtatatgtatctctgcacaatagaaagctagttacaattcttccttggaaatttttttttttttttttgagatgaggtcttgctctgtcgcccaggctggagttcagtggcgtgatctcggctcactgcagtctcccaggttcatgtgattctcctgcctcagcctcctgagtagctaggactgtaggcgtgtgccaccatacccagctaatttttgtatttttagtagagatgagatttcaccgtattggccaggctggtcttgaattcctgccctctagtgatccgcctgcctcagcctcccaaagtgctgggattacaggcatgagccaccgcatctagcccttccttggaaatttaatttgatatagaaatgtttatatattcttaaagctgattaatgaatgatattctgttccatctctgtgccttttttgtatgcctgtctctgacacttaattttgtgttgatgagtaatttctcctctctgcatcagacaccttttgttttttaactgtatatttttttcctcctggcttacaatgtcacagtttgatgcttagtttacttgataagagtttgggcacagcatttgcgaatatctgatgaattagcaagtagaaaggaattcccatggctggcttggttcaggggagctttgcatcaaaaacaagccagtacacctccatgagtccttaggcaatatcagagcagaggtgacagagatgtttagaatcaggaatcttgtgtatttagggaacccactggtgtaagaaaaggagttgttaatgttggtgctgtatagccagggccgtgggaatatgtgtatgtaaacggtgggagacaacttctgcttcaagctctaccttccctcttctaacctgtattggaattcaaaattcaatacaccaagcgctttctccctgtcttcttcccacctcctaattttgttctcaggagaatctgttcatttccagggcctctgaggtatagcacccttatgattatgccaaaaattaaaatattcacagtgtcaggggaagtagaatgaatatgtgatgctggtatatgtaggtgatagggagtggtgggagctgtggtgaacaggccttatataaattgagcagctactacttagctcaaaccaggtgagtgcaggggctcagtgtgaccagatgttctgataattagaaaagagaatgtacaaatccagacttttatgagtattttctcaactcaaattttaaagaaatgttgtgtgtccaagaaagtattcagatttgccctctatgctaacagtttgtaacttctgtgatatttttaaaatttttgcatgtggttaggtggtaaaagctagccacagaattggtttattagcagccttataccctaatctaatgatctcatgatatgtgtatcccaaaacagatatgtggaaaaactgatgacaaggtccattgaggccatgttggctctaaatggctgtcattcagttcattcagttgttggtatggaccatttggtagaggatccaggagaagaaagaaggctgtgaattttttgttttctctctgtggcagcagctgggtttgttagcacaggcctaaatcgtgctgttggtctctgaaagaatgctaaaaagaaatgtggatttttatgtcagttacaccctgatctcagtttagcccaagaaacaggctgccatatttatgcctcctggagtttggctttcatatacatgaacaaatgtatatacaattaaataatagtgcatatccttcagttcaactttgtttatggacttgcattttatttggcaaaaaatgaatgttgtgtcttttgtaaatgatattgatatcatagaactatcttgtaataaaatgtaaaactataaagtgatttctgattttagtgtatgttatcttggagttgagtgttcccgggaggcttgtgtgtgtttattgtgttgcttggcaattaaatttaatgaaagcagcatgattggacttggccacttagcattacttaggcaccagcctgcatttctttgtgccttttgtgtcttcttttcacttacattttactttaattttttttgttataaagtgctttaaacccatagaaaaattaaaaaataaataaagttaatcaatttctgtgtacctatcactcagattgaacaaatgttaatattttaacatatttgcttcattttctatttttttagactattacagcgaacccctccttcctttccagttcttttctccttcctacctccccagagataaccactatccctgacgttctcttctgtccttcccatgagggttttctgtccaccaaaaagatataaccagttctggcttttaggaaagtagatattttaacaccagaaagcagccattacctttttagaagctcatctgctactaaattttcaagttgtatttaggaccctaacgagcggaggcttcgtgcatcattaacaatgtcaggatgtttctcaaaagtgatcggcacctctatttctctatctgacccctcctggtagtgaagctgcagcgtttagggcaggtctcagaagactttcaactttaatatatatattcagctttaatatgtaatatataaatatatatgtgtgtgtatatatagagttggaggtctatatatataaatacctagtataatgtatatattaaacctagcatcatctacgtatataaaatcatccttccatgcttaattttaataatcaaaatagtaaggtagcccgtctaattttgagtataacattttaatgcaaaactcttcttaaagacaaggggttttctggcagtgggttaggtctcagttcggcatataccttcacttcctgctaaggagggtagggagtgagtgcacatgtgcattagccggtgttgttttattttctaaaaaatctttttattgcaaatgcctgcctcctgggatggtgaaactatccttatcagttgactataagaagcattcagtatgctgaatacttttgaagtgcagcaatttgcagtaatttatggttgttacgtaagatctttaagccttgagtctgtgctgtaatttgtctgggcgtgtttatgtttcctttggtttcattggaccatgctgggtaaggcagtgttcagctatacagatgacaggtggttccccatttatggtgttgggacaggtttaactgtagtgttgtcatttaggaataaaggagaattagaagaggcatttatttagttgggcctcagtagaataataaatgatagtcatttgtttaactgagcctcaatagaataatgagccacagacttctatattaggactaaagaaataaggctgcacacctacaactatctgatctggcaggtttgtagaagatcagatagttgtaggtgtgcagccttatttctgggctcttttttctgttccattggtttgtgtgtctgtttttgtaccagtatcatgctgtttggttactgtagccctgtagtgtagtttgaagtcaggtagtgtgatgcctccggctttattcttttgcttaggattttcttggctattttttggttccatatggattttagaatagtttttttccagtttgtgaagaatctcaatgctagtttagtaggaataggattgaatctataaattgctttgggcagtatggccattttaatgatattcatttttcctgtccataagcatggaatatttgtccatttgtttatgtcatccctgatttctttgagcagtgttttgtacttgtagagatctttcacctccctaattagctatattcctaggtatcttatttttttgtggcaattgtgaatggcagtttgttcctgatctggctcttggcttgactgttgttggtgtatagaaatgctagtgatctttgcacatcgatttcgtatcctgagactttgctgaagttttttttatcagcttaagaagctttccggctgagactatggggttttccatatataggatcatgtcatctgcagacagggatagtttgactttctttcttactatttgaataccctttctttctttcttcctttctttctcttgccagattgcactggccaggacttccagtactattgtattagtccgttttcatgctgctgataaagacatccctgagactgggtaatttatacaggaaaaagggttcaatgggcttacagtcccctgtgtctggggaggactctggggaggcttccacaatggtggaaggccaggaggagcaagtcacgccttatgtggatggcagcaggcaaagagagagcttgtgcagagaaacttccgtttttaaaaccatcagatctcgtgagacttactcactatcatgagaacagcacaggaaagactggcccccatgatcacttaactcccacctggtccccccaacaacatgtgggaattcaatatgagatttgggcagggaaacagacaaaccatatcaactatattgaataggagtggtgagagacggcatccttatcttgtgctggttttcaaggggagtgctttcagcttttgcccatttagtatgatgttggtgatgggtttgtaatatatggctcttattattttgaggtattttccttcaatacctagtttattgaggtttttttttttaacatgaatcaatgttgaattttatcaaaagccttttctgcatctattgagataatcatggtttttgtctttagttctgtttatatgatgaataatatttattgatttgtgcatgttgaaccaaccttgcatcccatggataaagcctagttgatcatggtggataagctttttgatgtgctgctggatttgatttgccatattttgttgaggatttttgcatggatgttcattaaggatattggcttgaagtttttttcttttgttgttgtatctctgccaggttttagtatcaggatgatgctggcctcatagaatgagagaggagttcctcttctccaattttttttggaatagtttcagtaggaatggtaccagttctttttacatctggtagaatttagctatgaatctgcttggtcctgggcttttcttggctggtaggctatttattactgcctcaatttcagaaatcgtgattggtctcttcagggatttgatttctccctagttcagtcttgggagggtatatgtgttcacgaatttatccatttcttctcgattttctactttatgtgcctagaggtattcataatgttttctgatggttgtttgtatttctgtggggtcagtggtaatatcccccttgtcctgaaataatgttaatggtcgtagttcccagtttgggttggtcaaatgtggaagggatttgaggttttgaaacctcaatgactttgaaaagtaagttttgacccctggagattatctggaactctactcagagacaaaaaccctgctgcacgcaggtaaatcaccggtgcctcacccaaaacagcagcacaaacattaagccagcagttcttggatctctgggaaaagcatgtgggtttgaaggaaaatattgattgtattagtcagggatggaacactgtgtacttgttacagttaatgccaggtgtgtagtcagctgaacttcaggttttccaaagggttcattcattagtaggaccccggaagtatttattgtcttttcttttagatagattttgactagagtttttgcttttcactgtaagtaccccctccacctctccaagatcatgtactatgcatgtatgaagaaatgactgttgcaacaccagtgtttgttatgttaagttcggtgatggaaccaaaaccatatttgccagctgtgccctgacctgatttatttgccatggggtgcgtttgtgtaatttccatcaccttgaaatgccagatacctttgaaaagggtgttctctgttcagcacctaatagagtcatcctctactgcactcttcttttgtacttgctgacatgtggctttatcagtaatcttaagtcattggaatgtttcttcagtttgctcaaatattttgaactctgtagtcagaaatggtttgatttcttaaagtattttaattttaattaaaatattttaactaaagtattttaattttaattaaagtattttaagtaaagtattttaattttaattaaaatattttaactaaagtattttaattaaagtatttttcagctctgtgctaagtgtgactaacagtgcaatgggagatctagaattcagacctcagtctctggttctgggctcagctcttaaagcacacatagtgtacctgtgggagactttctggaattgcaggatgagaaaggaagatttgaaaagcaggaattttattataaatatcatttcattccattgaaaatgcagcagacactttggcatcttagtagtttgaggtgatgggacttattattttagaatttactctgtgcttattgtgaaagacatactattttctagtaaaaatcagagctcaacaaatgtaatatacctgaatgtcattctgtttgcagaaatgcttaatgcatttaaacttattcttttccctaaattttcacatttgtctgaattttcagttgtttgtgacttgttgcttaaaatagtaatttctgtagttttataatttttcatttacagtttggcaacgcagcagtctcataagattatttttttactttagatggtgactaaaaccttttaccatatctttttttgtgtgtgtataagatatggaaaattattttcactttttataactggctcacatttagctcacatcatggtttaaacagaactgcaagcacatactagtccacattttcaagttggcttgtgggtcttctggaatccttgtgtctttataaacaaaaatagaggcccatgtgcctagacctgagatccatggtttggatatttttcccctccaaaactcatatggaaatttaattcctgatgtagcagtattgagaggtggagcctttaagaagtaattagatcatgagggctctgcctgcgtgaatagattaacagccgcagattactgggctaatggattaatgaattatcatgggaggggagcaggtggctttataggaagaggaagagagacctgagctagctcgttagcatgcttagcctccttgccatatgataccctgcaccacttcggggctcttcagagtgtccccaccggcaagaaggctctcaccaaatgtagcccctcagcctggaacttcttagcctctataactgtaggagataaatttctttgctttataaattacccaatttcaggtattctgttgtaagcaccccaaaacggactaagacataccccaattagaattactactctagctaagagagataaaggtgggggactacttagcttgggccagggactgggctctgtatgtggtcttgctttttatgtataattagattatggtacatttctgaaaattaacttgacttatgtaagcaatatataatatgtccttcatgtagagaataattcagacattttggaccaggtacagtgggtcctgcctgtaatctcagaactttggaaggctgaggcaggaggatctcttgagcccaggagtttgagaccagcctgggcaacatagtgagacccctatctcttaaaaaaaaaaaaaaagaagaagagaagaagaagaattgggacatttcagattagactaaaggctcttttggtcatttgtgcaatcccagtctctatccccttctccatagataatgctgctctcaatttggcaatactcttctgaaaatccacatatatacatttaaggaaacaatatagattacccatatttatgtaaatatacagactatttataatatacagcttgtttcttttctgcactatgtgtcttataagtcatttcatatctacacatgatctacagtgttataactgcattaatacataggatggatatgcatttagccatctttactgggggagtgtcatacatgctttaagaatctaataaaaattatgagccataggctttctctgtagaaaaatgcacacatgtatacatgtaaatttttttaataatttttgttttttcagttttagttggagagtatttttttcttgactttatttccaaatactaggagcaccttagtgtagcttgttatgtattgagtacagtttccatgttgttaatatcactttaaaaagtttttctgtatctgcattgttgcagcgttggaactttatgtaactcctaaaaatatagacagagattgaggaaaaaactactctggttggagctcactaattaaagggcaactgagtggtagatctgccaatatttatgtaattgattcttctgagagaacagtgaagtgttgggatatgggggtgtgtgcaccagttgcccgagggtaggcagagatcagaaatgacaggtgctccaagaaagcaggaggagatgaaaacacggttagttaattgttatgggcataactacaaaggcagatgtttcaactacaaacctacaacagggtccagacagagagggtcttcttacttcattgagtagaaaatcgatgagagagattgatgaattcattgtcttcatcaagggcctgccccacatgaagttctgtctatggcaggccctggagatagagcaagaacagactccaccttgcattcatgtccttgtaaacaacctgaatggcgagacagatgtcagatatcaaatcatcccatagataaatgcataattactattgtggtaaagctgtgaatgacttactggtgctgctgcaagatcttctagaaaagagcacctgtctgggcaaggtgcggtcagtggagagcaggtgtcagaggaggtaatgtgagctgtcatctggagggtccaggacgatagctggtggggcacagttggggagtggcagggtagaagagtctcaggtagagaaaatgtcatgtgcacagacatttggggtgatggtgggtaagaggagttgggataaggccagtgcagctggaacatcttgatctcctttgtgggtttttcctcattcctctgttctctaaattttggagggcccctgggctcatccttgggcctcttctcttacctgcactcatgtggtggttttatcaatcttgtacttttaaatatatcatatactcggatgacttccaagttattgcttactatgaaatcgaattaaattttggacttattctcaactagctatttcttttggggagttggaagggatacattcaagaataatagcagtctgtaggaagagaaggctcagggatgttgaagagttctgaataactgcatagaaaggctttttcatactgactttggattgcagattcatctatgggattcttgtatttgccctgttgagcttaatgtatcctcttgtggggtctccttcctcagtccaaagatagggctatttctcagggccacatccacacagtggttggtctccatgatgattggagagtgttgtcacctttaaaattactattgaatctttaaataaggaatccttaaaaatttgttactcaaattttgtggatttatctggagcacatatagcctgttaattctctagattattagcctgtactctaatatcttaatattaggatgtttattatctatatttctattattttgaggagataagaactatacagtcagtggacaacttctgtagcaggaagtattattgacagtaaaataaaattgcagattatttccctctttgtaggaaataagcctatccaactataataatacaaaaatggagcaatttccacttagcctggttagaaaccctgcttctggtagtggagtgcaaaggagtctgattgttgtgtgcccacctgggcaacagggagcccttatatccacatgggtccaaagttctgaatgagcagactgagttgcaggatagctgttagctctgggatcatcacagtattgatttgtttacatgcagttaaattactgaccacatatttgcaggagacttattgtgtaccaggattgtgttaggtaatttcagatacagtttatgtagtcccgggacaatgccacgagggtaagtacaaattctttactttgtaacaagtcagctgagaggccaggatgttaaatgcggctgctagttaaggtcttgagattacttggaacagcctctgcagtgacctcaaaagatggatacatgtacctagggctctggaagagcaggaactatgtttctcccaggtgctcagccaataatgtgactgcaactctgacttgggcttttttttcttctcataaattggcttattttccctttttactatgcttgtctttttcctgaaagctcctgaatactcagggtttctgagtgcttttttttttttttttgagatagtctaactctgttgcccaggctggagtgcagtggcacgatctcagttcactgcaacctccgcctcccataagcgattcttctgcctcagcctcctgaggaggtgggattacaggcacacgccaccacgcccggctaatttttgtatttttaatagagacagggttttgttatgttggtcaggctggtctcgaactgctaagctcaggttatctgctcgcctcggcttcccaaaatgctgggattacaggcatgagccaccatgcccagcctctgagttctcataacttacacttgagcacttgagactgtgttaacagccctgtccttccctcaagtcactctttcagcttccatcctattttttttttgagatggagtcttgctctgtcgcccaggctggagtgcagtggcacaatctcagctcactgccagctccgcctcctgggttcacgcagttctcctgcctcagcctcctgagtagctgggactacaggcggctgccaccttgcccggctgattttttttttgtatttttagtagagacggggtttcaccgtgttagccaggatggtctctatctcctgacctcgttttccgcccgcctcggcctcccaaaatgccgggattataggtgagagccaccgtgcctggccttccatcctatttttgaaaggatgtaggccagaatgccaaagtgagttacacagtttagttgcccagtttagttccttgagaaagagaattatattggctcagctactttgcccccgcttaataggtcactagaacatgtattgtcatttagctaggtgcttaactaactctgctccagtcagctttggcctccatgatgtactatggcacaaaatgtggtcccttggggctgctgcttttgcagaggctgtgagtagaatggtttttcttgtagaggtccatggaagtgttaaacgacatgactgactgacttttgtctagtgtaaatttatacatcatggagtggacattgtaaccatggtctttatcagcagcttaacatgataagaaatatgttttaccttataaaccagtatgtgtgtctgaatgtgtatgtttgcacatatgtatgtgtgtatatatctcaaagaaattttacaaggcaggagttactttatacttctgcttgcagtgtactatagtatttttaatttttttctgttctgttacatttaaatagataacgatcacttcatgataagactttattttgcattcaatgccagtttataacttataatttgaacagtggtaatatctgactccaaaattcatttgttttccactgcactgtagtgaatgaggcaaacaaaacaaggctaaaacccagcctaccctccaggagcttagaacctagagcagaagacaatagaaatgaaatgtctgaatgatattttgaaaggatgtaggacagaatgccaaagtgaatgacacagttgaaatcacagaaagcagtgaagtgaagatgaggaaagttttgtctataggatgtaacttaaactagatgggctatttgggcagaagaggagaaaataaaagtaatgaaggtgtaaattgcttgaataaaactttttctttttttttttttcttttaaggtagagataggaagacaggatttcaccatgttggccaggctggtctcgaactcctggcctcaagtgatccacttgccttggcctcccaaagtgctgggattacaggcgtgagtcactgcgcccagccaataaagcttgataggtaggcaaagggaagaagaaagataggacttctgtgtctgtttctcagatctccgtacaataaggtaattcctgtccaaagaaaccactgcctgctttgtacatctaatggaaagcatcagtttactctattacccatttttcagaaacagattttgctcaggttagatttttattgcaaaatctcagaaattcagagtcgctgttgttctaagtagcttattgttttggagtttctcattcctatccactggtcattttacaaaaatagcaagcaaaaataaaatagcaactaatatattggcatcacctttagaaataggtgttcttttcttccgcaagagaggaacatcagacctgttgtaccttccttaaccccttgactcataccttcactatgtgtaaatggcatcattctcagttacgcagactcctttatcctcctttatctctcatgcttgcagattggcctgtcatcactcattttcagcactgcctcataagctattgctcagtttggacttgattaaaatctttctttcttattgcctccctttaccttagcttctcatttcttttatctacaggtggtcatctctcatttctctagtttctctttggggcagcaacaaagaaatagaggtattattggcacctttaaacagttctacttgtctgccctactcgttttgtttcttttttgggagaggatgttgaagtagtattttagtttttgttattcgaagtgttgctttaattgcaaagccaagacatgtttattacagaaaaatcagaaagtaccaatagataaaaaaattgaactatctctttctattcaatcactattaacatttttgtctataacttttcagatttaaaaatatatagaaggattgtcttttacgcaaaaatcaataatgtagtaatagttttgtcacttttttcccttaacagtgtcgtaaatatcttttcatgttattaagcctgctgttttgtcacctttttttaacagtgttatgaatgaccttctatgtcattaaatattcttctacaacctttttaaagcccacatactagctcctcaaataagtggatgtttagctcttttaaccaatttcttgttgttaatcatgtgtgtgtttctaatttttcaatttaaaattcaaaatttaaggctgattaagttttttaaaataattatttttgaactactgaagtaaaagaaatacattctccttattaaaatattaaatgtaacagttaagactgaaagctgcttaactttaccaccattcccaacccctcagctgttaaccactgctataagtctggtctgtcccccagtattttattaaatagtgcacgtttaaaaattgttagtcttcggttaaattatagaattgccctttaccctgaatttattccctttcatccttgttacttctgtgtcattagcttttcatgtatttgttaacctcattttctcttcttaatttagctgatagatacatgagaactgcatctcttgctcatttgggggatagagaatacataaattttagtccaggctcagtagcccacagcgggaaatgcaggttagagagagccacaaggaaaagaggaatttgtttggtggtagaaatgtcaggattgatcaacaagttaaatgaccagggagccctgctgacagcttagctttcactgcagcagaagccaggaagccaatgagagatgttgtttctggggcattcagggggagcaacttaatttaggggaagagtagcttgcacagctcttaaaaactctgaagttttagaaggcagtgtgctacagtgattaagagctcaggctttgggggtggacaggccggcccaagtttgaatctcagctttccaattattagggtgaatgacttaacttttctgtgtctccgttctttatttgtaaactagggatagtaatgccttcctcacagaattgttacagggtttagatgcatggaaggaacagtacctggttcatggtaaacatttgatataatggtagtttgagaaataaattgagaaccaaccagaactctgaatcaggaattgacaagacatgggtagcaagctggtgagtgctggctgcaaatgaagtaatgcacgtttatttcctaaatgtacaaagcacagcagttcattcttgtgcatttaattacttatctgtagtttgtattctcagcctcatgtctgtattgaaatgatttggattcattcaggaatcctggctctgtctgtagatggtgatgcagggcatagaggagcaagtgtcctggtctgctttatctgagttttccattattttagcaaactcgatgttgcctgcttgaggctgagtacttgctatttcttgagattcaaacacttttttgaggattatagaattaagcttaacaataggacatcagagagatcagctttttgaacaaattaatttggatgtcactggcatattacctgatgcatttttaaattaagcatatgattttatgatatgtgctattatccttctactttttctttccttaaaaaaagcgttctctctctctgtttacccaccactccccagaaggatgacccatcttgacctcatgtctagtgtttggttatgcagatctctggccctttgaaatttgtgttctgtggcagctcctagctaggaaaagtgatgtcttagaacctttccttgtggatgtagtggggttaaagagagcctattgggtctggttacagaggacactctttctggactctggcagatttttcattttaaggatttcaagcatactctcaaactgctgctgttcccatgttatttacagtgaaagaactctagctcacttgtaattcagggatgactcaggttacattaagtctgtagaaaggacctgagagtgattgtgtcctgtggtataattttactttgaaatcccttcccatttgagctcttgagaaaagaagcctgtaagtagagaatcaccaatagacatgaaaagcaagcttactttcagcaaatgggtaaactccattgagttttagctcagatgggtgttcagtataaattagtgcttgatggagacagagtgatcttggattgtaaatctaatgtaatttttaactggctacatttttgagtctttttggtttgtgaggcttttgggttcttcccatctgttttccctagtggtgggcaaaaatagaaggaatgcacattcatctagaaacactatcgagtcatggagggtctgagaacaaagagggcatcagaacataaatatccctgtttacttcacagaaaatgattatctgatcagccaagagactggtgctaatcttggttctctccacagatgtaggactggctgtatccatagataagttctgtgtaaatggcaatttgagggatctatttggggcttagagaacttggctcataacctattccagttagtagagtcaaagaccaagaaatattacacaaagtttatagttcttttacacagttctctgcaaggtggagatgcttagtgtaactgtgatgagtgtaataatggactcacggtctaaagcttgtctgttcctttttagagtatttatctgagaagctcagacctgcaaagtactttagtttgggctgccataacaaaataccataaattggatagcttataaacaacagaaatttatttctcacagtattggaggcgggaaagtccaaaatcaaggcagatttggtgtttggcaaggggctgctttctggcacatagtgccttcttgctacatcttcacgtggtagaagggttaggggtttctctggggcctattttaaagggcgttaatcccattcatggagcaaagcttaatcacttcttgaaaggctccacctcctaataccatcaccttgggggttaggatttcaatatatgaatttgggaggacacaaaccttcagaccatagcacaaggtatcaaaaaggaaaccggcatgattttaggtggagtgtctaattaccttttggatctatactttgggagtttacccttttacaaatttcataaactatgttttgggtctaactagacagcatcatatccatagaagaaatatcttgtagtgttctttattaggtttagccaattactaatttctatctcatttcgacatgcaaaatatatcagttataaagatcacaggtcaagaatttcagcaccaattatacagtaaatttgtaattatgaatttaaaactattataacattagcaagttctatgcattcactatcttaataaggcacagatgtatgcttatatttttaacatgtcaaaactgtagtattgttcattttcttgttttatttgaatttttatccacttaaaatgctgaagatatagacatatgttcatatattctgtttaaaattcagaatctacagatttgaacagtttgtgaattggctggattatacaaaatcaagaacctcacattaaatccagttcttactgctttgttaaaaactacttttgcaattttacttgttgatgacatatttaaataagaaatttaaaccagtgaggaataagaaagttcaaatgaggttgctttggctgtctgtgtgtttaaaggagtgttgctttggctgtctacatgttcccatttgtacccagctgaagctggtatgaaatgtatattttaaaaatgaggccggacatggtggctcacgtctgtaatcccagcactttgggaggctaaggtgagcggatcgcctgaggtcaggagttccagaccagcctgaccaacatggtgaaaccccctctccactaaaaatacaaatattagccaggcactgtggtgcacgcctataatctcagctcctcatcctcaggaggctgaggcaggagaatcgcttgaacccagaaggtggaggctgcagtgagctgagatagcaccactgcactccagtctgagcgacagagtgagactctatctcaataaataaataaatacgaaaaaggagcctgtacaattttaatttctttcactttatgtatcaagtaagactcataggttttagaaactggtatattatattttctttcccacgaatggagacaatagaaacacttgaagaaatgggataaatttgacagtactttggattctcatagcaaaaattggtaaacttcaaaaagcttgtctattttaagactataggtataaacatatgtttttcatgctacaaagcctggaacatcaagtgatttttacttaggtttacagataaggtccctgtgtctgaatttgagaattttcagaggtctttcctattaaaaactttgtacacattctttttccccttcttttcttccttttcctttcttcctccctcccttcctctctgcctttcttccttatttccacttgatgttattcacctacattctcattctcccctgattgtctcttctttgctctctctcagtcttcttggggtccccttttcagatcattctctcccctcttgggtttcatctctccaccttgatcagtctctgaaatcttcttgcctgttcatgaccttctacctccagacacctgctataaggtgctacttaatttggagttgactgtggaaggatgcctcaggtggacaaaatgactcctctgggccttggaggaagaacctctagagcctgttctgttacaggccgtggaaggacagagacagaagcacaggcccaggagcagcggcctggcagccagccatgaggagccgctttgtcataccttagaagaaactttcaggctccccaaatgtgtgacacttcagttttctcaatcagaatacaagaaggcttcccggaatctctttttctagcactataattttgttagttccttactgatggcttgttaaaggaatattttactatatgtcatgttagtattagtgaaagattataattctgtatattaatactttacctttgtcaaaactaccttctctttcccctcaaaaaagcaagtactttagttgtgggtttgccctctcttttgataggacaaagtactcttaattcctcagtaaagtagctgtcatctgtgtaggtcgctaagcccaggtttttcattctcttctccttaagattttttgggtctgaaccccatttgggtggagatgccactggcatggaaattcttgctggtgacctcacctgcagagattgtgggcatggcacctgtatatccatctgccggactttgggtcatgcaggaaatcctgtgaaattcctgctcagggttaaccaaagggagcagctctgaagggttacattcttctggccagtctcctcccttattaaaatgtgtaaagaatcctttttagccatgaattcttgctgacaggctgacccagggtcaggatggtgggtaaagctaagaacattccaagatacatgtggaccaaaaaaacacatgaaaactggtacagacttggtattagaaggggtcttagtgatgctagcccaacccttagaaatgggatgcctttcatataaagtagggggtccctaaccaataatattgactaaaagcatgagccctggagttggactggcgtcgatgcagatcctggccttgttacctattagctatgtgctcttggatcctaagcctcaattgttacccccatctgtgaaatggggaaaagaacagtatcagctttctagagtttgtatgaggattcaatgggaaaaagagtataaaatgcttagtatattgtctggcacactataaatatttattaaataactgttgattaattaataaattaatattgatgaattcaacattttgtatagtttctcctaattcatttttgaagggcatagagttatgccttgaataatgcccttgaaacttttaaagtattaataaatgagtcaactctactttgctttttctcctaggtgaaaagaaagggattatctcagacagtaagccaggaggaaagaaagagacaagaggtatgtttctaccgagcagctgctttagagctctggagtgtgcatgtcggtgtctgcttttttgtgttttcacttactgtgtgcacttgtttagtgttgccctttgaaaatgtatttgtttaacaaaagcagtaagtgatcattttaatgtaaagctacgcataagcccccagaaaagaaaaaattttaaatatctcaacatcactcaacatcgtttgattttaaacaacaaagcacctagttcaggtatttaaactgagagaaatatgataaaaaatgaaaccaacattagatcttagaactgaaaaaggatgtttatggaaaaactgatagtcacgttagtctgtagacaaatgtagcctatttatgtaagataccctaggttagggaaagctggatgtagcatacaagggtctctgaaccctttttgcaagttttctataaatttaaaattataccaaaataaaaagtttatttagtaaaaaaaaaaaaaacaggttaataatgcagttttacaacttgaagtttaaatcaatgcaatttgagaaaattgcttattgtaataatattgtgaagctctcaaagcattttcctcttgcttcctgcatattattgtgtgtgtgtgtgtgtgtgtgtatgtcaatgcatatacatacatataaattgattccacaaaggacccaaggatgtccttttttttttttttggttggcatagaataaagtgaaatacaagggtgcagtatagtgccattttttcaagtttaaaaaaaataatagtatagaactttggtgtacccatccactgagaattaacaaatgtataacaatcgtaatttttctccttttttaaaaagaacataaaactgatagtgtagaaggcctgcattctcttcctcagtcctgtcctattcctttcctccccagagacaactataattatgaactggtacatatacttccagcctgtgttttaaaattatgtataacatacacacacatatttgtgcatgtgtgttaaaatgtatatgtatgagattctatgcatattttttggttttctgttttttacactcaacattatttttgagattattcatgttaatgcatatgaatctagatcattcatttcaatcatcatatagtactctagtctatgaacaccacctttaaatattttttatctatttttccaatgctggacagtaggtgggactttttccttcattgttaacattgtgacataaaaatgtttccctctccttgtggataaatttaaaagctcctccaagatattaatcccatttgaacatttttgttcttttaaaccttatataaccttgcctatttctatcatattctgaaaatatttattcagactttctattcctatatagcaattcctacctgctatatataacaggtctaacctaatttgcttttaaatagttgatggtattattgcaggatattttagcaattattttattaaacttattataataaactgccaattatttaccttttcctgtgatctattataaatagttcattaagtctttttgcccagtttgagtatttagattagattacacactctctccttgatgtaatcagaagtaaggagtgagcagagtgggggaaaagaaggaatgaagtgactttggacagctgtctgctgtgacaattcattacacactgaacatctgtctgtccacccaacttgaaacatacctcaaaatttctttcaaggaatcaagacaaaagccaaatgcatgagacattataaccctaaatggcttcctttggagataacaaagggcttatttgtttatgcccttcaggaacaaaagaaattatttaaaatgttgaattcagcaatattaatttttgttctcaaaaccctcaattatcacttaatcacattaatcagttagcatagtacagcattgaagaagtgaaaaatgtctttgctgttgcaaatattttaagtaattccaaggcatcgtatacatcaacacctgaaatccattatttatggtccagaagggaaatttttctttaattcgctttgtgtatagtttttgggggttattgtattgattgaaaaaattcaatacgcaggttaaatgagactcttaacattcttactctttactcttcagatagttacatcacttaatttcatgaaatacaactgaggctagattagcacatttaagtaagacccaagtccctaaaccttacggaagttaaaagtggaggtgagcactgagattagcacttctaacctgatttataaaatatggagcacccatcagcagctgggtgtccacctgcttgtgcctttcctgctcccacccagccacagtaccctctgctctttggggcaaggacttgaaggggtggagccctggagatcagggtgatgaagacagaattaccagggagctttccaggaaggctgtgaatcttaggcctgcattttccctatatccctttttagaggatctgaatttgattttgttaaggatctagatgaattccttacgcagggcattggaatcttatccacatatgtgggttggtatttcatcattaacagttatcaggaaaaccactgtgtgcctgccactgagagtctctgcagagagtcctttgctccttcttgagacattgatgagagtagagaatgtgacttgttgaatagatggaattactttcaattgtatgagtttatataaaagaattcctgtggttgataagaaccttttgagggtagacacagtcataccagaatatttgctgttattgactgaaaattagtcagattaagcatagggagaggaagagtgtgacacacaagagggaagggaaggaaggtgtgagaaattttctctgaatctcaagagatgaccataaatccttactgtccctaaagcagcatgctttgaaagcagggctggaggagatgaccccaaaggttaattaatgtctcactgagattttatgacatgccctcgcttccttccatagattctaccccttggcaaaggcatgacctcaggatgtgatgtcaagtcatccacatgatttcatttttttcatatttacagatagtgattattttttaagatttgggtaaatgtatattatataaagagagtagttttgtgatgttgtttctttaatgttctttttgtactttccaagatactatacctgaaaagtggagtatcttgttattcttacagcaaaattatgagagctatatttagttctttaattaaaagaattaataatacatttctttttccttcttaccaggctatctttgaagtcatatcctctgaacattcatatttactcagcttggagatcttgatacgaatgtttaaaaattctaaagaactgagtgatacaatgactaaaaccgagaggcaccatcttttctccaatattacagatgtctgtgaggcaagcaaaaagtaagtgcactgcagtctgcctttggtcgtgccaagaagttgcgtactaataaacactttgttatctctaaaggaaggcatttctggttatcaagtctcattcagttggcttttgtcttgattccttgaaatacattttgagatatgtttcaagtttggtgaatagacagatgctcagtgtgtaatgagttgtcacagcagacggctgtcctaagttatgttattcctctttccccactttgcttgctctttacttctgattacatcaaggaaagtgtcttcgtttggtgctagtctgtgatattcatccatttcagtaaagaaagagtaagccttaggcttaggtcttctgcaggcaatatctggctacgatttaataatatatattttcattatatttaaggatttttgctttactttttgtcatgaagagtagataaaatcatataataaacttttatacattcaaaacttatatttagcaattgttaaaattttccatatttacttatctattatttttgcttaatttttttccaagtatatacattggatgttttacttataaatgctccagtattcagctcttaagaataaggttattttcttacataactacactgttgtggttatacttatgatgatgcttttatgattttattccatttaagttttgtacgtgtaagtagtagagtcacatgttgcaaaattccaaaaatatgaaagatcctacagtaaaatgccattcatatactgttccctggccacctgaaacacaaccagagtcaacatttgtttcttgtgtatctttttagtaatactttatgattatgtaagaaaatacatgtatatatatatttttcttgtttttacttaaatgttaccatactataaacactgttctgctccttacttttttttacctctatcctggagattatagcatgtctgcacattaaaactttccttattcatttttatgttttttccttgcaattatttgttgaagaaatccggtcatttgttctgtagaatttcccatgaggcacataatttatgggtggtgatcaataccagatccattaattcattaaggattgtaaaacagtgttactctaatttatcgttctttattcatttattagctgaaatatttctataaagggaaaggtacatccatctattcatatattcagtggtaaagttcacgttattctatttattagtgctcaaattgttccatctttgatcttaacaatttttgattattttcttgctatatgacattttaagatgttaaaggatcatgttttacaattcctgctccaggcctggaatcaaccatttccccaaagagctctggtgtcttttgaaatgaggtggtatttaaaacctcagtgagtaccagcgtgctcattgctaagtggttttaggctgtttcagtagatacccagaaaaaaaatccaaatttttctctataaaactagatatattaaaagcccatagacactccaaatttatcaaagtatatatattaaataggtacttttttatgtatcaattatacctcaataaagcttaaaacataaagaagaaagtctagtttctattcttgtcccctctatcctattctcttcccatatagatactcttaaataagttgtttatctttgttttttaaaataagcatatgcatatgcttatgtatatgtattcccctcactttcttagataaatgaaagcatattctacttatttttctcagcctctttattcatgtaacaacatatattagaggttactccatagtagtttatggagatgttttactcctttctccagctacaataattatcatcgagtaactgtgtagtagtttattcatccagccgcctatctgtatgagcattaggattattttcagtctcactgttacagatagtttttctttgtgcttacaccctgctatatattagccattctatctttgagattttctagaattaggattgctagatcaaagggtaaatgcgtatactattttgtaagatactgccaaattcttcttcaaagaaattgtaccattttgcagtaccaccaagaatagatgaatgcttgcttccccagagtctttctagcagagtatgtcaacaaacctttagatttttgtcatctaacctttagattttgtctgataggtaaggaggattatctgagcatagttttagttagcatttctcttataagcttttccatatgaataagagccatctggaacatagtatgtgtcagtaaaatattactaaactaataatattcctctatgatgttggaacaatttaaaatttgagataagcactaacattacatcaacaaaagtcaaggaaggagaggttttctaatgctcgctgaaacacaagaatatttgctttgactagatcagcaatgttaacatgtaagattggcttagctagtgaaagagaattatctgcttaataagaaggagagggaaaacgtattagcatttttttttctgctcaaaaagttagaagctgttagaggcatcttatctgaaaaagttaatacaagtagaaatgatgaacataactgaatttatcaaataccaaaatattagaatccagggtattccttgaggcttgaaggacgtgtacgttcatttatttagttattattttagttatcttttatggaatacttataattcataccaagcattatgttgtagccttttcaatagagtatgtatgtatccttaaatagactgccctcagtgaacaaagtcttaggagaaataacaaaagtataatgtagttcatggttagtaggcatgtaaagatcatcactctaagaggccaggaaaactgaaggaaaattctaaaaggactgtaatagaaatatggttttagtttaataagctatgtatacctatataatgtacgattatttaaccaataaaatgctttaaaggaatatttaataatatggactttaatatattcagattttaaagcaggtctaaagagtgggatttcatattgttctagattttaattatttgaaaggtaatttatcaaaacataaaggataattatctttaatgatagaattatgagttattttaatttctgtctgtgtacttatctgtagtttcagcatctgcaataaacataatgtagttagaaaaggaaacacaaggaaatgagaaacaagcagtaagaaatatgagcccagaataaaacaggggaggtcactggatatggctgacaaattcataattggttaaccttgaaataagtcattttatttaaagtatagactaaaattttactttaatttcagtcatttacaaaattcatttaaggttttattaaaaattttatctctgtcatagcttatcgtaaggggctattttgaacatttttgtctattttttatttaaaaaagaaaacagatacttttcatcctccattaaaagaaaaacaaagaaatatctgtattctttacatttttattttgttttcacttcaaatgcaatgctttaatatggatatctgcctttgtaataatttgatctctgttatatttcaactaggaatgttcagcttttacatgataactctgtctatatcataataacttacattacaaaagtgtttttgatttagtttgaaacactcatttcagatacagcctttttgaaattcaaagtactcagaagatttatttgcaaaggctatttcatgatgtaaggcctgcttgttgaacttcaagagtgacacccaagtgttggtaactacttaatgtattactcatgaaagagtttgcagtcccaagaaaatgcgaaataaaatcttgagtaaaataaatgatcagtgtctgaattagatattacagagtaagcatggtattgttaagtatgtcataaccagggctatcttcattgttttacttttacctaatgaaaaattatagctataggtgatgacatattcaatataggttgcggtcagaacatcctggacatccaaattaacagtgtgttgtctagtcccctgtattgtggcttaggttgttgactgccaataaataacactaagatttatgtaagttgacactatttgaaaacagacaagcagggacaacgatcattctgactgtgtgtgtgtgtacgtatgtatcagtagtatgtctctgcaaaattcttttcttcttttaaaacatttctcatttcagttaacacttagggcctcctattctgcaaggctcctaagttccaaagcatttcagctggtggcatctccccaggggccgttggttcttgggacccatggtagttggcgaacacctccaatgtatttgcagaggcgttttagggcactttccttgaaatggaaaggcttgggtttggctggaggttatgggtttaaaggcccttggtgaaaatcaaaggagagcatgagagcagatgttcgtgaaggccattatgtgccctgctgaggcattttcaccatttcctaaagcctatgtggaaacatttatcaattaagtaggggactgattttgtggcattgtagagaacagtatggtgtttgtcttagcagagaggtgaaaatgttaaaagatttgaggcaattgaagtaacacagctagctagggtggaaactgacaggggcctccaagggatattgagagatatttagaatatggactcttgaggacttgctgaaaaggcggggtcctcctaggtttgcctcccaggtttctacctggttgactatcattggaaattgtattaaccaggatataagagaaacagattggggcttagggagggagacaaggaattcagtttggggcattttgcatttgagtgcctggaacatgagagtaaggtatttagttaaaaagagaaaagcaggttagaactacagaaaaatcttcagtagggatgtcaatttgagtcacagaggtggttcttgtcattttaagtttaaatgagataactacaacttgtagcagtggtttgtaagcagtggtggtggtatttaccccctaaggatacttggaaatgcatttttggttgccccagtagacttggggggctctattgacattagtaggtgggggccagggtgccaggcatcctacacttagtaggacagtcccagataagcctgaattgtcccacccaaatgccactgaagccctttttgagatgcatggagtaaaaagaagacgaatgtcagaattttgacaaagaaacatttaaggagcctgtgggttggaacagaaatgagttaaataggataagaggaattgcacagtgtgcatggatcttaagtcctttggctgtaaagggtttgcctctcttattaacaccttcctgttactctgtctcttagtgccatggcctaacaattgtttgttttctaaccctccttaaaaggagtatttggggagttagaatcctactgattgtttttaccctgcctaagaagggtgacacactttccttttgcatggaatgattagagctaaattctttaaatttaggtagtacctagatgactttgggtcagtgtcagggaaaaaggctttgacttccaactctacttccttcctgtttaactgtaccaacttcttccctctgactcaaattcatgagcttttcctggtttcatgatctccttgtcttttaaggacctcggctatcttaaaagcctgatcatctcatgaaaaatggagtatttgatatcatctttcaattagaaatgaataggcttaattcataactaaacatcacacatagtatatactttgcatattttcatatttcctttgatttttttttggttcttcccctacaaaatctacaaaaatctatggttacttaggataatttatagataatccctgtgttaatataaaaagacctataaatgtgattaacttacaatgatttgcaacagaatatgatctaacaccaattgtttttaaatttaagatacatccctattaaaagactgatactattaggaaagaaaattgtcttttgtagaagactgaatgttaacccttctcccatatttagaaactctaaggtctaaataaggtcttttgtgttaaaaagttttctgcaaaatgaaaattagatgagtctttgctttgatgtttcataaaaagatgggtttttactctcaattctgagttttcattctaaatacctaggttatgttaacagtctttcatttaatttttttcaataacagagtgtgctgttattagtaccctataaaaatatgctactgaagacctttgcaaggtacttgtttctctttttccaattacaaagttaaaacattggtattctttggaaagccatttaaaactaaaactatgcttgtcttcaatttctgcagagtaaagtaaaaatatccatcaatgtgcttttgtgtcctgaggaactgaatttgttcccaacatataatgagcagtgaatgccaaattctctggtttctgctttgtgtagcagagtaaattacaataatagtaaacatacaaaatagtacttaccccgcacttgcttctccagaagttttttccctaattttaatcaaactctattaaaattgaaatgtcatatgacattaaaaactaccttacatgcacttgctttaatattattttatgaaatgagttcatattaccaaaaaatgacaatttatgtaaataatagtatagcatatctgcattatgaaatacgtttctatttggtaattaaaattctaaactttaatgcataagcaaataacagtaaaccttcaaaagtcttttatagtatgaatattaaaattttaactttcctgactaattcttaaagctaaattttaaaggaaaaacacattaaatttaactaggccagagaatatggaacattttaagttgtagaacctgtttaatttttgccctgaagtaatggctgttgctatttttgttagcaaatgttattttcttactccatatatactcaagataaacttaccccagagtctttggtaaacaaagccattaccttattttcctgaatataacagagaaactttattctttctaaaatcaatttcttcaactgacagttgaaagacagtgacattcagaagccactctttatgtcactttttgactgtttctctatcctgagattaatgacaaagaagtttatttgaaattcacccgaagtattttcacaatacttcaaagtaagtctacgtgagtattctagtccatgttgttcagctcttatcaacaaccagtgtctggagtaatagtaaaagaaataggtagttgtttaggtattatttcaataaagaaagaaaaactagtgatgttttaatagatgcagtcctttggataagacctcaggaaagcagtgtgggatctgaagtctttgtacaattgaacaggaggccagttaaagatgactgattagagacatgcactgtattcattctcttctaaaaatcccagtaaaaatgatgggaaggtcaatacacaaggaaaaagaaaataagaatgagacaacagctacaatattttggaacctgaaaaacctgagatggttgtccagtaatgcaggaaagtttaaatctagactggtagtgaggaaaaccaaggatcaaccagattgaaatcccagaacctctgaaaggtggtgcattgattgattgattgattggttcttccttcacaaatctatggttacttggagtaatttatagataattgctgtgttaatagaaaaagacctataagtatgattaacttaattaatttggtctaggactaggttaaaggtaattcctaggtgcaggaattgatgatgaagttgggtaaaggtgtgactaaaactgcaagtttcatgcaaatctgtttgagaagtagtcagatcctagatcccctctttggctctacccagcaagatgatgaccctctttaccccagcagcagggcagcattggtgaatactggaccaggagacccaggaccacataagaaggggactgttgtacaggaaacgaaggtatagtggcagttggcacccacagccttctgcgctactctccttttggaatgctggtagccaggtttgtgtgtgtgtgtgtgtgtgtgtgtgtgtgtgtgtgtgtgtgtgtacactttgtcccttttctgtcaaatagtgattggcatagtataggttaagtaacattttatcatctttgttaatggatttatgttcaaatacattattattaacatcattattaggttttgcaggaaacaataagttgagtattacagcagaaatataaaaagcctcaagaaatatccattttagtaacatgttaggcaagtacttgttgactttaaatcttaagtttctttctcatttaataaggatgatagtatacttaaccttataagattgttttgaggattaaatgatatacataaaatgcttagcataacactagacaagttctttagtagcaattattttgttgatgttattactaaatgatttttatcatctatgtctggtattctgaaatgtctctggattttgtatttgttgacttttgtaaatatatgcctctgccagcattggtctaggactaaattaaagaataggtcttgttttatgcagcatctagtgcaatggtttgcatgagtttatttttaaaggtagttgtggcacaatattacattttagcaatcatctttattttgacattgagtgaatcaaagtaaatagattcttccataatcataaagaattaattgtgacctagattaggactaaaacctgagctattttttccaaccagcctggtgttttctttgtgagtggtagattccttgaatcagtgcttcagagcaggccctggcatgcttcagctgccaattagaccattctcctggtcactttttgcaggcatttggacccattatgttctttttgcattgcctttacaaattctaagtctgtggattctgagttgtcacatggagatttaaacttggataatgagcctggttgggacagactaaagtgttacctacttagtcattagctgttatcaatcttaaactagggtagaattttgtggaaaaagaaacaatgactggggtttggttgcagtgtttcatctgcattgcatttatagctgtggattttgaaccattacatggatttttgactctgccagttgtgagtaaaacaagcaggaccacacagtttttctggctgatggaaaagattttaatttaaactttgtattctagccaagttaaagctagcacttgatttaagtggaagggagatggttgatgaattaagtttcaaaagcagactttttaaagccttctaattgcttatcataggatgttgcctctaattgctgtgcattaattattagcatctgggcatcaattttgtgtttctccaaaaacttttcttatttcatctgatttaatccttaatagcatgctgtgaagtatgccaaatccttgagtaatgttgttttgctataatgttgatgaggggaaaaatggattcccagccagggccattgcatgtgtggagtttgcatgttctcccggtgtctgcgtgggttttctccaggtagtcaggtttccttccacctcccaaagatgtgcacattaggtgaattggcgtgtctgtggccccagtctgaatgaatgtgggtgtgtgagagtgcactgtgatggaagggtgtcctgtccagggttgacacttacctcgccccctgagctgccgagataggctctggccaggtgtgaccctgaactggaataagatgcttgggaaaggaatgaatgaatgaatgcaaatgattatgaaatataaatttgtattatatatgataatcatacaaatgcactataataaacgatgcttttagaaagcgctcattgagccgccgtatttgtgattgtttttgaaccgcatgatggtaggaggtgctccttccaattttcactttgcaaacatttataccttgatttaacccactgctgtcactcactgattcaccaaaaattgggtaaataattgtcttacttgtttttacttctctttcttaaatgtatatctagcttacatttatttcagtgtttaatattagaagtgttttgagtgtttatttagaagtttggtgattttctttttgaccagaaatatcctgtaggaacttaacttttgtttatatcaatgagcctttggtaaaattagtttagttatacatcatttcacttagagtcacagcccccaaaacctatcaacaacattgtgtggacttactgtactaccatttcccttttgtgggtaaggagactgaggcccaaattagttacgtggatttgtttaaagtcattcacctaactggaattgtacctagtgagttttttgattcttcataatgtattggcatagactgtttgttcaaaaatacatatatattgtaagtgcagttaagggttcagtctacagaactaaattttaatttaaattttaatctgccagggattacacatctggaaaattatttgaacttgctcctgttggtgtacatcacccatggagctagtcagacggagtgatgagatttttatctcatatttgaatgtctttgacctcttagaatatggagacttaaaagcaaagagcatcttgttttctgtggcacagctctgtggcacatcataaaggtcattgtcttattttctcatggacattgttcccgaagtgaagaatattgtccatatctttagcataagcagtctgtgaatgtgtcccaatggtttggcattgcagtattctctagaaataacctaattgattataaaagtatcccataatctgaagtgtgtggagtttgtatttattaacttttgcatgtatgctgtctatgtactttcctcagattaaaaaaatacccaaataacatacactaccctccttaaactactttacagtgatttgaggaagaaaagaaaatgtatgtttggaaagtgccaacttaattcaggttgtaattttctgctttttggtctaaaaaatctgttttcaaaataaacttttgtagaaaatgattttgcaagtctttttttaggacttaaagaatttcttatatcttaggtgctgatataaatactgagcaacctcacagcaaaatattttaattttttagagtatcaactttatgtaaaaaagctgtgaaaatatgatttttaaaaaaaattttgaaatcacctatatgctaagaagaaggtgaagactgttttagtattaattcagtatattattaccattctctaattgttttaaggatgtggattaaatcatgtaagccttgttttttaattttaaaaatatatttataaaaaatatcctgaggaacatatgatgaatggtatttgttaaagaacttaatagatactttatacagtgtttcctttggatttcaaaaaggtttcgggaaatgacttggactttgaaaaaaattttggtggaaaggttccatagaaatgtcaagattggctaagattgaccttgtcacttgtgggggattcaaacaaaggtccctttgtaacaagaaaaactgtctctgtattgggagttcattggaatttcttttctagcagagaagagtaatacgaatgaccagaacagggcacaataggaatgtttgtgttcatctgctgaagttgtcctgtgatgtagcttctacttcttattctcttgagtcttgtatatatttgatacacactacttagttataaatatttaggtgtacatttgtgaatgtttttagatagctctgaaaaaatctgctgtgaataagatgctttccaagaaatcctcagcaagcgttcttacaagttgagattttacttgaaggcattcagttgaaaagaaagctggagtgattaagttatgaaattattctcttggatttatctaagtggcattaaggatttttaggaagactggtttaaaaaatgtatgtcacaggtatagatttaattattttatctttgatttttggaggatctcatatggtcgtttgagaatctgtgtttttcaggttttaaaaatattaaatatgggaggagtttggtttacctcacttatgcttatgccattcctaggggtcactgtatgcctcctgttttgaaccttgacttattttttaatcctttttcttttttcagtcttcctggccaatacccagtttactttcacaaagctgcttttgtgattgtaatataattttatttgtccagaatattattttaccactgttttaataaatttagagatcaggatatcattttattaatatttcagagagagagacactaagtgattttctgttacttatggagtaccttttccaacttagaatggggaaaacagtataattatttagaactaagatacgttttctctgcatgctgttgaataaagcatatttttccggactctttgaagaccccaatatttggaaactcaggtgttcaaactggagaaacttgcctgcctttatctattttattccagactttcctggcatgaactaattaccaactttgaatactagtttttattgatcacatttctttttcctgagacctgcataaggaatgttaatctcatccttagacagatcactttgtccctctgcatgtcagctgctaaatgaactttccatcagcatggaactaatgtttatcggaataactaaataatctaaaaccagggccctaaggtttcacttgctgtgagtctgttatcaccagctcacactggagaattctttttcgtaccattgctttttctaaacaataatttctatccatggtatgtggatttggaagttagtcttttagagacttagctttgcagacattaccttaggctcagaagtctgacttaaatcagggtctggatgtagtgaaagcctcctggggatggtttgaaaaaatctagctgtacatgttgctacagtatttatttatatctatttttattttttatttttgagacagagtctcgctctattgcccaggctggagtacagtggcgtgatcttggctcactgcagcctctgccttccatgttcaagcgattctcctgcctcagtaggagaatctactactcctactgggactacaggcacatgccaccatgcctggctaattttttgtatttttagtagagacggggtttcaccatgttagccagaatggtctcgatctcctgacctcatgatccgcccgccttggcctcccaaaatgctgggattacaggcatgagccactgtgcccagccagtatttatttttaatgtgggaaagagttgctagaggtagcaaacatatgaataacctgaggataggaaggtaacgtatgaaaatggttttctgagagggaacgttcatgctctgaaaaacagatggagcagaaagctttataaagaagctgccttttcctttcctctggaattgttgaacaacatctttgagggaaacatgacataatattttgataattttagtgagtgtatgtatttgagcaaggctggtattgagttgtaggctgtttggcatggtaaaagtttgaattctccagagctgcttttaatccatttgcaatgcctgtgttttttcttgtgagcagtgtgtatcctcatcaggggctgcctcaatgcttatccatctggaggaggctactcagctttaattaaagaaacagtggttgagagggtccgcctacaaccactgaaagtaataaatgtacatggtgtaaaattcaaatactgccaaaaagtatgcactgagaaacaagtccccctgtatgactggtttggggcgtagcttccagagatactctctgcacatacaagtacagtttttttaatacgatgattgcctaccatacacactgtatgcaccagtacctatttacttttagtccatcaaacagccagagtcttaagaataacaccgagtataattttttaaaatctttgtatgctccccaaataagcccaagttttctttatgtagtttcttctacttaggaactttaaatgaataggtccacatgagttatggactttattgtgaaaatagtcattgctctgaatatgggattcttattgagcattacatctgattccttgataaaatattttaggatgagagcacctactgtgtaccaggcactgtgctaggcattggaaatgtaacagtaagcttgacaagcgaggtccttgtccttgagacctggtgggataaacacacacagaacagatgcctgagaaacagagtattccttaaagtaggaccttggcctggatgggggaactgaggaagtgacctttccttaccgctcaatcttctttcctttcctcctttgtcaaattaatctcattagattaatagtctttatcagatgttttaattcaaatataattcagtctagtctctagatatagaaatgccatactagtcacatgttaattgttttatatttgcaagtaacttcattaaatgggcacctgggatgtatggaacagcttaataaaccaacatttctgcactgtagttaaattgatcctttagctacaatatgaaaatttttatttaaagaaaaacagagcctggattatgtcacagtgcaaaatacgaaacatatttctagtttgaatgcataattcttggatttccctgcctctgaatgatttctaaatctggaagatttggatcctgtcaatttatttagcttacggaaaagtcatctgatctatacttcaggttcattagaaactccttttacatcatgtccttaggtaacagttttatgaaaatttctgtaactcatgattgcagttttgttcttacaatctccaggtattttatttaaaaataagaaataaaattgtacaacctatcaactgtgtgatcattagcttgattaagatatagctcacctgctgttaatttatttatcttagtaagccatgtggtgtgcatgagcttattttactctttcactttgttctgtgattaataaactacttccatggaattttgggattgagtttagaggccatatatcccattctgtaatttacagatagtatcccagatctcacagctaattagaattagagctaaggctagaactcaggacttctgacccattttataggaaagggtggttcactgtgtttttagtatgttatatatttacgtggcttaaaagtccaaagaggctgtacacgttggctcacgtctataatcccagcactttggaaggtgggggtgggtggattgcttgagctttggagtttgagaccagcctgggcaacatggcgaaaccctgtctctacaaagtatacaaaaattagccaggcgtggtggcacatgcctgtagtcccacctacttgggaggctgaggtgggaggatcacttgagcccaggaggcagaagttgcagtgaaccgagatcactccactgcactccatcctaggtgacagagactctctgtgtcttaaaaaacaaaaacaaaaacagaaaaacccaaaaatggccaaagattatcaaatagcatctgtttatatactgagaagcccagacgcgttgactctgttacccttcaccttctgttgatgtattatattagttgtcttgtttatcctcctagcatttccttatgtagatacaggcaaataaaaatggtttcttattgtcccacttttctttaaaaacagcgtgctgactgtatatgcgattctgccacttttttttttctctcaagaaagtttaaatttaagctcctgaaaaaagtcagtgtgcctacagataccactttattttgtccacttagatcagaactaggttgctatctttagcttaattctagcatatgagaaatgtgagatagttctatgaagactgtagtgaaaaaaaaaagattagaaatgtaaagtacaaggtgggaaattattgaaattgctattatttaacccaaagaagaaaaagtttgggcattattactttatagatgaggaaaggggaggctcagatggaggtaaagtaccttacccacagtcacccaagcactcggagtctcaatgggggcctgcactcagattagcctgccagtattgaagtctcaattcctcatctgctacaggagcctgatacatttgtgagtgacaagtatagtcgatactcattatttgcggattccatatttgcaaatttacctatttgctaaaatttatttttaacccaaaatcaatacttgtggttttatggtcattcacagtcatgcaagcagagcagcaaaaaaaaaaatgtgtttcctgacacgcgtgtttccagctgaggttgaacaaggcagtctctgccttttcttatactataaacaagtgtccttctgatggtcgattaagtgccacagttttttgtatttttgtgctttttgttgatcattttgctgtttaaagtgatcccaaagcatcgtgcaaaactgtttagtgtttacaagaaggctgtggtgtcttacagagaaaatgtgtgtttaaggtaagctcatagtgctattgtaagttagagttctagtgctgtactgctgttggcgtgagttcaatattaacaaatcaacaatatgtcatagttttgtgactgcagtgatagtgccattggcgtgagttcattgttagtgaatcaacactgtatacattaaataaggtgtttttaaactgaaacactcagaaaacaaagttatgtattgatcagttgatgaaattattgtgaccagaggcttgtaggaacccacactgtgtttccactagttcagtattccagtaattcaatgttcacagcaacttcatggaacataacttctgggaataatgagaacagatagtaaatgcaaagccagaagtagtcagcttcctgccagttctagctatgttttatttcttttcattctaccctaaggtacaggaggaataatttagtttagctataagaaaaaaaaaaacaactagctgggcgtggtggctcatgcctgtaatctcagcactttgcgaggccaaggtgggtgaattgcttgagcccaggagttcaagaccagcctgggcgacagagtgaaaccccatctctacaaaaaatacaaaaattaacctggtgtgatggtgcattcctgtagtcccagctactcaggagctgaggtgggaggactgcctgaaaccgggagaggtctaggctgcagtgagctatgattgtgccactgcactccagcctgtgacagagtgagagcctgtctcaaaagaaaaagaaaagaaaagaaaaaacaaacaaacccatgacttcctattgagataactcaggactatgaaatacaaggttaaattgcttattataaaacatcataacaattgagacattttgaaagttgctgacagtggtgttactgatagtatagcatggtgactaagagtgtcatcagtccacctggattccattcccttctgtaccatttgtcctgtgtgaccttgagcaaaatacctaacatctttgtgcttcagcagtcatgtgtgtaaaatggagatgataccactaactacttctttgggttattatggaagttaaacgaatcagtcagtcagtctatggaaagccattagactagctcctggtatacagttagtgctttttaaatgattagagtaattgcatctcctcatttgcccaggataattttagttgtgattagctgcccctttcattctcaaaagatatcccaatttggaggataaattgtatggtcaccctctaatgtaaggatgattcataattatcagctaatactgaattattggctatttctgtaaatacctgttgggacgattgatttctttttcttcttcaagaagtaagttgaaaaactccctcctcctggttttggagggctgcttggagaagagaaatgggagaggaacaggttgagtattcacatgtggcataattgtgtgttgtttccttattttgtgtttttgctcagtgaaagaaagtggtctagaatctggttctggcatagagagattatatctttcccactggacagctctttctctagtagccaggaaagacttgtgggaaatatagtttatattttagaacagttttaggttataggaaaattgagcagcaagtacagagttcttatataccccctgatgctgctcccaccccacacagcttctaccctactatcaacatcccacatcagaatggtacatttgttgtaattgatgaagctacattgacacatcactatcacctaaagtacataatttacattacggtttgctcttgatgttctacactctatgggatggataaatgtataatggcatgtgttcatcattattagtatcatacagaatagtttcactgctctaaatatcctctgtgttccacctgttcatccctccctctccttaagcccctgacaaccagtgatcttttttattatttctatagttttgccttttctaatgctgttgagttttgcagtagttatttgtcccttgtcccacatagtcttttgagatggctatgagacataagaggcactattgaacaggcaggcaagcaggtttggatttgggccatttgaaggctggagacatatttgggagtggttagcatgtagatggaatttcaagcaatggtgctgaaagagattattggagaaagactagagatagagaagttaaagctgagcaccaagccctgagaccttccaacactaagatattgagaagttgggggtgggggaggactggccaagaatgctgagaaggagatgccagtgggagtagaaggaaaccccggattatgtgtgctctagaaggcaagcaggatgtaattttttttcttcttcttccatatttataaaggaagaatcaacataccttaagaatggtttcaatctcttgtggcattcttttgaggatcagtattttgtgccatgtcaatgagatacagagttgtagacaggaaaggctctgcgcaagaagcaggtgcgaccggctcattcagggtgtcatcagtgtaaaaaggatacacttttggaactctggagtcatggcatggcccctgtgccttccagaagattattggagtaatcagcatcacttccaaagaagtgaaaagtgaaggggaggtagagcacttcagtaaatgcagtagatgctgttgaagtttcacagtagctgtggaatgtggatgagtcttctgctttcatttgttttcagaatgtggaaagcacaggttgtgtttaaagacaggccagcctaggcagagcctgccatggccaggcaccatggtgcacacctgtaatcccagcactttgggaggacaaggcaggtggattgcttgaggccagtagttcaagaccagcctggccaatatggcaaaccccatctttactaaaaataaaaaagttagctgggcgtggtggtgtgtgcctgtagtcccagctactctgtaggctgagacatgagaattgcttgaacccaggaggtagaggttgcagtgagccgagatcacatgagtgcactctagcctgggcaacagagcaagactctgtctcaaaagaacaaaaccaaaaacaaaagcaaaggaagagccagccatatagaacagatacattcattctaaggggaacatgttcatcctcaatatgtttcttcttataaaataaacatccaagggtttttttgggtcatttgtagtgatttgatttccaaaaataattagctttataaacataaattgcataagtaatgtccccattttataactctaagttgtcattatggaagggataggctgtgctgtaaaattgttgactttgaagtaaaatgcttattaaggatcatgagtaccaattttcacatatgtcgtagcctatgttgtagccaaagtcgacatttgagaaatggttaaggttttacagcaacgtttactttattatcagaatatagtatattcagtcaagtactattaataccatttcatatcgtaattatgccatttcaagggaatttattagaaaggtttacatggattcttctttgcattaccctccactcctgccacccccccaccccacctgcagccatccacgtaaaaattcattatgttactgccttggatttttgccaatatagaataaataattggatttagcttctgttacagttttgtctgtctcagattatgaatgtaagttggtaagattttctgccaattttaattcaccaagattgcattaaaattatgaagagacaattgaatgtaatttttctttcctttactcctgtaattgaactgtaaaagttctcaattaattacagttcttacagagtatcaattattgcaatttgcaaactccagagcctttataatgaaagataaacattttacaaccatacatttgtcaacgtttgatgctaattgcagcaattaattcgttctttaatgtttaatgttttataggttaatgaaagctggcattctcttccctctttatgttaatatgagaaacttttcaggagtagggtacagattgatacatgtataaaactatttttgcaatctattgcttgtcttagcaactaaatgaaaaccagaggttgcagaggtttgcttattcttttctctgcatatgtagagtggaggcctgcaggttcctgacaaacaagagcagaagtttaatgagtccctaaaaactcagtttgtttctaaataaaacataaatttggagagttgaaatgagtgatttcagaaacctttttggcttgggtgaaaattagcatcttctcaagtatttcttaaatgccttgtcatttgaagatgataatagtatctatgaccatttattcagcccagtgtgctgagtactgtggtaagttcttttagtactttatgttatttaatccagaattcagacaagatctgactccagagctctctctacagggagacaagttcaaatacctgccctggcagccaggccatatagcttagtaaagtaggatgggtgtgagatgggtctgagtagtgggatcaccataaactgggctgtgagtacagcgccagtcattccagccatggtggaatgtaagctcagtgttgccagatctactgatgtttcagaaaaagtgggaaatctagatgtgtgggtgcacttccttaatttttaaatgtttggagctaatttaggtttttaaaatacatgtgtagggcagtttcaacccaccagccatccatttgagagctccgaagcacactgtgttggcttgatcttttggtctgaattagcttgatacaatggctggggcttgtgcctatgcatcaggtggcactcttgaagttcctcagagagcctctctacaaattcagcaggggttggagggaagaagggaaaatatatcttaatgaattatattaataaatactaatatgtaatttgaggcattgaggaaatacaattatataactttcagtgataaagcatgctgatctttccttcattttccttcctgttacagttaattgggcaatcagttaaataatatgcctttgtcagattttttatattagagcacctaaaggatcaggtagatttcttttttatagtattaacacagaagtaaaaacaaagtagcctttctttaaaagaatgaggaaatgtatacatacatatacatactcatttttttttctgaattaaaaaatagttaagaaatttgagttggcttggcaaagaaaactgagaaaatgcttaaaattagaaaatatatagacatatactttttataaacattgcaaagaaaaatgatggagactatttttatgttcaatctctaactgtcctaggcatagtgtaagtgccctccgcatgcaagtcatgatttactgtgaatgggtctcctgtatatactgctttcagcctgtatgttttttaaaaaattgaatttaccattctgtgtcataagactagagggtaaagttcagattttgaaagtctaagaaaatgtgatggcatcccattcatcttgtattaaaggttctataaaccgtaatggttagatctttgacctctgttcctacacctgcagctagtcctaaatcaaagtgtttaagcctgacatgggctgtacctgtaactcagtgtggaagctgcatattgtaggctatttctactgttggagagggagggcgggcattgtggtaactctttttaccttttcatatgttcattaactttccaaggaaatgaaatgcttccctcttctttttctacggttaaatttcaagctagtgttaaaaaaaaaagtgcaaggaattaatgtaccaaaccctggagatgtgtaaaagaaaaacctttaaaattgtattttcaaaaatcttgagtccttttaacattcctatagataatttagtaaagataaatcatacttactttttcatgaagctaattgcctctggtttgtatcccctgagaaatactaatttacaaattagaacctacaaatgatttttgtttcaaagaccacttttgtttcagagaccactttccagggaacaattctcaataacggaaggagggtgttttagttcccccttcaaaggaaggtattggcactgtatgttttgttttgttttgttttgttttacaaagaagccagatggtatttattttgcatagctgtaataagttctaaggaaagcacttggaaatggtactaatgtttaatggaaagatgtataaacccacttgggaactgtaaagcattatgcaaggtatagtttagctatttaatataataacaggtaatcattctgtgctggctttgttattagcacaggtgccagggcattttggggctctgacattttatagaaaccagagtagctgctgacaactcaaacagtattgttaccgtggcagggcctggatcccacagtctagctatccagtggtgcctaccttctgttctgcaggtatatctttctccatcccttttaaaccggagactatcaccctgtgaaaggatcacagtgcagccttcccctgagtaaatgacaaataggcagtttctttagtatttttcacattcctgcacctggctgggagccagctctgcttttgtggcagaaagtgaggctggagagaatgtttgggagccaatctttggtagggaagtgacaaaatgcaagggtatatgtatatgggccaaagttaagataaacttttttttggtagttttcactgtaattattaagaggcaattaaaaaaaagaggtaacactagaaaatgacaaactcccagaaggtgtgattacttacaaatcagctgctctgggtcctggtgagtgacatagtcctggtgatcagtgtcagcatccttcacaagcaatgaaaggagagttcgcaatgacgctgcttcacaggatgtagatgggtccaggcatttaggctggctgagaggcataaagtggctgagatttggttgggaagaaccaagatgaggcgtgcctctgtgtgctttacgtagacggtgttgtatggttagaagccagtagttagaaattcggtttgaaaagccgggtctgatgtttcagagaaaaagggtaatgcggccagagacgtttttagaagcagattttggtagattctttttaccttttaaaaaaatacatatatatatctttttatgagatgaggttttcctacattgcccaggctagtctcgaactcctgggcttaaacaatcctcttgcctcagtctcctgaatagctaaaattataggcatacacctctgtgcctggcttggtagagtctctaaaaggggattgatgcaagaataaaagggagaagagtaaataccataaaaagcccattgcagaaggtgtgtgtttcaaagccagggtagagaaataagtaagggatgcatgtataaaacagaacaacattggtgaaatgtgactgtttatggtttacaaattactgattggcagcaggaaacatagatttaagaatatacatgctacagaaatttccctaaagaagtaacgtattttataattctaaatttactgttattaaagttagaggctgccagcagcttggttatggtcaaatgccaggtaagattttgggatatgaaacatttgacccttctgaactaagttcacatgcattggacctctccgaaagccttgtaagagggtataaaagcaaacttcccttagcttcctacaagtgaaaccattatttcctcttaccagggtaccttgcatggtgattaggcagaaggataagagttgtgatgtgttaaaggctgtgcaggactggctttagtgtggacataactgtctctaattccctggtgtgactggggtgggggacatgttggctgaattccctctcactgaccctacaaatacaaagatgcttaacattccacatctctcagccatttggatctatagagtggtttcggattgtgttccatcaggcctggaattccctgaaggcactttagggtctgccaatttgggtgtcagggaagcaaataactgggccctgggcctcctgaccctgctacaagcagaacagctctcttttattgtggaagtcttgggacttttcataagattcacttgaaaagggatgaaacacatacaaaatccactatctggggaagcaggaaaagagagcattctgtatgtgaacaaaactagctgatacaagccccggccctccatccatttctctagctgctgcacttattaaaagggctttattggccaggtacagtggctcacacctgtaacaatcccagcactttgggaggccgaggcaggcagatcacgagatgtggagttcgagaccagcctggccaacctggtgaacccctgtctctcctaagaatacaaaaattagcctggcatggtggtgggcgcctgtaatcccagctactcgggaggctgaggcaagagaatcgcttgaacccgggaggtggaggttgcagtgagctgagaccatgccactgcactccagcctggttgatagagtgagactccatcttaaaaaacaataaataaataaataaaaataaaagctttattgagatcacaattcatatgccatacaaataacccattaaaattgtataatttagtgatttttagtatagtcatagattgtgcaaccatcaccagagttttacgatttcatcacctcaaaaagaaatgccctacccattagcgctcactccgcatttccccccacacttccccagctctaggctgccaccagtctactttctgtttctatagatttgactgttctggagatttcatatgaatagaaaatataaaatgtggtctttgatgactgctttcttttacctagcataaagttttcaaggtttatccatattgtaatgtgtaagtaagtacctttcattgctgaataatatgttattgtgtgaatataccacattttatttatccattcattaattgatggatattgggttcttttttattttaaattatgctgctatgaacatttgtgttgaagtttttgtgctttcgatttttatttccctcgggtatatacttaggagtggaattgaagggtcatatggaaactatgtttaacattttgaagaactgccggcctcttcttaagtggatatgtgtagacttgcagctggcctctttaccacctttgcacctcagttcagctttttccagccctacaccctgcccttcaccctgctccctccagggttactttcctaaaataccagaaaccctagtggttctcttgttactttgaaacaaattgaaactctctaatagggcatttcgagttctacatggtctaggcccaggctatgtttataatttcatttaatagtaatttccaagttcttgcgtagatgtttcattatacaagcactagatgtttcattatacaagtcagtgattattgaacttccttttagttatggacccctttgaaaatcatccaatagccatacgtttcttgcttcctcaaaaaaaaatatgcatgtataattgtactgacaacaacaaacctggcatgcaagttcagagagtttgtgattgctctggcaccattagcaaaccatgaagttcaccaacacattggctgggcacaatctgagtgttctttgttcaaactactctctcacctctcttctcccttttctccttcctgctgattgcctaatgagaagctttcttgctttttagagtatctttcagagaatctgctggaaaggaaggtggtttggctcctttttccaccattgctgctccacagttgtgtgtgcagtcctgcagcagggccttgagggaattgaacagagagggctagcctctctgagaactagatggtgagtgccatgaagacagagacttttgttggaattgtcctgggctgtgtattttatgtgtctagaatagagcctggcacatagtaggcattcactaagtagtcactgaaagaatgggtagggaagggaattgaatctggaaccatcagctttctgggatggatgaagctatatatagtagggcccatgagttacaagggacccgtatgcagatactggatgttggttactgggaatggaacaagaggttagaagagagtttctaagacagattaagaggatgtattagttttctattgctgctataacaaattacaacaaacttagtggtttaaaacaacacaaatttattctttttcaattctgaaggtgggaagtctgaaatcaatttcactgggctaaagtcatggtgtcactaggctgtttccttctggaggctgtaggggagaatccgttttcttgcctttttcagcttctagaagtcacttttgtatcgtggcttatgaatttttctgtcttcaaagcctactgtgtaccatcttctctgatttctacttctcttctgactcttatcctcctgcctccctctcttataaggacctctgtgattactttaagcccacctggataatccaggatgattttcccatctcagtatcattaattacttctataaaatcacttttaccatgtaagataacatattcacaggacatggacatttttgagatgatggacattaataatggacatgtacatggccatcatttagcctgccacagggggctctaaaaataaacatggcgccctttgtgtttttgccaagtgtgtctgttccttgctcagggcttcttaattgtgacatgacttcttcctcacaatgattacgctaaggccaaggacagtgtttgcatgtaaagaaatgttccaccacttctcagttgctgagaactgttagttttccctggttcatttctctcccacatgtaactcactggggaggtaccaacacaaaggacttaaaaaggtctgtgctgcatcctcctctaattttgtcattggtaagtacctactaaaacagtagctatcagaatgggaatgagaactaccagagcatttttgtttagaactcttttttcccctcacatcccaaaccacttttaatttcttatcctcttattatcaatccagagataaaatttcagaagaaaaggctaaaatagaatatgagaagacatatagtctgctgaaaaggaagtctcttgagacctttaccagatcaggatgtaggtaggatattttctgattgagaagcaactgtcctatatttgtgtcgaatcaacacatttcctatcactgttagtctctggtgaaggattcatcgatgagcttcatcttcctcagcactgattttgatgtattgttaatggctgcctggagtgcaaactctgcatgtaggcagagtgccagacagttactgatgcctgccatgggttagtggcggtgcgcttgccatgcttttattctccctgatccagtatgtcaaaagaaactgacttcaaccttcagtgtcaatgtgaccaccaaaaaaattccaaataaagcagccccaaatcttacttaccggcagcagaatataaattcattttggtagagtacagaatgttctgtattaggaaagtatttccagcagcacatacttcgctgccacttatctggaatatttctttgtttagggaagatattttattatataacaacaacttagacatgtgaaatctgcctggtatgttacaagtctccagcctaagtgaatatgaccttctctggtaggatactgcagccatttagattgacagctcatttaagtgagggagacgtccaagaatgatttcagtttgctttaggcagatggatattaatgaagaaaaagtaccttgaaaggatgccattctgaggagggcaccggacagcggcattgattataaccagagctcctttttttctgtgtttccagagctagagtgctgagtgctgcgctgcttagtctctctgtcatccttctgaattggataggggaggggctggtctggcaggtttttcagaaaatgcagctggcattgaagaaactcagattggactgggtctctctttagtaatcctaattgaagaattgtaaagacttgtgctgggagtttgtgtcttcattggtggcccttcctgtacctagcacagttctgggaagccaacttgtggtcaattaaatatatgttgacttatcagtgataaaagcaaggtagagactgacccaatttgtgggcattactttcttagtaaaataataatagaacgaaattcttttacatgtttcacctttatcattttttatttaaaacaataaatttcatttgtttatgtattcactgatcaaatatttgactgtctcctatattccaggtactatggccaagtctgggtgggtgggtggttgggtgtgtgtgtgtgtatatatacacacacaatatatatatacacacacactatatatatatataaatatagtagtgaacacaacagacatggccccatcctctaaaccttgctaagagagacaaaagtaaacaaaaattataaaagaattaattgccatcatagtaggtacactgaagaaaatatatggggatttatgaagtcatagaacaagagaacttagcctatcccagcaggttcagggaaagcttcctggaatagatgaaatttaatctgatgcatgaaggatgagtgggattcatgagggaaaaaggggagcgagaataggagggccaaaatgaataacccccagagggcttcacagggcacctgtaaaccaatatttgatcacactgtgtcaaccaggaccagagcacattgctggctgtgattttcctgattatctttcttggaggctgaacctgatatggttgctgacccttctgttgtctgcacattttgtcatggcgtggatcttactgtgaacatctgcactacgttgatttgtgtaatttatttgctgagaccattcaacattaatcttggaaaatgatctttttctttgcagttccagctgctactcttcttgctggatgtcttagttgagggttggccagtagtaacaggtgggcaagatcagctcaccgctgagagctgaggcagcaggtgttttggttcaagcacagggtctggctctggtttcaaatgaagttgtgacttaagcactctttgccttggttttcttatctataaaatgggtataatgaccatctcataaagcaggcttgctgttggttttgttttttcctcaaaaatgtagtgccacatttaagatcatcacataataaagcaaccacaaaagacctaaaaaaaatccctgcagttttaaaaaacgttagaagaaaggttactagaccataagcaagctccacatcaggctcttttttcaaacatgggttttagctgaatcatcttgaacctcctgggaggtggaccttatatgtttggtaggaccattatctgcacagctgaggagctcaccttggcagactacaatcatttaaagcactcatttgaagtatgggtgtgattttgcttgtgatggtgagttaacagccaaacagggctaacttgtgtttctggttaggagggaatgtttctaggcagcttttcctggtccacagaaggtttctctttagtggtgagattggaaatgctttacagggaaaaaaaagataaaggttgtgtaacatgattggttataaaacatgaacatcttggtaatactacaaagaggaaataagtggaagtattatccccgaaaaaaattcatagaacttaaatacgtatttccattaaaaagttgtcctcctcgtaagccaaattatttcattcaagtttcatccagggaaccagaatacttttacttttgcttcagatttgatttgattcaccggcattcttggttcccgaaatcatacctcattttttagaaatactttcttgatctttttgtagctaactcacttagtaaagtatgcaaattttccaaaataactaatagatcatttaacatagaaagctttaaattatgtcttaattatgtcaatgtaaaaataaaaggtgggtggtttggtttatattgaagtaagtagcataaacagaaatttaattagtaccttatttttaatatcgtactttggcaaacctttcacagtgataaatgaaattttccttttcattgggaaaagccaagttactgttgtttttggttatatagttgcattccttcaggctggtaacagtgtaagctaaagacaaattgtaagagctacttgcctcaagatatttatatcctagaattataacggccttatggtttcttcttttttcaattttctttctttttttttttttgagacggagtctcgctctgtcgcccaggctagagtgcagtggcgcaatctcggctcactgcaagctccacctcctgggttcacgccattctcctgccgcagcctcccgagtagctgggactacaggcgtctgccaccacccccggctaattttttgtattttaagtagagatgaggtttcactgtgttagccaggatggtctcgatctcctgaccttgtgatccacctacctcggcctcccaaagtgctgggattacaggcgtgagccaccgtgcccggcctttcaattttctttaaacaattttctttacatttgcattacaaaacagttggagttaaatgacaaatatttcacatttctatgaaaaacagctagaaatcaaatagtcttaactatatagtacctagaattccagttcctctgaattttcacagatgtgtatttttagctgtccattagacatctccaaggcaaaattaaatggagctcttcctgctgcttctccctgttcctaaatctctgtcttcattaatggtttaagaacccactttattgaccgggtggaaaccttgaccagaaatctcagcatcttccttgacttcccatctaatgcgtttcttgagtctattaattttatctccagattgttaccctatgctgggtcctcttgatttcccactaccaggctttattgtcagcttgcccagattagccacctaaccggcctgcttgccatctgttcctccctactagtaatccatccttgctctgctccagttttctcggattgagtgatttattggcttccacacctccagtggtttcttattgtctacagattaattgtaaacttcccagcatgcagtataacctttgcaatcaagctcagccctgctctgcagtcttctttctgtgcccttgttcctcctggagtggagtctgtacctcagctccactgaacttcccagtttccccaaccagacccacgttgcttccactgcccattgtgctttgctcccctgctcccgtcatgtcatccttcgcactgataatccagcttacacgtgtccttacctgtgtttaccacaagagtggtcactctgccctctggagttttctttgtaggcctctttggttttttactcaccatacttctgacaccaaatgtgtgaattttttttttataccaaccgactctctaacccttgagacaccaattgtgtgtcctacagttccggtcctacaatttaagttcctacattaaccaccctgagtttgcatcacactccacaggtttaaggtttcagcccacaatactgccctcatttaagacggcagatgcaagtattgggtccccaggttacccacacttctcttctacttggctacaaagttgtggggggatttccacaatccacccctatttcaggccctgatgatttgctaaaatggctcacagaactcaggaaggtactctacaatttctgctttattatatagggtacgactcaagaacagccaaatacaaggattgttacagggcaaggctggagggggtgcaggtactgcagaccacctagtccctctcagggcctgctactctcccagcacctcaaggtgttcatcgaccctccctaaccccatcagttaagggttattgtggaggctccattacataggcactattgattaaatcattgttccttggcaattgaactcaaactcttctcttcttatgactggagataggcaggcatggctgaaagttccagctctgcaatcatgccttggtctttctggcatgctgagagccatgctgaagctatctaagggtccccagctaccagtcatctcactggcatacaaaagacactcctgtcactggagattccaggtatttcaaggagctgtgttccaaggaccagggatgaagaccaaatacttattattaccacacctgtgttatagatcctgtattgtaattggctgcatgcctcccatcaaccgctccactgtgagtgttgggagggaaaggatcatttcttactaaattttgtttaatgagctaacctctccttggcatataattcagcttcttctgttttggttcaagtattatgctaccgtttctctacacacacttagacacacacacacacacacacacacacacacccctatacacatactattgtacagtcagtgtggttaaaattccactgataggaatataccccagagacttgaaaacagacacaagaatagatattcgtatgcagatgttcatagcagcattattccaggtagccaaaaactggaaactactcaagtctccatcagcagatgaatggataaacaattgctatctatatgacatatataatgatatatatcatatgtgtattatagatatatacacttgtatgtgtatatctatttaggtgaccctaaattgctatctatttatacactaaatctggtaaccctggccgggtgcagtggctcacacctgtaatcccaacacttcgggaagccaaggtgggtagatcagttgaggtcaggagttagagaccagcctggccgatatggtgaaaccccgtctctactaaaaaacataaaaattagccaggcatggtggcacatgcctgtaatcccagctactcaggaggctgaggcaggagaatcacttgatcccgggaggcagaagttgcagtgaggtgagataatgccagtgcactccagcctgggtgacagagtgaggccctttctcagaagaaagaaagaaagagggaaagggagggagggatttaaatatcatgtatattatcagatttaaaataatgtgattgtttttattttgagaaaaaaacatatactgttagatttatttcagacttttttttttttttttttttttttttttgagacggagtctctgtcgccaggctggagtccagtggcgtgatctcggctcactgcaacctccgcctcctgggttcaagcgattctcttgcctcagcctcctgagtagatgggactacagctgcgtgccaccacacctgtctaatttttgtatttttaggagagacggcgtttcaccatgttggccaggatggtctcgatcccttcaactcataatccacccgcttcggcctcccagagtgctgggattacacatgtgagccaccacacctcctggcctcagacttattttttaagcatttatttaggtgttttgctcatgtatttttccatacaataaaatatataagcattcactccccttcccataaagaattcttgaaaaataatgaaatatgtttagtctaaagtacctgaaggcagagcagatcaatgtttgaagccaaacacttgaagcaataacttgatttttttttttttttttttggttttgtcttgtcttgaactcctggcctcaagtgatcttcctgcctcagcctcccaaagtgctgagattataggcgtgagccacaatgctcatcctcaaggaggtgttaatatgatagatttaaacttagataaaatttttatagattttaaaaatattttttagttggtactgtgtactgttgaattttcaaaccccgtgtaataacattacatgaggctaatctgttatctgttagagtgtatgaaagaagtgttaatttttttttccctttggtttttcaggttctttatagagttggaagcaagacatcagaataatatcttcatagatgacataagtgacattgtggaaaaacacacagcatccacatttgacccatatgtgaaatactgcacaaatgaagtctaccaacaacgaacactacaaaaattgttgtaagcaatgtcgaatgctacagttttaatcatctaacctagttttaattaggctacattgactgaaattaattgatcttttgaattatatttagaaatgcctcctgataggctatttcccagaggagaaatgtttaagagcattacttttagggtgagggtgtttaagtagaaaaatctagtgtgtagagaattttctctcttacgaaattatagcttgttattgatgtccttgtttagtgtttcgttgtttttaattgttgcaggaaacagaggtggtcctcactctaaacccgcagttttctaagctttttactggcaattaagtggttttcctgaggcttagaggggattcttgagttgattgagctaaaagctaagattcagagttttctctactattctgatctccctccattcaattgacaacgataataaattgttcataaaaattgctgattattccccccacttgggtagttagagttgaagagaggagggaagttctgaaggaaagcagtagaaaaaagtaatgttcttaaagatttcagttatgcagcaaaagagttaagcattagatttcctgccacatcttttctttttgtcctttttaggttactgagagttttgatgtgatgcatatgccatctgtgtccttaaaagagtcaccaattgttcagtaatgcctatatgtattttaaagagtcctgtttatcacaagtagctgttttacagcacagttgtgcactgctgtaaacccagtttgggagcttaatggctgttatcgttctcaccccctcctgtgagttgtggcatttatgaccacggcatggagcttcggtcaacttctgtgcaatatgtgagacccctatggaggagtaggggttgaggatgactaacttatggctgcttggagaaatagtcaaagcctctaagctgatgagaagggctgatgatggccccctttttcctccacatcttcatgacattttcatatagccagggtggaaaacacacagctgctaaccccaatgagatttttagtataaagcagggtttgttcgcacaattgacattttggactggataagtctttgtggtgggctgtcctatgcattttaagatgcttaagggcatccctggcttccatctgctagatgccaaaaatctccccagacattgcagaaggtcccctgagggtaaaaccacacccatcacttcctcactccaccacgccctggtgggaaccgctgctataggaacagaggttctctgtaactgttagagaatgcaagttcatgtctgaaaacaaagccttgaattagagataaatttgggtttcattttgttttgcaggatttaaaaaatgtcactaggtactgctatacatcatgtgactcttaaaggttttatctaaattagcttaatgataacatcatcagcactttcacgtggcaattagtagtgttttcaggggatttgttgcagttgatgtgatttttttttttttttttttttgagatggagtctcactctgtcacccaggctggagtgcagtggcgcaatcttgggtcactgcaacttctgcatcccaggttcaagcgattctcctgcctcagcctcccgtgtagctgggactacaagtgcatgccaccacacccagttaattttttgtatttttagtagagactgggtttcaccgtattagccaggatggtcttgatctcctgacctcgtgatccacctgtctctgcctcccaaagtgctgggattacacgcgtaagccactgcgcccagcccgcagtttatgtgaatttaaggttagaacagtggctttcaattctagctgcatgttagaaatgccttggggcctgaaaatgagcaaatgtacactgtccagagtccatcccagactatttaatcagaacctttggaaggtgagggaggggactgggacctgagttatttaaatatacaactaatttagaggtttttgttttttttttttaactttctaaaaatcttgtcaaagctatcagtaaaaggaaacttaaaacttctcaattagagaaaatggaaatgaattgtttctgtataatttcttttcatttgctattctggcattctccccctccctgcttttagtagcagccttgaacaagattatttaattttcaaaataacattttttttaaaaaaaatgactgctattgtcactatcctgcttccttctcccttcatgggagtacaatatccatctacctcctaccctccttgccttggaaagtggcagtggaactctacagagctcctcatgggatgaagtgaggtaagagagtgagaaatggggggacaagagtgtcagatttaacattagaaaacttgggtttgaggccaggcacagtggctcacgcctgtaatcccaccactttgggaggccgaggcaggtggattacttgaggccaggagttcgagactaccctggccaacatgaaaccttttctctactaaagatacaaaaattagctgggcgtcatggcacacacctgtaatcccagttacttgtgaggctgaggcatagaattgcttgaacctgggaggcagaggctgcagtgagccgagattgtgccattgcactccagcctaggtgatagagcaagactccatctcaaaacaaacaaacaaacaaacaaacctgggtttgacttctgtctttggcagttactaagtcatatttacttggtgaggtagggacctttctgcattccattttcttactggaatccctatctggccttccttaaaagttacgtaggtggttccacatgaaagaatgtatgtcacagtatctcgctaagtttcattaaaatgttatagcagcattaatacttttcttgcattaacaggagaaaaagaggaatatttcgactgatgtgatgaaaaggttttctgtctcagaaagaggatctttgtggcctaaagcctctgaagtccagtctaactgttaatttcttatgccattgtctagggctggagaagtggcttaaaacatattatttatgatcttattaatgatatatgtttatagatgatcggatataaaagacctagtctgtatactgatttatgacccatatattcaccattatgataccacagcttcttcatttgcttaccttccacttgtataaatttctagctcctacatgttttgccttattgttaatactgttatgtgaaatccacatcttattatattcagccttgaatataaaaggcagacaagccattcgtatttgccagtgtaattatgtgcttatgatattttcatacagtttaaaatagttgatgctatatggatttatcacagtattttgtaatacatttttacttgctgcttaatttgaggaggaaatattttgaagtttctcttttctttgttttccctcagagctaccaatccatcctttaaggaagtattgtcaaggattgagtcccatgaagactgtaggaacttacccatgatctcttttctcattctccccatgcagagggtgacccgccttcccctgctgatggatgtaagacatgacggtggctttttcctctgtggatagctgtgcttctctaaatctgatttagaaaattattattattccacttaaattgatgcatatttaaaggtctaaaaatcccccaattaagtgagaaggtgttgtttgttcagaaagtctcacctgtatctgatatctctggaaattatctttcatttaggcttctatggtcattctgaagaaattggatctcatcacccacttactcagcattttttgaaataggaagagttgtggcttctttatgtcaggaggcctggattccaattctagctaagccattaggcatgtgaccttgagcaactcagtctctttgggcctaagattcctcagactgatcactgagatcccttcatctataatgttccaaggtgccctgggccttccatttcatacaggaatgagagtctcttcagcatgacaaggcatagtactgcctgtattatgcattgtgcgaagtgagtgaggaaagcccagcttccttcttgtgttaggcagcattcatgaggaaagcaagtgtttttgactttgaatcacggcaagacatgactgggaaaagtgagtagagtctgcctagtagtacgtgcagctggaaagacaggtaggctatgggcaggagagcctgccactggctgcactggagctgctggggcagcaaaagagaaaagtggggtggctcgacacaggtgccattctagcagtggatcacagagtgtctttttgatctaattagaaaatattttgttatgattttcctactttaaaattggatcataatgttgatataaggtcaactttttacatacctgattttgactaatcaaaacaaagtaaaatatatattaaaaattatgattaaggttacaaagtaaatttcacattctgtatcccattgtaaattctaaaatacattctttaaaaatgctgaaattttgaaatgtgtaaaagcatggaatcatgagcatttagctgactgctgcagttttggagacgttttgtcaggtatttcaggattcatagcaccttgtgctcctcaagtttacttcgatctactgcctttacaccttctccacccatcacctgtaattcaggaacttcccccctgtgtacatattgggaagcttgcagttttgaacatttcactttctgatttttttttgagatcagtatttatcatgtttaaagatagaatgtggctaagttatcagaatcgaatttttgcttaagaaggaaactttggtccatataaggaagtattatttcaaacatgactatttttttaagcaagaagtgaatgccttgtaaatacaacatttcttgtaatattagacttttgaattttcagggttttcttcttctgaaaatgcattttattcctctttgagaattgaaataaaagaacaaaaataaataaaatgcattttaaacatgttttccagattttatatatgctgtgatggccaagccttttatatcctctttaaatttgagaaaattacttgtatggaatgggactctaaaatctaacacattatgttatacagtgttggagattcatgccatgattgctcagtaggctttaaactttttttaagccacagacccccccttgagattctgagtaaagctatagcttttcttcccagagaatatgtgtatgcacaaaattttacataaaatatcaatatatggaatccagctaaggatgcctgctctcagggacataaaccagtatttttcatgctgctttcatacccattagtgggccataaaactgatttttgaattatgagcatatgtacgttgctcataaagtggttaaatattgtttcataaaatcctggttcatttatgtgtgcatgtgtgctggttgcagtgtaaaagtatttcttacagtgagtcatagtcaaaaaatataagaacctccacagatggtgcactctgtgtttctcacatagcagatagttaaaaatcttgatgcctgactttcagatggcttggcttggtgcttctgtacatttaagggaccagtgacttgctagtagccaactactttctacctctgcctgatgcctgttgctctaatctgtttctcatgtgtggaaatctggccatttaggcagaatgtaaatgtatttaaaatagtgtctcttcaattttacctcatttggaaattcagttaagcttgttcattaaaataaacactttcagtaattaaagtggttccctgggctttgaatgtgtgtgtatagctttaaagttatatgtaattaaatttaccgtgaattgaccctgtttgacctgattttcctatcacaaatgaaatttctcagtataaatatatcaacagaaaacctagcaggctttttttcctttgctggtttttttgggtttttttttgactgttttttctttgagatgctgtcacccaggagtgcaatggtgcgatctcggctcgctgcaacctccacctcccaggctcaagtgaccctcccaccttagcctcctgagtagctgggaccacaggtgcacaccaccatgcctggctaattttcttttagtatttttgtagagatggggtttttccatattgccctggctcctggactcaagtattctgcctgccttggctttccaaagtgctgggattacagacatgagccactgtgcctggctgttctttttattcaaaatgtatcatctataaatataattgcctctaataataatgattataatggtgataattaaagtaactcttatttattgagggcataccctatgccaggcactaataaagaactttacataaattatcattaacacttctaacaaccttgtgatgtagctggcatcaccccagttttacagatgaggaaagagaggcttataaagatagagttagtgacttgctcaagatttgataactagtaagggcagacctgggatttgaaaccagggttacccacctctgaattctatctttcttaaccattccctggatggacttggatcctgtgtttaaagattatttcctggtttttaaattgggttttaatattatcctcatactcatccgtaatatcgtgtttggcattgtttgctatgagtaaaaggatatggctggacattggttttattttacttaataaaatagatcaataaattttgttcacttttatttcattacagactatctgtcaaaaaacacctaaggactctccgaagtatgaagtctgcaaaagagccttgaaggaagttagcaaggtaactgttgggtgacagtttgtttgtaagacaggaaaccattcagttagctcagacacaaagtgtgtcttggcttgatgctgaaaactggtagagtctcacagccatttgtacagcgttctttaggtagttgcaaaacaaaatcatatttgctatactcaggtgaagttggtatttttactgtttcagacagttttgttttaagagcctacagatacctcattttcttttggtggctgaatagctgtttattcatttctcgttcagtaaatgtttattgagtatcaaccactgtgccaagaatgatgccagttcttggaaatgcagtgatgagtgaggcacgtgtagtcactgtgctcgtggaatgtgcagtggaaagaggagggcagacattaaacagagttacaatgaagggtagtgggtgatgtgatagggaagtccacagtggtgtctaagctgagacctaacacaggagtggctgtgagcccaggattgggggaagagagtgtctcaggtatgtgtagaggtccaaaggcaagaaaatattggagattttgaagaactggaatgttctccatgtggctaggatgcaatctgagagacagcactagggaaccagctgtgtggggccttgttatacatgctaggctgttgggggcctgatcgtaagatgatgtagaggctaaattcatgtattatgaagatgatagtggtgatggggccagttctgaggccagtgatagttgattaggcaagggatggcagtggcccctattgacatgatggtaaggtggtgagaagtctacctgtatactggggaggcagacttggaaactgattgggtgagcacatttcaggacagaagtcaaggaatattgtctgtggcttgggcagcgaggtagatgctcttccttcatctacgatagaaacatagggagagtggataagttccatttgggttgtgttgtcattgagattcctatagaacgtccaagttggctaaataaacaaatcagaagctcagagaggagacctgaactggagacatggatttgggaatcatcagcatatggacaatagttgaagctgggtgagtggatgaggttacttagggagactggaatgagaagggcagtgagcctgaggaatgaccatgaggaatgctagcattcatagtcttattagggaaaatgagccagtggagaaaactaaaaagaacaaaacaaagtaaaacataccagggaagaggaaggaaaaccgtaatagcttggcaaatggcagttaatttggtggttaactctgttgaatgcttctgaaagataaagtgggataatgattgaagttatccttaggtttatcatcagtaggttgtatactggggttggggggcggggatagggaacctgagctgagtgtattgagaaatgagagggaggtgtgaatatgcagccagccggcagtggtagctaactgtctaaattcagggagtagaaagagaaagagctgtagctgaaagggaagtgagagagggtcttcgttagtgtatttgtttaaagattagaaaaatgtaggtagggttagctactgatagaaatatctagctgagaggaagcaatagaaggtgtaggtgtcactgaggatactgtatgaggttggcacagaggagcaaagataatggtagcatcagaagcttcctaaatgtctccagttacatagccctatatgaattgggtatggctttgtaccactttgctatgaagtactgtttcttttagtcaatttacatcgagtcaccattttacttaccctcttccttgccaataatatttacaaaatcatgggttttattagttgtttatttttctaacatttttgtagtaaaagtaagtgtatctgtgagccacttaaattcatctcttcatcccatcagtggtctgcacacctattttgggaacagtaagtaaagaaagcctgacaagtgagaagttacctaaggtactattgccagtggtgcttcctccaagacctcaagtcctgtgctgctttcctagaggaggaactggggagggaaacgggggaaggtttttaggagaaactactagagaagttctagtcttggacataaatgggattttgacaaattttgcctggttgttactaagaaattgaaaaaaaaaaagaatttgcacagagaaaaaaataggaaggtactagtagttggttgttgaattaaacctggaatgttacttaatttttttcaagaattttacatctcagttacagtagattactacattccttcaggcatctcttgttcacttgatttcatactgatactttcaggaaaggctggcaaaaatgtaatagaccagtgagttgctttaccttgatactataagtatacaaaaagctatcatgtgaagagatgtcattccagtgacttgctttctctgaagggcatcattcctttctctctattgagcatgaatcatgaatattagaaatattccttcagtctcccagcgttacagggaaactgaaatcgttgatatagtcagctcaataattaatcttcttttttatttgtaaaggttactgatgaggttttatagaatctgggaaaacaatatgaatattttcagcagaaagagtatgcatagagagcatttatggtttagaatgaaaatgtagaactacacttgtttgctttatcagagaaattgggagttcccaatattttattttagagagttaaatttggtatgttgaggcccaaggtttagaaccagatgctgccttaatgtcttgggtaagtctctctaggtagttactcattcttggaaaaaaagagtcataccattttggtagttaaaataatgcagtttatttgcaagatgcgaataatactttgctgaaattgctcatgcatgttgccttaaagactgtgacaatttctttaatttagggccttggaaagacttactgacctaatcaaacaactcaaaaacaagaacaacatttctataaaatgaaaatgtgcttacctcctgattttctgttaacatgctggggggagaaattctagggaatctgataatttccataggaatctggtaattcagctcatctagagtgatgtgtaccatgtaaggaatagtgatcaagagatggtcttatgccaaatgaatcttccctgttatttccttctgtttactctcccatggaaagagaatgtctgctttaactctgacctcatcaaaattccgtttagagttggagatagtgttacattatgagcctttctcccagaggcaaaatagtcaagctctatttaatcttttcgtataacgtattgcttcagccatttacaaagaagtacatgtgtatgacaaatggccaacaaacgtgaaaaaatgctcagcatcactaactataaaggcaaattaaaaccacaatgaggtaccaccttactcctgcaaaaatggccataattcaaaaataaaaaatagtagatgttggcatggatgtggtgaaaaggaaacacttttaccctgatggtgggaatgtaaactagtacaaccaatatggaaaacagtatggagattccttaaagaactaaaagtagagctaccattcaatccagcaatcccactactggatatctacccaaaagaaaagaagtcattatgtgaaaaagacacttgcacactcatgtttatagcagcacaatttgcagttgcaaaaatatggaactaatccaaatgtccatcaaccaatgaatgggtaaaggaaatgtggcatatatacaccatggaatactactcagttgtaaaaagaaacaaaataatggcatttgcagcaacttggatggagttggagaccgttattctaagtgaagtaattcaggaatggaaaaccaaatatcatgtgttctgacttataagtgggagctaagctatgaggatgcaaaggcataagaatgatattatggactatggggacttggggagaagggggaaaagggcttgggataaaagagtacacattgggcacagtgtacactgctcaggtgatgggtacaccaaaatctcctaaatcaccactaaagaacttctccatggaatcaaaaactacctgctccctgaaaagtattgaaataaatttttttatagataagtagatacaaaagtatttttattattttattaattttgtgggtacatagtaggtacatatatttatgaggtacatgagatgttttgatataggcatgcagtgtgaaataagcacatcatggagaatggggtatccatcccctcaagcatttatcctttgagttaaaaataattcagttaaactctttattttaaaatgtagggggttattattgactgtagtcaccctgttgtgctatcacatagatcatatagtaggtcttgttcattttattttttttttatacccattaaccatccccacctcctccccagcccccgactacccttcctagcctctggtaagcatcattctactctctatgtccatgagttcatttttaaaaaaaatttttaaatcccaaaaatgagaacatgtaatgtttgtctttctgtgtctggcttatttcatttaacataatgacctccagttccagccgtgttgttgcaaatgactagatatcattctttttcatggctgcatgatactccattgtgtgtatgtactacattttcttcattctttcatctactgatggacatttaggttgcttccagatcttagctattgtaaacagtgctgcagccaacatagaagggcagatatctctttgatatactactttcctttattttgggtatatacccagcagtaggatttctgaatcatatggtaatcaatttttagttttttaaggaacctccaaactgttctccatagtggttgtactaatttacatgcccaccatcagtgtatgagggttctcttttctccacatccttgccagcatttgttattgcctgtcttttggatataaaccattttaactggaataagatgatatctcattgtagttttgatttgcatctcgctaatgatcagtgatgttgaccttttcatatgcctgtttgccatttgtatgtcttttgagaaatgtctattcaaatctttgcccatttttgattggattattagattttttttctatagagttatttgagctccttatgtattctggttattaatcccttgtcagatggctagcttgcacatattttccttctattctgggggttgtctcttccctttgttgactctatactttgctctgcagaagccttttaacttgttgtgatcccatttgtccatttttgctttggctgcctgtggttgtagggtatttttcaaggaatttttgcccagaccaatgtgctggagattctccccaatattttcttgtagtacttttatagtttgaggtcttagatttaagtatttactccattttgatttgatttttgtatatggtaagagataggggtatagttttattcttctgcatatggatattcagttttctcagcaccatttattaaagagactgtcttttcctcagtgtatgtttttggcacttttgtcataaatgagttcactgtaggtgtgtggatttgtttctaagttcttttttctgctccactggcctatgtgtctgtttttatgccagtaccatgctgtcttggttattatcgctctgtaatataatttgaagtcaggtaaagtcattcttccaattttgttctttttgcttaggacagctttggctattctgggtcttttgtggtttcatatacattttaggattttttatatttttgtaaagaatgtcattggtattttgttaggatttacattgaatctgtagaattctttgggtagtatggactttttaataattttaatttaataatttaatttaataattttaataatattgattcttccaatccatgaacatggaatattttttaattttttagtgtcttcttcaatttcttttatcagtgtttcatagtttttcttatagagatctttcacttctttggttaattcctaagtacttaattttacatgtggctattgtaaatgagattactttttaatttctttttcacattgttcactgttggcatatagaaatgctactgatttttgtatgttgattttgtatcctgcaactttactgaatttgtttattctgatagtttttattttgtggagatcaaatataagatttttttttattatactttaagttttagggtacatgtgcacaaggtgcaggtttgttacgtatgtgtataaatgtgccatgttggtgtgctgcacccattaactcttcatttaatattaggtttatctcctaatgctatccctgccccctcccccgaccccaccacaggccccagtgtgtgatgttccccttcatgtgtccatgtgttctcattgttcaattcccacctaagagtgagaacatgaagtgtttggttttttgtccttgagatagtttgctgagaatgatggtttccagcttcatccatgtccctacaaaggacatgaactcatcattttttatggctgcatggtattccatggtgtatatgtgccacattttcttaatccagtctatcattgttggacatttgggttggttccaagtctttgctattgtgaatagtgccacaataaacatacatgtgcatgtgtctttatagcagcatgttttataatcctttgggtatatacccagtaatgggatggctgggtcaaatgaaatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatagccagtgatgatgagcattttttcatgtgtcttttggctgcattaatgtcttcttttgagaagtatctgttcatatccttcacccacttgttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccatttgttttggtgttttagacatgaagtccttgcccatgcctatgtcctgaatggtattgcctaggttttcttctagagtttttatggttttaggtctaacatttaagtctttaatccatcttgaattaatttttgtataaggtgtaaggaagggatccagtttcagcttcctacatatggctagccagttttcccagcaccatttattaaatagggattcctttccctatttcttgtttttgtcaagtttgtcagagatcagatagttgtagatatgcggcattatttctgagggctctgttctgttcccttggtctatatctctgttttggtaccagtaccatgctgttttggttacagccttgtagtatagtttgaagtcaggtagcgtgatgcctccagctttgttcttttggcttaggattgacttggcaatgtgggctcttttttggttccatatgaactttaaagttgttttttccagttctgtgaagaaagtcattggtagcttgatggggatggcattgaatctatgaattaccttgggcagtatggccattttcaagatattgattcttcctacccatgagcatggaatgttcttccatttgtttgtatcctcttttatttcgttgagcagtggtttgtagttctccttgaagaggtccttcatgtcccttgtaagttggattcctaggtattttattctctttgaagcaattgtgaatgggagttcactcatgatttggctctctgtctgttattggtgtataagaatgcttgtgatttttgcacattgattttgtatcctgagacttcgctgaagttgcctatcagcttaaggagattttgggttgagacgatggagttttctagatatacaatcatgtcatctgcaaacagggacaatttgacttcctgttttcctaattgaataccctttatttccttctcctgcctgattgccctggtcagaacttccagcactatattgaataggagtggggagagagggcatccctgtcttgtgccagttttcaaaaggaatgcttccagtttttgcccattcagtatgatattggctatgggtttgtcatggatagctcttattatttagagatacgtcccattgatacctaatttattgagagtttttagcatgaagggttgttgaattttgtcaaaggccttttctgcatctgttgagaaatcatatggtttttgtctttggttctgtttatatgctggattacatttattgatttgcatatattgaaccagccctgcatcccagggatgaagcccacttgatcatggtggataagctttttgatgtgctgctggattcgggttaccagtattttattgagatcttatcatctgcaaacaggataatttgatttcttccttccaaatttggatggtgtttatatcattctcttgtttgattgtactagctaggattccagtactatgtcaaataatggtggtgaaagtggatatccttgttatgttccagatattagaggaaaggttttcagttttctccattcagttgatactagctatgggtctgtcatatgattttttatcatgttggggtatgctccttctatacccagtttttgagggtttttagcacgaagggatgttgaattttatcaaatgctttttctgcacaattgaaatgatcatttttttttgttcttcatttggttgatataatgtattacactgattggtttgcctatgttgaaccatccttgcatcccagggataaatcccgcttggccatgataatctctctttttttttttttgataatctttctaatgtgttgttgaattcaatttgctagtatttttttgaggatttttgcattaatattaatcatagatattgtcctgtagttttcttttttgatgtgtctttgtctggttttggtatcacggaaatattggccttgtagaattagtttggaagtattccctcctcctctatttcctggaataggtggggtagggttggtattagttctttaaatgtttagtagaattcagcagtgaggccattgagtgtcaggctttgctttactgggagacttgttattacagcttcaatctcattacttgttactggtctattcagctttttgatttcttcttggttcaatcttggtaggtggtatgtgtatgggaattttccatttcctttagtttttctttattatttgttttctaccaattttgggtttggttgagtttcattgttagtttatttttcttttccttttttttttttttttttgagacaagagttttgctgtatctcccaggctggagtgcagtggcatgatcttggttcactgcaacctccgcctcctgagtacaggcgtatctcatgcctcagcctctcaagtagctgggactacaggtacatgcctggctaatttttgtattactttttagtagagatggggtttcaccatgttggcaggctgatctcgatctcctggtctccagtgatccccccgcctcggcctaccaaagtgctgggattataggcatgagccactgtacccagccttttcctcttttttgatttattcacttacagctataaaattccctctttatactgcttttagtgtatcacataggttttgatatgttgtgtttccattatcatttgtttcaagaaatttttacatttccttaattttttctttaacctactggtcattcaggagcatattttttaatttctatgtatttgtacacgttccaaaattcctgttactaatttttagttttatttcattgtggtcaaagaatatgcttgatattacttcagaatttttgaatattttatgacttgttttgtgacctaaatatggacagttattgagaatgatccaaagaatgtgtattttatagctcctggatgaaatgttctgtaaatatctattagatccatttggtctatagtgcagattaagtctgatgtttctttgttgattttctgtctggaagatctgcccagtgctgaatgtgggatgttgaagtctctagctattatggtactatggtgtatctctttctttacctttaataatatttgctttatatatctatgtgttccagtgttgagttcatatatatttaatattattatatcctcttgctgaattgacctcattatcattatatagtgactttctttgtgtcttcttgcagttttttctggaaatccattgtgtctgatataagtatagcaactcctgtttttttttgttttggtttccattgacgtggagtatctttctccatcctttgtttttagcctatgtgtgtctttataggtaaagtgtgtttcttgtaggcaacagatcaatcagtcttgttttttcatccattctgccagtctgtgtcttttgattagagagtttagtccatttacattcaatgttattattggtaagtatggacttactcctgcccttttgttatttgttttctggttgttttgtggtcttctattccttctttccttcctttttgtcttcctctagtgaagattatttcatctgatttagttttttgctttttattttttgtgtttaaggttatcatgaggcttgcaaatattataacccattattttaacacaataacagcactatttgcataagcaaggaaacaagcaaacagaaaactaataagaactctatgccttaactttgtacccccacttttaatcattttgttgtttctgtttatatcttattgtactgactatgccttgaaaagtggttgtagttactatttttgattggttaatcatttactcttctacttagggtaggggtagtttacacaccatagttacagtgttataatattctgtgtttttctatgtatttactattaacagtgagttttgtaccttcaggtgattacttattattgattaatatcattttctttctgattgaagtacttcctttagcatttcttgcaggaaaggtctagtgttgatgaaatgcctcagcttttgtttgtctgggaatgtctttgtttctccttcatgtttgaaggatattttcactggatatactattttatggtaaaagttttttgccttcagcacttgaaatatgtcatgcccctctctcctggcctgtaagctttccactgaaaagtctgctgccagatatattgcagctccactgtatgttatttgtctcttttctcttgctgcttttgttttatttattttttgtagagatggggtctcactgtgttatccagcttgttctcaaactcctgggctccaaaagcttcttaagctgataaacaacttgagcaaagtctcaggacacagaattaatttgcaaaaattgccaacattcctatacaccaagagtgggcgatccaagagctaaatcatgagtgaacttccattcataattaacacaaaaagaataaaatacctaagaatacagctaacaagggaagtaaggacctcttcaaggagaactacaaaccactgcccagagaaatcagagatgacataaacagatggaaaaacattccatgctcatggatgggaagaattagtatctttaaaacgctaatactgcccaaagcaatttatagattcaatgcttttattattaaactgccattacattcttcacagaattagaaaaaaagtattttaaaattcctatggaacaaacgaagagcataaatagccaaggcaattctaagcaaaaagaacaaagctggaggcatcacagtacctgacttcaaactatactacagggctacagtatccaaaacagcatggtactggtacaaaaactgacacaaagaccaatggaatagatagagaaaccaaaaataagaccatacacctacaatcatctgatcttcaacaaatctgaccaaaacagactgtggagaaaggatttcctattaaataaatggtactggaagaactggctaactgtatgcagaaaattgaaactggattcctttcttataccatatacaaaaatcaagatagattaaagacttaaatgtaaaccttaaaactataaaaccctgaaagaaaacctggtcataccattcgggacataggcatgggcaaagatttcatgatgaagatgccaaaaacagtcgtgacaaaagcaaaaattgacaaatgagatctaattaaactaaagagcttctgcacagcaaaggaaactctcaacagagtaaacagacagcctacagaatgggagaaaatttctgtaatctatgcatctgacaaaggtctaatatccagcatctataagaaacttaaatttacaagaaaaaagaataactcttttaaaaagcgggcaaaggacatgaacagacacttctcaaaagaagacatacatgcagccaacaaacatataaaaaaaaagctcaacatcactgattagagaaatgcaaatcaaaaccacaatgagataccatctcacgctagtcagaattgctattattaaaaattcaaaaaataacatgctggtgaggttgtggagaaaaaggaatgcttttacactattggtgggagtgtatattagttcaaccattattgaagacagtgtggtgattccttaaagacctacaaacagaaataccatttgacacagcaatcctattactgggtatgcaccgtaaggaataggaatcgttctgttataaagacacatgcacatgtatgttcattgcagcactacttacaataacaaagacatggaatccagttaagtgcccatcagtgatagactggataaagaaaatgtacatatacaccatggtatactatgcagccacaaaaaagaatgagatcatgtcctttgcagggacatggatggaactggaggccattatccttagcaaagtaatgcaggaacggaaaaacacataccacatgttctcacttataagtgagagctaaatgataagaatacatggacacaagggggaaacaacatacactggggcctattggaggatggtgggtgggaggagggagtgaattaggcagaatagctagtggattctgggcaatacttgggtgatgggatgaactgtgcagtaaaccaccatggcaaatgtttacctatgtaacaaacctgcatattgggcatacatacccctgaagctaaaataaacgttggaaataaaacaaaaactgggctcaagtgatcccttgccttggtccctcaaagtactgggattacaggtgtgaccgctatcctcagcctcttgctgctttcaggatcctttctttatctgtgaccttttggtgtttaattattaaatgccttgaggtagtcttttttgggttaaatttgcttggcgttctgtaaccttcttgtacttggatacttatatctttctctaggtttgggaagttctctgttatatccctttgaataaagtttctaccccgtctctttctctacctcttctttaagcccaataactcttagattttcccttttgaggctgttttctagctcctgtagccatgcttaatcattttgtattcttttttctgttatctcctctgactgtgtattttcaaatagcctgtcttcaagctcactaattttttcttctgcttgactaattctgctattaaaggactctggtgcagtattcagtatgccaattgcattttttttttttttttttttgagatggagtctcactctatcacccaggctggagtacagtggtgcaatcttggctcactgcaacctccgcctaccggattcaagcgattctcatgcctcagcctcccaggtagctgggattacaggcacataccaccatgcctggctaattttttgtatttttagtggagacggggtttcaccgtgctggccagactggtttcaaactcctggcctcaagtaatctgcccacctcggtctcccaaaatgctgggattacaggcgtgagccactgtgcctggccgccagttgcattttttggctccagaatttctgcttgatttcttttaattatttcaatctccttgttaaatttagctggtataattctgaattccttctctgtattatcttgaattccttgagtttcctcaacacagctattttgaactctttgcctgaaaagtcacatatgtgtgtttctccaggattggtccctggttccttatttagttcatttggtgaagtcatgttttcctggatggtgttgatgctagtaggtgttctttgtgtctgggcatggaagagttagatatttattgtagtcttcactgtttgggcttatttgtacccatccttcttgggaaggctttccagacatgtgaaagaacttgggtgttgtgatctaagctgtatctgctttaggggcacccaaagcccagtaacgctgtggttcttgcagattcatataggtaccaccttgatggtctaagatctggaagaattctctggattaccaggtagagactcttgttctcttcccttactgtctcccagatacatagcctctgtctttgttctgagtcacctaaagatgagggtggagtgacacaagcacccctgtggccaccctcactatgattgcgccgggtaagacctgaggccagcacagtgctggatctcgctcaaggtctgctctaaccactccctggctactgcctgtttactcaaggcccttaggctctacagtcagtcgacggcaaagccagccaggcctgtgtccttcccttcaggccagggaggtcccccaggccccaggtgggtcgagaggtaccgttcacaaacggtctaaagtctaaaacctcagaagtctacttggcattctgttgtactgaggctgagctgccactcaaaccacaagatgcagttcctcccactctaaccttccctttccaaagacgggagcctctctttttagccaccaccaccccaggccacaaggagtactgcctgactactgttgatgttccctgaagatccaagggttcttaagtcagcttgtggtgaatgctgcctggcctgggactcacccttcagggcagtgggctcccctctgacccagggcaggtccagaaatgccatccagaagtcaagtcctggagtcggggaccccaggagcctgcttggtgttctaccttcctgtgaccatgctggtacctgaatccaggaagtctcagaggctgactcagggccctcggcatagtacctgggtatccaagctgtttattcagggcccaagggctcttcagttagcaggtattgaatactgccaggactgggttcttttcttcaaggcagcaggttcccttctggcgattctcatgcctcagcctcccaagtagctgggattacaggcactcaccaccaagcctgactaattttttgtatttttagtagagacggggtttcaccatgctggccaggctggtctcaaactcctggcctcaagtgatctgcccacctcggcctcccaaaatgctgggatgacaggcgtgagccactgcacctggccgccaattgcatttggcgccagggtatgtctacaaacgttgtctggggccaggcacaatggctcacacctgtaatcccagcacattgagaggccgaggcaggcggatcacctgaggtcaggagtttgagaccagcctggccaatatggcgaaaccctatctctactaaaaatacaaaaaattagctggttgtggtggtgggcacctgtaatcccagctacttgggaggctgaggcaggagaattacttgaacccgggaggtggaggttgcagtgagccaaggtcgcaccattgcactctagcctgggcgacagattaagtctgtccccccaccaaaaaaaaaaaaatttgtctgggaggtggggcctggaacgggggcctcacaacagtgagcattaccctctcccactgtggctgagctggtatccaagatgcaagacaaagcccttcccattttttcctctcgtcttctcaagcagaaggaaggggtctcttttggagccccagctgtgcttgccagcactcacttggctgccacagctggtgtctcagtatgtcatgtgagcccccattccattgtctctgggcctagttcagcactaggacttgcctaattgtcacagtccttatggcctaaactgcctttcaagttcactgagagtcacagagtgctgtaggccttggtggtgagaactcaagttcagactgctgggataagtgattcccttctgactagggctgatttaaatgctccctccatggatgggtatcagctgagtttggtctttttttttcctgctctaacaggacagcattgagttcagtgtgtcacaattgctgtgttttctttcccacagtgcccagagatgctctctgcaacatgccgctgctgtaggagacgggggtgggtggggggtggcatcagggattcaagactgttttttctatctctttagtgcctcttttcagcaatacgaagataaaaccaggtactgagagctcacctaagttttggttcttatgaaggtgttttctctgtgtagatagttgttaaattggtgtccttgaagagggtagtggggaggatgatcagtggagtcttctattccattatcttagttggccttgggccaatatatatattttaacatgcaaacaagctgtattggtcagtgcagaaaattaagttgcagaacaatataaatagtataatgacacctagaaaataatgtatatgtgtgtgtgtatatatatatgtgtgtgtgtgtgtgtgtattttattgatatgtagaaatagtcccagaatcatgcacattacactttcaaccattgttagctgtggtaaagggaggagagtttggaagggaggaagtaataaggctaagtacagctctgtaagaacgtatttaagttgacattggtatattttaacagtgcataaagtggccaagtgcaatggctcatacctataatcccagcactttgggaggctgaggtaggcgtattgcttgagcccaggagttcgagaccagcctgggcaacatagtgagacctcttctccacagtaaatcaaaaaattagcctggcatacagctgtggttccaactacttgggagactgaggtgggaggattgcttgagcccaggttgttgatcatgccatgatagaccctgtgaccatgatcacaccactgtactacaacctgggcgacagagcaagaccctgtctcaaaaaaaaaaaaaagggaaaattggatacaataataagtgtacattgcagaatatttggaaaacttaagagacagtaaaatgcatcagtaattttatcacttaaaggtgactactgtcattctattttgtatccttctggttggctttctgttccaatattagcatatgactgtaaaggaacacttaaaagtggtctccaacctttttggcaccccagactagtttcatggaagacgatttttccacagacgggtggggggctggggggtaggtgggtggtaggtggtttcgggatgaaaccatttcacctcagatcatcaggcattagattctcataaggagcacacagcctagatccttcacatgcgcagtttacaataaggttcacactcctatgagaatccagtgctgtgactgatctgacaggaggaggaggcagagctcagccagtaatgctcacttgccctccactcacctcctgccgtgcgctggattcctaaccaatccatggccctgggggtgggggatccatggtatatatggtacctatttcatttaacattctaagttgtgctccattgaacattgtcttacctaaatgattgtgcacatctaaccatttctaaagataaattttcagaagtgggttcatgggaagaaaaacacaagaatgttttaaattcttttgtatataatgccaaagtgccttctagaaaagttcatgtccacatccaccagtagtatttcagagtgtctatcttactgcatactgccaggatcagatattctattaatctttgttaatttgatggatcaaaaagactttgtgttttaatttacatttctttacgagtaacatagagagagagagagagtgtgtgtgtgtgtgtgtgtgtgtgtatatatatatatatgcttttgttccaggcctaatatatatttattaggcctgggacaaaagctttagtgaaccaaatttaataaagctttggcataaattgaaggaaggtacagtaatatactgaggctgctttcaataaaaacagcagaacatgtatgttcaaattaatgcttgtcccttcaaaatactaattaaaatcaactccattgatgcaccattgcttaagacatcttgggaatcttgtgtttggtctgacttctgaagcacctttggtttctttaggatttccctagtggtggcatgactccagcttttgctgatgggctcagaatttggaagtttaagaaataagataacccaaacttaataatgccattttttcttttcattttatgaagggatagctattggcctggtgtgctggctcatgtctgtaatcctagcagtttgggatgctaaggtgggatgatcacttgatgtcaggagttcaagaccagcctgagcaatgtagtgagaccccatctccacaaaaaaagacgggaagataactatgaataaattgtttcttttttttaaaaatgacttacaaataggctctgaaggtggtttgtttatgcagaaacatttgcagaatatcccattgggcgttaggtgctatattgggctctgggcttacaattacagaaattttatagtctgtgctctccagtctttttggagaggtagtgcccacattgagcactgaaagacaagtagggggatataaatctagataaggagtcagtcggacagagtggggtgaaggatgttcagacagggaaacacacatgcaaaagagggaaggtgggacacagcatatgcatccaacatttggtagggccgaggccccacatgggagcagtgagaggttagggatcaaggaagtaggcaccagatcatgaagggtcttgctaagactttattctgaaagcttcagggagccttttaaggatttctagtggagttgtttcatgatcagatctgaacttagaaaaactgacatcttatttttggaggactcataagggtagggcagaagtgaggaaaagaattaagcagccagtaatccaggcagcaagaggtctgagcctgagttcagtggccagggcaggtagagagaagtgaacagcaggacagcatcattaaggagacttggattgtatgtggagggcaaagcagagggaggggtctgagtggtgagggccaagttttggaggaaagtggatgatgctgagttgagtcaccaggatagacagtgtggagccagggacaagagcgtgatgaaggagatgctcaggtttggtcatgctgaatttgaaatggctctgggaaatttaagaagaggtgccgtgtagatagttggatcagagcctaggatgtagacaaagtctgggaacatagatttgggagctatgaacacattccccaggagaagtcacaaaaatgtcccaagcagcaggagcctggtatggtgcttgggtttcaccctgatatgccctgttcctttcagggtattgcagtttcaggttgctcctgtctcacacctagatattttggctcttagctttgatcagatatagctatcaatccctgcatcagtgaactcacaggccacagctaaagatatgctgtcattgaagacaggtttgccctctaaatctaaaaaccaagtgagcaattagaaattgtttaagtgcccattaataggaaatagaataaatatattggggaaagtccatataattattatagcataaattggatcatgtcattcccccactgaaagcatgctggtgactttctttttgcacctggaatacaatccagacaccttaagaccttgcatgatctaaccgtggcctatctcttttggcttcatcccatgccaccttccttcatgccaggatcttctttgactcactcagtcacacactttctcatctcatcctttgctcatggtgtcccttctctgtgaaccatcttatcatttagtagtaactacttctccttcagctttcagcttaaatgacctctcaggagagggtcctttggatccctccccacttcccactcccctactcacctgtgtttttactttatgatctcagtctgtgatttttttttttttgccttttgtctgcccttccgtgaggttagggattgtaagtattataaccctagtacctgaaacatagtaggcactaaataaacttttttttttaatgaataatattttagaaggggaaatatttttgtcttaattcaagctgctgtaacagagtaccataaactgggtggtttaaggaacagatatttattgctcacagttgtggaggctgggcagtccaagaccaagatataggcagaaccagtgtttgctgaaggctggtttcccggtttgcagatggccaccttctccctatgtcctcacatggtggagagagagcagagagaagaagaaagctatcctgtctcttcttataagggcactaatcccattcatgaggactctactctcatgacctaataacctcccaatattatcacattgcctcgtaatattatcacactgaggttaggatttcaacatgaatatgggggagacacaaacatttagtctgtaataattgataagtgaaaaaagaaaaaagacatacaagcatagaatgatcatttccaaaaaagaaaaatttctgtacatatatgtgtgtatttatatgttcatatataacataggaaaaaaagagaaagtgtatgacccagtctgtttccaactacatctgtgcagtgggagtaggtcaggaccttttatggcctattttatttacttctatattatagtatttatttttatagtgggtatgtttatattattaaaaataaatccaattaaaatttccagtccttttaacaatcacatttgtttttatggcaaatgactctaatatgggcatttttttttccagattttccagttaatgagatacttgagatgcaaaatttgttttgatttagaccagtgaattaagattaggtactcattaaacgactgtgaaagtcctttatagataattttgctttatagataatttagtgcttctagtgaaacaaatttaactgatggccttagcttggctattgttgaagaatccttcactgttaggctcccctgcaagacttccctcttcagcacttgtttttttttttttatttttttttattttttattttttttttatgtctatacaaaatatttatttttttattatactttaagttttagggtacatgtgcacattgtgcaggttagttacatatgtatacatgtgccatgctggtacgctgcacccactaactcgtcatctagcattaggtatatctcccaatgctatccctccccccttcccccaccccacaacagtccccagagtgtgatattccccttcctgtgtccatgtgatctcattgttcaattcccacctatgagtgagaatacgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtacatgtgtctttatagcagcatgatttatagtcctttgggtatatacccagtaatgggatggctgggtcaaatgaaatttctagttctagatccctgaggagtcaccacactgacttccacaatggttgaactagtttacagtcccaccaacagtgtaaaagtgttcctatttctccacatcctctccagcacctgttgttccctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcacccactttctgatggggttgtttgtttttttcttgtaaatttgtttgagttcattgtagattctggatattagccctttgtcagatgagtaggttgcgaaaattttctcccattttgtaggttgcctgttcacactgatggtagtttcttttgctgtgcagaagcttcagcacttgtttactggtcacatgctttacacagcactctgcttagattttgcctttgaggttggccatctcccttcagctgctctgatttggaagaagggcgagggttgcagctttccctgagatagggtgacctttttttcccttctgtcttcacatcctaatcacaccacttctaactggatacgaatgtcttaactgtgaaaaactgtgagttctctgtcagaaatgaatctctagggcttcccaagtggtaattatttcctgtgagagttctgcttttgaaagtgaggtttctctccttgacctttaaccctcgttactcttctgtgttcccagttggttcgactatgcaatgagggcgcccggaagatggaaaggactgagatgatgtacacaattaactcccagctggaatttaaaattaaggtattctcgtaccttgttcattactgttcttgcctatgtttttctctaaatagagagagacagttgagggcaacaaagtagataggaaattgcttttcaaagaagggtcataaattgctaagagggagtagcagatgcttcaggcaattttgcttttgcttgtaccagacagagtgaccttcctccaggccctgaagccaggcattatctaagaagcacttttttttttccaggaagacaccaagcttaggggaataaataaaataatagaatagggtagttaaaataatagaattttagaattgaaaggagattccttcattattctcaaaatgttctgaaaaacagtaatattccatgagctggaccagtgttctcctaaattaaataaggacactccttttctcgtttacaaaacagatcgttaatggataatttttttcaagtttgtttttctctcataatttttttgaatatgtgctgcttgttattccttgtctgatactgctcttgagcagatgacaagatgaacaaaaaagaagaaaatgacagctaatggcaaatctaggtcatggccattcttttgttggctcatggctgagtttttaatgggaagtgagtgctcacgattgtgactctattgttttataacttgtaaatgtaattaaacaattttaaatgactggtcatatttttccctagtaaaagtgtttctatttcatgcagtcaaattatagtgatcagcatttcatggtattctgtaaagagcagattctctgccatgtcatgtagtttgaggattactgcatgcttgctttggcagcatatatactagaattgaggatcactgatatagtccagctacacccttttattttatgaatgaggaaaagaaacccagagaataattgtcagcagagtcacttggctagtggtgataaaatcaggactaaggtctagatgtcctgacttgcaggtcagtgtaaactcttctactgtaacattctgactctaatggtttagatgcagaaacacaaactgtaaaagggaagaagatgggtatttgccaaaaaccagacacacatgcacacacatgcatgcacgcacactttaaatagttttaatgttcttgtacagaattttatagcaattaaaaaacccatctttctcccaactctcagaatctcgttctctctaatttgtttctaaatattttggaaagtatatctgacaagtttgttttttgttttttaatttcctccttttgaaagatgaaaaattccctaaccatttttcttttcccttcttcactgaaagtcacttggtataagattactttaagaaactctgtctaggccgggcgaggtggctcatgcctgtaatcccagcactttgggaggccgaggtgggtgaatcacctggggtcaggagttcgagagcagcctgaccaacgtgatgaaaccctgtctctactaaaaatacaaaaattagccgggtgtagtggcaggcacctgtaatcccagctatttgggaagctgaggcaggagaattgcttgaacccaagaggcagaggttgcattgagttgatatctcaccactgcactccagcctgggcaaaagagcaagactcttaaaaaaaaaaaaagaaaaagaaaaagaaactctgtccagtacccaaaattaatttgtaattgaaaaatgctaaccccaaggatcattaaaagtaagtgattaactgaggtcaggagatcgagaccatcctggctaacacagtgaaaccccttttctactaaaaatacaaaaaaattagccgggcgtggtggcgggcacctgtagtcccagctactcgggaggctgaggcaggagaatggcatgaacccgggaggcggagcttgcagtgagccgagatcgtgccactgcactccagcctgggcgacagagcgagactccgtctcaaaaaaaacaaaaaacaaaaaacaaacaaaaaagtaagtgattaacatcagttgagttcctgagttttggttgttttcattcaatgattaaaatatttgcgagcataaagtatggatttacagtggagcacctcatttagaacacttagaattactaattattactaattggaaatactcgtaaaatcttaggaccttataatactatatgaataacagtggacatttctatttaatttattttaatgatgataaaatagaggttcaatgaggttaaatgatttatccaagtacatggcaagtattgtaagaatagagcagatttactgagcatcttccatgtggaaggcagtagataaaaacgtgatcatccctcccctcatagtctagtagaagactgctgaaaatcaaaggagtcagcaaagtctacagctgtcacagtagctagaagactatggaaaatactggaaatggaagggagatggacaactctaagagcaagagacagagagggctgggggacttggagcagtctggcaaggcttaatgccagaggtgtgtttgacctgaatcttgaaaggtgagttaagaagggccttagagcagaaacaaatgcacagtttccactcctgtggcccaggaattgtaagcattcagtgtgggtagacttggggtgcaagaggagcagggtggagctacagtagcaggcaaacactcctgcggacagccctgtgtaccaagaggaggagctgagtgaggtcatttgggagccaccgaaaagttctaagcagggaagtgaagcaatcagatgtgtgtttagtaaagacaacttcagcaatggggaaaggcttttccaacttactccaaatccagaagtcattaaaagaaaaaagtcctaattaatctatataaatttttaaaaaatttctctatagagggaaaaagaccatgaaaaaagtgaaaaggcaaatagcaaactggagaaaaaaatagttgcaactcacatatagacaaagggtaaatatccccgatgtataaaatcaaaatgataagagaagacccactagtctacaagccaaggagcaccaaagattgccagcaaactaccagaagctgggggagaggcctggaacagattattccctagcaccttctgagagcctggccttgctgacactttcatcttggcctgtcttccaaaactgtgagacataaattcctgttgtgtaaaacaaaaaaaaaaaaccactagaaagttgcaaattagaaaactgctaccagaaaaggaaatccaaatgatgacaaagttttgaagatgctttatttcactcagaggaaaattgctaattgaagattagcagataaagataatgaacttcaccttttagatttataaataattcaaaagtttgataccccattttattgatggaattggagaaaaaggcatttttatatgttgctggtgggaaagattgttttaccccaatggtgtgcaatttggcaataactatcaaaattacaaatgcaagttactacaactcagcaattttacttctaagaattctacagatgtactcatgaatgtataaaattaaacacacactgagctattattatagtgttgtttgtaatagtgaaagatgaggaaaaacatctaaatatctatcaaagaggattaattaaataaattatagtatacgcaaataatgtgataccactcaaaagaataaaggagaattttagatacctatatggaaagctttcttatatattattaaatgaaaaaagtaaggtttagatataaaaaaatacagtttgcttttgcagatgaaatatttggacagatgcagatgaaactagttattggtcattacccgtgaggggcagtggtcagggagtgggccttgtcgggttgactgggtggagagccacccactcactcagataggaaattcaggaggaggaacaagttttgggggaaggtaatgagttctattttggccatatttggtttatggtatggccataggtgctactactatgagaatattggttgcaaatttactaagtagtgccattttcacatttatctgatttaattctcacatgaaccctataatgtacccttattattaacttcactttatagatgaagaacctgaaactagagagattaaattctttgctcaaggttatacaccaagacgttataaagtctagattcaaatctttgactccagagtccacattcttaacaatgactgtatgataatgataatatggatatttttctaatttggaggaaagtaaattttgtagggcatgtgtgtgtgtttttcattgtcatttcacacgttttttatttttaattttgcttatgattttctggaagactgtcaagtgctaaactgcagtaatatgagaggagatggaaagcatccctggattggcactttggaagctagtgtaaagttagagcacaggctccagaactgacctgcctgagttgcagtagaagctccaccacttactagctgtacaaccttgggcatcacttaccttttcatgtcttggttttctgaaccctaaagtgaagctgatgatagtactttccctcatggaattattttgaaaattaaattatttaagagatataaagggtttaaatagacctgatttatagtaaacaagcagcaaacattgttgatgtgttttatcagagtagttaaatagatgtgggtgcattgaagagtgagtgggatgtgaagcagttgaagcagattagacttttcattccagaagcttgactatcaagaggatagggcagtgatgataactagaggattcacaaagtcaagggaccattttttgtgaatagtcttcaggatagtttgcagaaagggagccaggagggagagaatactaatgagaggggaataaatcaagggaataaggccttagagctgaaaacagggtgttgaagacaggagagcttatcctctgagatgggaggaaagaaaatgatggttgtagagaaaaagctggtcactaaaccaagaagatcgaaaaccagagattagtttgtgtctcaaatccagtgttttttctccactagaaaacagctttctttaaaagttgcctctacagagttgggaagaattttgtttttttgtcttgcgatggaaagtttgaccttatgaataagcacatggagaagttgaggtttctcaggctgctttaggagacatacattcagtgtgattgagtggagtggtggtatgttagttgacagaaggctttgctggttgccatttgggggccttgctaacaatggaaatccaagaaaaatctttgtgctgtagaggacagtttgttagtttcccaaaaatctaaacataagagttactactatatgacccagcagttccactcctaggtatatacccaagagaactgaaaagagatgttcaaaaacatatacacaaatcttcatggcagcattgttcataatagccaagaaagtgaaaataccccaaatcaacggatgaattgataaacaaaatgtgatatatgcatatagtaaaatatttaggcacagaaaggaataaagttcttatacatgccttgtggatgaaccttggaaatgttatgctaggtgagagaaaccaaattcaaagatcacatattgtataattccatttatatgacacatccagtatagacaaatccatagagttagaaagtagattagtggttgccagatgcttgggggaggaagagtggcagatgactgctcaatgcatatggggtttccttttgaggtaatgaaaatgctctggaattacataatgttgattattgaacaatattatgaacatactagaaaccactgtattctacaccctttgaagtggtgaaatggtgaatttcatgttatgtaaattttatctcaacattaaaaaaattatttgctcttcagcagctctctcttttcttgctgccccataaaattagttacattttatgccaaggctagctttctaggatgccaggtaatagaaaaaaaaaaatgaaatgtctgtgctccataggcacagactatttcagtactatttaggatagtatttcagtactatttaggatatatctttgttcatgaatttcttttctagtttctggttcacacatggattctagtctcagcatttccttactaggggaattcactcatgctcactttgggctgttctgatttcctttatttggatcattttaatatctcttctttaataaaacctatctgattgagttcagtcttctaacaataaatctgaaacataaactatatataaaatgttgggcttttgttttcaaaagaagcatagatgtattgaaagcttttgtcaattttaggtgtttataggtagaaatttagttttgcccctagtggagtatgaggactccataaaaatgaatctgctttaaaaacaataaaacaatttaaaaatctttctttctccaccccctaaatcagaacagtcacagggcagcatgtgcactgaaacttaaccataatattgtccttggttcatcttgtagggttatacgcaatagcaagatagtcctgtgtttcctgtaattccggcccttcagccggacctaccctgacacaaggtgacctcttgtatgtgctgcctagtctgccggagttatctaagcaatctgtcgacctttaaggtttcagctgtctctgtagggtaattgtctgatttcgagattttgggggttgggaacttcataaactcccttagcagccagttttgaaaagtttggggttagccataatcttttatcttcgttttttggaccttcaggaaaatagtatataaatgataagcaaccttcttataaaagctctttataaagtttaaaataaatatgaaatcctttcttagccttctcatttcctctctaatatcctcaatttcctttagctatttttaatcattatttcctgaaaagggtgatgtttgattgcatcacatttctgcattatgttttgtgtgtccaagaacttttgcttattttatggatgtagtcttttaaatcagagttttggcagtaaacatttctggtaacttaaaaaaaaaaagctttcaagggtaaggattgttctgtagttttgagagttttccagttggcttgtacaagactgaataaagaaaataaaaaagcagtatgtaattttttggatacagccttttctatgatattataatgattatgatggattattttggaagaacctcattttcacagccagaaagtagtatgatgctttcaggtacaaacttccatgaagcaagctaccatgatcttaagaacaggtgttctcaagaatatggctaaatagataatttgtagacaaaaaaataagcatgtaggtttttttctcttgaaagaaacctttttacttcatgaagtaaatgtagacttttatatttgtctcgttaacctatagttgtgtttttctgtatgtttagattctgatttgagatatttaaaataactagttgattctgatatattttattactaggcttttcaattgtaaataactccttactttctttttcagttaagagttaatagaagggtcataattttttattgatccaataacattttctcattgagttttagtttcatattgggaagttaatagttttttatagtggaagatatattgttctttttcattttttcttgaagaatgcactgtacttctgtatttatagttcagttttatatgcctataaaacaatgatgcatactatgataagtatcatttgtttgaatgtacgttttagcttttactttcagtaaacttaaaaggatttcaatttagctttggtcactgggtttttctccttttgtagccttttcctttagtctcctcttcccggtggttggtaaaaagaggtgaattgacagcctatgttgaagacactgtgcttttctcaagaaggacatccaaacagcaagtctacttctttctctttaacgatgtgctcattatcaccaagaagaagaggtaagtctttatctggtgttgctgactagacattccagttttaaagttctgtaattcagatgcctgttagggtgatcatcctttaaaagctagaaatgttggaagtatagtttctacatactgaatcataattgcatctatggttcattttctttaaattgcttatgtagtttcagacgaatcattatctgcatcataattcttgccaacctctattgagccactgttctaagcattttacacatttatatcattcaattcttatgatatccctgagaaggtagcactgtttttattctcattctgtgtttttcagactccttctaccataaaatttttgtgtaaaacagaaaaaagttggtccagttgagaacaggttggggagcaactctagtgctccttttaacttaatttaaaatgcactgcttttaatgatccttagtctaaaacattcccctgtgactgggaaggtgttagccatactcccttctgaagggaatgaagtaaatcatttgattggcagagtgtttgttcttcttactccaggcttctagttctgtgtttgtgtccagctctggtgagatgtccatgaagaatattgtagaaaccttttctttccagtatttcttctgtcagactgtttctgttctacacacacacacacacacacacacacacacacacaccccttcagctctgcctttctctagggaacatactttattaaatgcacccaacacatgtaaggtcctatgtaaatattccgtctttcctagaatatgaacttagagtgaaaacttaaatctgtgggctgttatttccacatatgagggaaatgatggtggcctgaattgatggcatatggtgggatcaggggtggtcctggggtgcaatttaggcaaggtgaagagaattatagaaacagatctctatgaaaatacaaaataaatgtccaaatgtatcaggcatatttaattaaatgctagttctgagttgctgactttatagcttgaaaattcaaactaaattaaaacagattgagttcttctttttgctccttttaatcagaccatattatgaattatttcagctgagtggctgtctagctgaaatgaaatgttagtatggtcttccctgagaagccataatgtgacaatgatacatacattaaaatgctgatcattatttttcatacttaggaaaattctatttccatatctccaaggagaaattacttctcttacctggagtagtctaaatagttctagcagctaagtaaaaatttttttttttttttttttttgagatagagtcttgctgtgtcccacaggctggagtgcagtggcgtgatctcggctcactgcaggctccgcctcccgggttcacgccattctcctgcctcagcctctcgcaggcgcccgctaccacacccagctaattttttgtatttttagtggagatggggtttcaccatgtcagctaggatggtctcaatctcctgacctcgtgatctgcctgcctcagcttcctaaagtgctgggattataggcatgagccactgcgcccagccgtaaattttataaagaaagatgggagaagaattataatttttatgtttttgtgttttgttggtttcctatgagatagcatttttccttggctttctccaggatgttttgtttttaggggagagtagttatatatgtctcttcaaatgccagaactcttgacttttaacatcttccagctgttgaaatatttgttctgtctcagtagaccaagagctttaactaaaatttgatttaaatggtaaaatgtacactgacagtaccaagccaattttaaatataaatgtaatttcgattatgatgactttggtgacttaatgaaaatattaaaggtatttaaaccagtacagtgcaacttttgttcttgaatttgcacagacctactcaataaatatagactattgaaagtcagaattaaggtatatgctcttctacttagtagcgtactttgcccttcacagatggtgttgctctcctagctatcccacatttatttgctcaggtaaatttgaacttgtattattaataaagagcaatgccattgggagtctttgagaattttttttttttttttgagacgggcgttttgctgttgttgcccaggctggagtgcaatggcatgatctctggttcactgcaacctctgcctcccaggttcaagtgattctcctgcctcagcctcctgagtagctgggattacaggcatgcgccaccatgcctggctaattttgtatttttagtagagatggggtttctccatgtttgtcaggctggtctagaactcctgacctcaggtgatctgcctgtctcggcctcccaaagtgctggaattagaggcgtgagccaccgcacctggcctttttttttttttctttttcttttttttctttttcttttttttaagagcaagatacacagctccaatggagaggacaacctgagtacctaacttggcctttaccaaaactagaattttttttttgccttaccaattagttcattatatttctagggtgttcttaggtaatagtattggagacctaattgtttatgacctgaatatgtggtgaggttacatgcaaaccacagaagcttcataaacagacttggttaaaaatgtacactatgcctgaccgtatttacatgatagcttcaaggaggcgaactgcaaatgctttgcatgccagaggcaacagtaaaggagatacaacaaccctgaacaaggcgataatttaggcttggccacaagttacagataaaggaaaatcacctgtgccagcgcttgaggactgatctagccacccactgcctaattctaattccaggtttcagtcaaggaacttagcagctgggcttccagtggttttcctcttcagggaggtttttcagctactgagaaaagctgctcgggaggacagttactcttcctcctccgatccagactggcagaaggtttatactgggcacattccatagattgctgaggtgtgtggaccccctccacttcacagtgcatgtatcactgcttgtgcttgtaaagctggcttgatgagtggccatgacactgtctttgtgacaggaattttcacttttttagaacattaaaaacaagcttattttaattattaattttttttttagagacgggaccttgttatgttgcccaggctgcagttcagtggctattcacaggcatgatcatagcacactgcagcctcacactcctgggctcaggcagcccttccacctcagcctcctgagtagctggggctgtgggcatgtgcctttctctttacaagaaagtttaaagttttcattagccctggctgctagtgagtcactctgttaatagcctggttctaccagatttcaaaaggatacatgattgattactctggatgagggatgaggacatgaacactttggtatttgaagctttgactagaagttatctgggtactgcaagagcagacttctcaaccttggcacgattgacattttggggcctgatgtttctttgttgtagaggactgtcctgtgcaataatgtaggatgttttagcagcattcctcgtctctatccactgttcgctagtaacagcccccttacaccctagttgcgacaaccaaaaatgtctctggacgtttttgcctaatgtccccatggagcaaatccctgctagttgacaaccactatactagcatggtagtaaactaaactagctttgcctttggagtagtgaaggtgtgaaaatctatcagactgacacagcaagaatagtaatattgtattataaaagtaatttattgtcaagttatactcatagattaacaaataacattataatatccaatatgtgcctactgataacttattataataaagatgaattacagactgtaccttcatgtataacctatggtctaaatactgttgttcctagttttgaaatacaaaactgaatccaagatctaactaggttcaagctactaaaagatttattttgtaagatatagtcccttctatctggcttaggtcttctctaccaatatcacctgaagctgaaagcaaaattttccttcctgtatttgtttccttactgtgttagtttcttacagctgctgtatcaaagtgccacaaacaaagtgagtggcttaaaacagtcagaatttattgtctcacagttctggaggccaggattatttccatttcacagatgaagacgctgaggaaaagagagataaaatatctttttcaaggtctttcagcagagccaggattctaatctgagtctttgtttccagaggctcaatttctttatgttcattacttcttcattttatttttctagaatatttcacttttcccctcatcctataaagttattgggggaaaaaagcatagaaacttacaacttttttgtttgtttggagaaacatcttttccaaagtaagcttttgttgagtatttttatagttttactggttgtaggagaaaactagaaccagtaccaaatcatatttgtgagttttcctctgccattagctaatctagcatcagaatctggggaagagtttccctttgttaacatttccttcctgcagacatttaagacaggagatttctacttcctgatttctggttccataaatactgtgtatagcttgagccctggttacaactttctaggttttataaaaaggttttcaaaatttttaatttttttttcaggttttataaaattttctgtaatagcaaactactaggtcattatcataaggtcaaggacttaagttcaaatttggattttcccaaatagtttgaacacccagtggctcaaagctgtgcaggctcccttgaaaggttcatggcctggtttggttccattttttgctttttccatgagaatgctctttcctattatagaaagctgaaaatcacctgatacctgtttcatctgcagaataaactcgttcctagggaagtcaagagtatcctggctaaaggaaaggcagtaaaaatgattgcaagctcctttgttcctgaaacacatgaagcttgcttatttctgaccattttggaattgagttctaaattcaagatggcaagatggggtggaaaagaaatgggagccctgtttcctttttgctcctttttttcttccgctgtcatttgcagccttgattcctctgatgttatgaggtattgtttcccctgcatctgtaaggagagttggcattgctgttaaatgttgaaagctgccactactgagaagcacaatatcgatgcctggggtcagaaaactgagctcaaatcctgggcaaattacttctcgtctctcagagcctcagtgttctatctgtaatatggggataataacatcatcttcatcatggagtttctgtgagaattaaatgagataatgcacataaagctcttactacagtgaatatgaatagtcctgctaagtaactgatacatgctatcattaagattatttttggtattgtgttctctctctaaagattttgccgtaaatcaaattattgcccttctgcttctagaatattttattgtttttaaaaaatgattttaaacctttacgtaattgctacatagctgaaggtacggcacgctctaggaccagacatgaatttatggcctccagaacatgagcagtttaggaataaatgcctttaactctatgcctttccctcctcatgaaacccatgtcaggcggcaagtgagtgaggaaaaactattggtcaatttttattctttataaattggtgtaaatcatgtgtacacgttgtagtagcagttttttttttttttcactattcctaaatgactaggagacactataacattgttgctgaaaaatgtgaaataaatagtatatttttcctttttattgatgtcgtcagtagtgtggtactcctgaattggagtgtggggttgctgtataatttggataaccttgttacccacttaagaagctgtgcctgctcttcagggcttgcttagttcagcttatcccagggagagagcttcagaaaggtggtgacagcctctcagaactgtccatctcctctttttcaaggactatgggttcagagcatcccatgagcagccacagaagtgctgggctgtggcatctggtgacccttggtgacagggatggggcttcctggcccttttctgggtcactggccatcttttttggtggcagtcatactgatgaatggggatcctcatctccactatttgttatattattaacaatgaaataggatgtatgtggcatgtttgttagacttcagaattagcttgaggaactgagcaagtaagcctatttgaaatcagtttctggataaatattgtgccttgttttgctggtctgagcacttgccaaattgtggatttcttgacatgggtatttagctctaattatgcttggtccacttgtgcatttgcaaaacatataattatcaggcttttaacaaaatgtcaggcaatttaaatggatggcgttctgttaagaaaataaaaaaaatagctgacatttactgtaagtcaggcatgattgtaagtgccttacacacaatgaggtaataaatgtattatctcatttaatcctctcaacaatccagtcaagttggtactgttattcccactttacagatgagaaaactgaagcacagagaggatcagtaacttgctttggttcacaaagccagtgagtgagtgggtttctttctttctttttttttttttgagacggagtcacccaggctggagtgcagtggcatgatctcggctcactgcaacctccaactcctgggttcaagcgattctcctgcctcagcctccggagtagctgggactacaggtgcttgccaccacgcccggctaattttttttttctatttttagtaaagacggggttttaccatgttagccaggatggtgtggatctactgacctcgtgatccacctgcctttgcctcccagagtgctgggattacaggtgtgagccactgcatccagcctagaattgggtttcttaccagacattccaaatcatggctctactcttacctgctgtgccatatttcattcctttaaaattgtatattattccactaaaaacatgttagtagtataattctaaaaccaaattgaaatggaaatcaacctcagtcaagtgaaaaaaaatttttaactccttgacttaaaataaatttcagcataaattcaatgtccttcatcccagcaaagtttgactagagtgtttctgttccatttaaacacacgatcaagtgcgacggtttaggaatcatgttttttagaaggagaagggaaacaagttgaaatctacagaacactttttctcatacatatattggaggaaagtaggaagaatttcctttgatctcataaaccccattaactcctgtgtatcagtgctactgggggggaatgtcagagccattaaattcctcagagggatttaatgcacgacagtctagaagaggatcttggagagtgtccccaaagaagaatgacttagaaatgtcacagaaggcattagaagatagagtttcaggattcacagttgctcagtgtcactagattctgtatacatgcaaagagaaataatggtgaaatccaggtgtttaatttggtggggtgatgggccatggtggccttcggaagccatttcactggcctgtaagcacaagggtctgaaaaaacgcaggcagctgctaactcaggaaacatttgttgtggcaccagcacattctagtaaatatttttttcgggacagaaaagctatgtgaatgttctaaagcctatggaaaggaaactactgaataggtaaaaaataaatgtcactatcttgagaatatatgccaaaaatcatatgaatatcaatgatgtgataaatctcaatagcatcttttcttttaaattaaacctttttacaaaaggaagaactggaagtgctgcttgggtttccatctgtcggatttgggccataaaacagagttttaaaacaatgtaagcgggtacgtgagagttacacctacagctggggctgagagacgtgggttgtgggaaagctggcttgtgcagtctaaccctttcccttgcctccccatcaccatccttcctttcactatcctgggtgcatcttggtaagctagcctattttccattcctgttcatccgtattaagtatctaaaatgcttgctaataaggattaagatgagaacttgccctaaggtatgtacatgtttaacagcacctctctgaccacaaggcaggccgttaaaggtctgtatccagcagaaagacctgtcttgtcacttagtttttcttcacaactctttatgtacccagagcttgggtccaaggaaatatcctggtttaaggagtgagattgggatcaacattttaaaaaaatatttgatatgtttccccaaatgtcccaatattatttattgattaacccattaatttttttagagatttgaaatgtcacctctatatccccagacatgtctgtgtcaactcgcaaacccactattctgcttcacaattcatcagtcaactcgtgcccttgtcccagtctttgaatttctgcagctttacagtatgtttattttttaattttttaattttaattttaattttttttgaagcggagtctcactttgtcgcccaggctggagtgcggtggcgcaatctcggctcactgcaaggtccgcctctcaggttcacgccattcttctgcctcagcctcctgagtagctgggactacaggcgctcaccaccgcgcccggctaattttttgtatttttagagacggggtttcaccgtgttatccaggatggtctcgatctcctgaccttgtgatccgcccgccttggcctccctacagtatgttttaatacatcataaggctagtttattcttttttttttccacaatctttctggctatttctgcatgtttattttttttccgtgttttacaatcaactcaactatttctactccctgccatctctcaaaaaacccttgcttgtgttttcactgggttgtgtttaaattatgtattaatttaggaggaattggtatcttgataatatcaagcttttctattcattaatttgggccttcttctaaagttgtttaaggttatctacatatagaagaaacctgttaagtttaatccatattaagggttttgtgggttttgtcataaagtgggttttgtcataaataaagtgacatcttcattttatattctaactgggtgttattcatatatacaaaagccattttttaacacctaatcactttactgaattcactctcacttggtagtatattttcagtcaatgatgtcatctgcaaagagttagttgttagagggcagaaaagacattccactatcaggtagtcacttcagttgcatccttaagcagccacagacacctagagtgatgatagctgtcatatctatgtatttttgatgaaattcttgttttttacttttacttgtaaaatggttcaaccttgcagaaaattatcaaacatgaacatacctatcatccatacttaacagatactttttgccgtattagtgtcagatccctcctttttaaacaaaaaaaaatatataaaacacttcagattacccaaagtccttccaccctcagcccttcttcctcctcttctccagagtacctgctccgctgaagttggcatctctttattcttgtgctaactactgcagatacatatatggagctttagtatttttaaaatgtatgcaagttgtatgcaaatttttaaatgtcttcctgatttcaaagtaataaatatatgctcagaatgaaaattctaacctttatagaaattatgggacagaaacttaaagggcttcataataatctccttaagaaagccactgttgataataaggtatatcatttttctgcctttgatgttatgttgcgtatagtagaaccaaacactgacctgcttaacaaagaatgccctccagagaagaaaaaaacaatcagaatatgtatttaccatcatatcctgttctctactagtagttctttattttgttaaaaacaagaaaagaaagaaatctcaacaaaggttactaggaccttaagtggatttcaacagaggaacccatcactgtttacacttcaagcaacagacttatatagatttgattcagttgaagcacctgataggagctgctgcttgcacaaagcagacgccttgatgagcagctggtaaacttggagcacatataagacaatcaaaggaagtctccatataaacttctccatgcaaggaaagatggtttttccatttgcccttttctgagcactttaacttcctcattacatgttccaaattgtttcagagactatataaaccatatgtttgttaaacgatagagacaaacatggggaagtctgattagcatcagcttccctcaggaagggggtttctttcccaaccctgtttagcctgctccatacttattggacatggggtaaataagcagagatgggaaacgggctttaaacagctgcacctggctatagagtttctgctcctctttctactgaagcactactgttaaatggaattgtttctttttatagtagatttcctaaaagagcagtaaggaaggtgtaaagacctacattatttattgcataatgcagaagtttactggcctagacgaagtaatgatattggatattgggtgatagtaaattactttaaaaacaaacaaaaaggccaacatgtttcctgcattttgttttggacccagaagtccagtgggccaagttccttgttcaggcatattcaatgacacaactatgcagatgtgtggaaataaacacttgaggtgaaatcatatagctgtgattagggcagccacagtttatcattcaaactggacatttgagaggactacaggcataaactgagcccagcagccatcctgggtcttaatcagtggcattgtagttgtcattgcttaagagaacaattaataaacattttaaaaaagtatctacttctgtctttatcccccaaagacaagaaattaaagcatttatgactgaaaattgaaaaagaagctggctgggtgtggtggatcaggcctgtaatcccagcactttgggaggccgattacttgaggtcaagagttccagaccagcatggccaacatggtgaaaccctgtctctactaaaaatacaaaaattaaccaggcatggtggtgcatgcctgtaatcccagctacacgggaggctgaggcaggagaatcacttaaacctggcaggcggaggttgcagtgagctgagagtgcaccactgcactccagcctgggtgacagagtgagactccgtcacacacacacacacacacacacacacacacacacttaactagtttattcatattagcttatattcattttctgtgaacccttggttttgaattctattgggatgacttgataggtgaaaccactttatgttgacaacattttcgaatttgagtcatctcaaatgatgactttatagcatattcatttctttgacttttatttctttggaaatacctacaacgcctacacacatgtcattgtttagggccttaccccatgttcacaatattaggttgcttccatttctctttctgaagcagaattgtttttaaacagaaacaggtgcctttgactaacaggttttttaacttgtaaattggaccaaaagagtaatcataaggggcagagagaaaatagtaacaaagaagcctcagttcatcctctttttctcttgtttttgatgctgttgttgttgaggttttgttatgtttgctgttttatcctggttttggtttttatcctgagtcctatgctgttcaatgcatgtctgatatagtatctatacaacatgataaacttgttctgtgttgctaaaaattgactgctttgtttctagtaaacatagtcttttaaaaaatgaccgtatttgtttgtaaagcgtattattcaccttcctctttttataaacatcatgtctactttgataagtctcattttggatgtgagaaatatttgacatatccaagtgtgggtgtgctggtctgtaggcagtctcaggagaactttggagataatcgtgccacacaatcttttaattaatacagattactatcctaggaacaattaggcttgatcagaaggcaatattttgcttttatagataactgcatttgctgttttttgagggcagaatctatcaaaccaaattttagaaaagattataaagtttttcaaggagcatgacaaaagagtggttgacaggtagatgtccattctgaggaaaataaattccaggaaatcttgagcaaagtggcctgttctgaaattcctcctagtgtactggactaggcacaaggagttttcttttctctaagctcccctgacatcattcatttgcatttattattaaatgaggtaattattcgatattcctagcgtatattagaatttattgcatattcatccacttatgtgacagttatttattgagcactctcatgttcactcgcaagggtgcaggtgcagagtagaggaaaagctgtatgtcaccaggttcgggatttgccaggcaaatacaatcaaggagatgaatgtgtatgcaagatgtgatttaactgggtaccaagaaatgcaagctagctaatttaatatgcatgaacaagaggacatgagggaattaagggggggaggcggaaggttgtagagtcaatgggttgtaagaactggtgagttaaataatggttggtgttgaggattagaggaggtgagttggaaagaaaggccatgctggttagagagtggtatgtttgacactgggattacagagagtttgtagttgatggtaatgacaaggactaaggtataaccatggatttgtggctgaagtagggcagaaaacaagatcatcggaggagagtaaagtcggggaattgagggtacagggtaatggaaagatcctttacaggagacttcaagaaagaagtagtgttggggacttgatgtaaatgaccgagagagagagggagagagagagagagagagagagagagagagagagagagtgtgtgtgtgtgtgtgtgtgtgtgtgtgtgtgtgtgtgtgtatgaagaagtattgttggagagagacagagagccagcagtgaaactcaagggagaggatcggaaacgatccaggggtctatagatgactgtagttatgagttagagactgatgccatgagcttcaaagctgatgatgtttcaggaggaggaagtgatcattgtatagaagcaggaataaaaagcaagcaggcagagagctctcaggagacgccttgttctctagggagagccaggtttcttttaaggcaagaatgtgaagggagggttcagagacgaggccaagtatttagaagactttactagtttcttaaatgagggaattgcattcccagagggtacagtggaaggggttcaggaaccagctgaggagtggaaaaaagtggggccagattgggcatgttcacagtgcgatgggaatgggagtgcaggagaaagaaggatattggggttcctgagcctaagcaggaatggagggcataatgagattagtcctggtggtttgtgaaacaggtggtgaggctctgagtgtgggacacaaggatgggttgggtgtcttgccagaagcaagcagacctctggggctcttctcttcaatgcatggtcatttggagatggggggtttggggggtgaggtcttgttacccagagcatgagtagaaggctcctccttcattctgcaaatagagatgtggaagctggggaggtacacctgctggagcatgaccaagatgcatgtaaggatgcaaggatcacttattataacagttccaggatgatgtcaatacttgagatgcaatttagtgtgttacatccataaaaatagtaattaggtttaattggagggggttacattgattcataatcagtagatagaattcaaattccaattcatagtttaaaataagtcattctttccctctccttcctgcccactccttgctgtttccaccaaaatgtgcctcgaaaactgacaatgtcagtcttatctgctgaataattgacgtgttcttttccctttcctttacagtgaagaaagttacaacgtcaatgattattccttaagagatcagctattggtggaatcttgtgacaatgaagagcttaattcttctccagggaagaacagctccacaatgctctattcaagacagagctctgccagtcagtcacctctttactctgacagtccttagtaaccacgcgaatgagaaagtggagatgctactaggagctgagacgcagtaagtatatgtggggaaaagattggaatagctgatagtatctccctgacctgattttctttggtttacagacttcctaaaaacagcagctactattcatgtttttgttgagcacctactgttcgctaagcactatgactgggtaatttttacagatgttgttcttttcattgtaatcttcttacaggagaaggatgttgttattttttccctataagtcctgatagatgcactgtgctttaggtgatgtctttatttttatagagtggtttaaaaatcattttacttttttcattgacaaaaatatgatacactatccttaaggaatatgactcaactggtattttgagtctaggccataagccttcttaggtaatggaattcaggtcgtttctcagtcacctaccttcaaccagagagcagaaagcccaatgatttctgtcaaaagagctacccagtttacggaaatatactgataaatcctctttctaatccagagtttatgcacgaccaaaacaggcgtcctgttggtgcctgcagtttcgccagcagttagtgtgcacttagttctcacattggatgagtggcagtgagggttaactttcaagtccaccttagtgattttttggtccacttaaagatgactgaccaatgtttttgtttagaaactggaaacttcctcttgcaataatcatcatgggcagatattatattgggtcagagagtggaacagtggagggaaaggagaagttccctaattctttgtcctctcagattcctgcctccaactccatgtctgccagggttcctaaatggtgtggttaaaatggatcagcagctgatgaataacaaccctaaaattgtagcaagatcttagagaaagtgatcccaaagaggtatcttcaccttaagactgattttaacagtgttcctagatgattaacgagaatattcaagaaaagttattgaaggacacttgctaaagcgcagtaagcttcgcagcctttatgcaaggtcatcttaacaggcgtaaggaccattgcagcaacgtctccagtaggggagagagattgggctcaacttccaacacagcatgggcaagtgggaattcatagccatagggcaggatggaggtcagtggatggaaacttactgagaggaaatatcagagataagggctattctggctaaactaaccaaacaggattcttgctgaagacaggccagggtaattagacatcataacctctgggatgatggagaataatgaatcttatcagatattgaggatggggtaggggatattcttgccaaattgacttagtagggttctttgctaaaactggattttacgaagaactgtacagatgagcctaggagaaggtacagaaatctaactgaagtttggccaagccaagaatctttgtcaagagacataagaaaaatgtgaaaattacaaggcacccacataaaatgtcaaattatttcatatcttttggcactagaagtagcatttcacaggctagagaaaaaaccaaggacaggttggtgaaagctgtagcatattccaaatgagctggagagttcaccaaggtaatgaaaaaagaaatatatttcataaggctacagctaccatagacagtggttcctctgatggatctgggcaaagtaaattaaaagccttctggaaaagattcaccatcgtagatgtcattaaaaacattcataatttcatgggaggagatcaacatatcaacatgaacaggagttgggaaaagttgattccaactctcatggatgactttgaggggttcaagacttcagcggaggaagcaactgcagatgcaatggaaatagcgagagaactagatttagaaatggagactgaagatgcaactgaattgctgcaatctcataataaaacttgaacaaatgaggagttgcttcttcaggatgagcaaagaaagtgaagttgctgtgagcattgtggaaatgacaacaaaggatttagaatattccgtaaactgaattgataaagcagtggcaaagtttgagacgattgactccaattttgcaagaagttctgcagaggataaaatactatcaaacagcattgcatgctatacagaaatctttcatgaatgaaagagtcaattgatgcagcaaacttcactgtggtcttaagaaacggccacagccacccaaaccttcagcaaccatcaccctagtcagcagccatcaaaaaaaaaagggagcttcatcttcatgtgtttgtttacaaaacaaacaaatgcctttctctgagatcccagagttcttcccctaaaggtgctgaaaagcgctgatggcattccaagcatgcccctctgtgtttgcggctgtggggaggtgagcttgggtgggcgtgtgcttgctgatctgtgaggtgaccagcaagtgacacacccaagaccagggtcaaggggaggcattacttgaactccaaaagtggtttaaacctcttggccagtgaggacaaactagacttcctttgtgtggggaaacttctcctcaaaacagaatttttagtatgcctgtgctttggattttatatgactttaaggatgagaatgactttaacactttggaaatcagtaattttccagtgttccagagaattctcagaaactagagacttccctttccccgtatagttagtaatggtgaaagtgttgctggttttgccttgtgttttccttttctttggtttacaaggattgtttgttctttattcaggccttgccaacatctcaacagagattttcctgactgtctcattcataatttatgtagtctccaccactcatttctgagatgattccaagagagtaggaggtgaactgacatgtccagcttatttcacgccaaggctagatcctttcctgggacattctgtagcatttgttccatccttttgccttttaatcttgccaaagactgaatggttgttcgtttcctcaatcagacatgttctcagaatatttagtcatgtcacttggaaacccataggtctgactcatatttgtagttatttaattaatagcaagagaacattccagaaggggcatgggacagaggtctccttgggtacagagggagtgactctctcattctctttgctctccccacccccaccctcaattacagttgagaagtaaataaatggacatgctttcaagacataaaatagtattggtgttgaaaaaatatatttaacaactaaagacgcactttccttaaaaataaaaaagactattaaaaaacctggcaaattgttacatgccatgtttgcaaatatgcaggttagctttgggctaccgagttttgagcaattagagttttgatatgcatagaatgtgttattttcttccaacatttgtgaaatgcatcaataagtatatattgtttaggttttctttcttttatgtctttttggttaatatggttcattggcaatctagttgaaaaaacaaggtttgcactaccattctagccttaagtaattgaagaacttagagtcaggtatataatttcactacttactctttgacctgaaaaataatgaattttacacctaaatctttactttctttgaaaaactgttgtcactaaaggccacctgaggatatacaacatgtaaaatcagcagtaggaggggtgcagctgtttggcacaaggacaattcaacttcataagacagtgaaattgtggaagaaaaatcaatggctttgattacgtaaagaatgcagaaatgctcaccaaaaggagttggggcaaacagtgagcatctgggatatgccaggcactgagccagctatagaacatgacgaagggacccatgggtgtttctagaggaggacagaattttgagctgaagaaagcatatagggaagtgatcagacatcttggttttcccagaatcagttgttcaagtttgggtccgttgtcctggtgaaattatgaatgatactctttttgactctcaaaaggtcctcgtttatacaatgaaatatatggtgaccctaattatatataattataatattacataaaacaaaatattatcaataacaaattataaatatatacacatatttataattatatacatggtccaactctctcattttcttcccccatgtgaagtgactcacaaaggccatacaggaagtgagttattgccaaagctggaactagaatctggccttcctgacagtctagcagtctttctagtaacaaattttattctttttacggagaagctgccaaccagtaggctgttccacccccactttgctgctcagtttggcttgttctggatttggaaggaaacctccaggaagtcagtcgctattaactgtgagaaactactaaaatatagaattttttaagtccaaagactttattattttttattttattttattaagacagagtttcactctgtcgccggggctggagtgcagtggcacgatctcggctcactgcaacctccccttcacgggttcaagtgattctcctgcctcagcctctcaaagagctgggattacaggtgcttatcaccatgcttggctaatttttttattgttagtagagacggggtttcaccatgttggccaggctggtctcaaaactcctgacctcaagtgatttgcctgcctcagcttccaaaagtgccaggattacaggcgtgagccattgtgcccggcctcaatccgtaggctttaaaaaggaaaaaagattgtggaaacctagatgttaaatttaggatatcatatgggttagaatattttatgataaaatgctaaatagatattgcatccccaaaattattttccatgttaaacttccttttttgttcctttgcctgtgtttttcatacttcctggaatgccctcttcaggcctcctcagatggccagatggctcctcttagggcccatgtcaagcctttcctctgctgaggagcctctcagtactgcacactgcagtctcatcttgagaatgcccagtgctcgctgtgtgtgccactcattagttcacttttcccctcatgttttctgtctcacccaccctccactgtatgactccaaactcccagcctcctgctacatccttcctttcctttacagaacttctcaagagagtggccttcatttctccagattaattcagtggatttttgtcaggcacctacttcccatcaagtgttattctcagtgctgggatgtagcagtgaaccatacggagatcagatctctgctcttaggcttatatccaagtgaagaaccgatccccttgggcttcctgctcttaggaagggtgactttggatggaagggagctttggccagtctgcctgggcaaatggtctgcaatgagctaggatgatgggaaagtatttcttcatgatccagttaaaaataaaggatcatttcaggtagtggtaagtgcagtgaagaccctaaagctggtgatgtgatccggagtgagtgctaattggggggtggtgaggataggtactctaacttaggtggtgcagaaagacctctcttaagaggtgatatttgagccttgagtgaaaaggaggagtcaacccttaggaaaatgcagagtcagaatgtttcagccaaagggaacagcaggtgcaaaacctctaaggaaacgaatttagtgttctcaaacttggcttgaacatggagaatgtggctggagcagaataaaccagggagaggggtggcagtcaatgggcaacaaagtccagtttgtcttcagagctaccccagtgctgtctgtgggccatcagtcctcaagtagttaccagcctggtatgtaggaagcagtttgacatttctgaggcatcaaaacttgtgattattttaacaattaatttatttttactgtatttctaaaaatgcttggtctgcaatggattcaaggggtggagactggttctctaccagagatatctcgagaaacactgatttagaaccacataagccatagcaggaagttccaggaacaacaggggccctggggacagaagtttcagtggggcaaacaataagaaccctaaccctaatcctgttggagtagtcgaggggagtcccgatgttggcttggaccgtgatatgtaggaggagatagaaatgttatattttggagacaaaaacaacaggaccaactgatggattggatgagttgaggtggcagtaagtggaagagaggaatcgatgatatttagatttttggcgtgagctgctggcgtgagctgctagcttgagttgtttcttaatcaaggtaggggtacgtgcagtgagttgttagctagttgagttgtttcttaatcaaccttggcgtgacttcttcctctggcaccctgttgaggcctctccatcagattaacaggcttcctagtttcacacccagcagtccaatcttcctttctttacctctagtatcatttagttttattgaccatccagctctttcatgctaaccctttttttgagattatgtttttctcagcctcttatctatgctcttagtttgcctctcacacctatgaccattcctcttctctgtctcttcagaaatgcagcctgtccaaaaccaaacatcaacactgcccgtggctttccccgacacacacatttctgtaaatggtactattgacactcttttgcgttatccagtctggagacttggtgctgtttttgatgcttctgtgtcagaacagatccatcacctgccagttcttcctgtgtaaaagtctatttcatctttccccatctttccattccactgcctccttcctaggtcaaccacatggcttttgaactaccccaatggcctcctagccattctcctctcccatcaatacagtagttttatcactaatccctaagctcagctctagttttgtcctttccttgctttgtacatagcgagtaggttcccaataaatatttttgggattgacccataattattataactagcttttctctatctgagacaaggtagaagagtaaccaggtgtggagaaaaactgcttcctgtctctatttactgccctttttgttactgctggagcaggtttttcccaaattttacttgtttttcaattttttgctattaaggattcagtcaaatgttttttaggatgtacgtcgaagtcatgtatactgtgttatatctgtttgtccatgacaggccctaagtcatggtatcgtcaatgagacaatactctgtgaaaaatacagaagtctaccctttataaaaggacaaaggaagaatgttttaccactgtcattcttttttccctctgggcctttcaagaggaatgtgggagccagagagccccctttgtctgccttcattaaaatgaagcacagacagctgcagctggcacacacaacaggctgtggcaagtggagtccttggcttcctgcatttgcagtaaaatttagatgtcatttgggtgtagtgtataccgtcatgaaacatctaggacatgttcagtgatgaacacaaactttcctcactcattatatgtcagttataggatatgatgaccttagcccataatcaaatatccttctcaaaatttctccctcacagagctagaagcataatgaatgtggttggtgctgtcaaccatccagacaccaattcctgggcctcctgataaaggggcattgtttgcagggagtctttgagcttttcctgcttctgttaatgatttaattaacaacaggaagtacatggaatggaataaaattgtaaatagtatctctgacatagtcatatacttcatccttttagaaaaatcacaacataaagacagtatacatggaaacattttatttattgtagggtatagcatttttttccttgttaaatctaaattctaagtccagtcataatcttacatttatctagtgcctgtcaaaggatctgatcttaatgtggtcctcatcaccaaccccaataggacaagaggtcttttatcagcaggaaaacatcattgacccgcttcaggttaactgaaggactctggaccagattttttaggtctgagctaatgtaatatgataaacaagaaataattgatttaactatatagcatgtgacaaaaatctaaattttagaactcttagtgggctagggatattattttgcttcagttagattttttaaaatttggcaaattgaactgatatctagttttttaaggcctggtctcagcatttttaatgactttttttcacgctatggggctttctttcatggatcagttttctgaactaatctagttgaattgagtttgtgagggaatgaacagaaacaactatcttcacaatcctattctttacaaaggttcgaaggactttagagaaatcaaaaggaaccacaggtaaatgtgtaggctgtaaaaagaaacacaaaaggtaactggtcaaatgccactttgggagggataaaaggaaggttaaagagcaactaagggctatttttttctattgagaaatcagaaaaccctgttagtgatggagtcctcagccaatgttctgttctgtgcagcctcacctgcagccctgtctctgtgatttcaaagcctacttcctactttctcagtatgtatctatgttttgtagctgatgcctggtattccataagaagtgagactttgctgtatctttgaccttcatgcaattaagttaaacctactgtgcataatgaattatatgagagacaggacaaggtgctaccatagctgataggaaactgtagaaacatcatttcatgccatgcatggagaacttgagggttatgaaaagactacatttatagacatttaagttaaaagagtctcttttcaatttagtcgtctttctctacgtaggtcaaatgttttggtagagtgttccatttcagcacactgcatgctgtattggattttgtgagtgttttctgctctgtgtgttccctcatactgagggcggtaaaaagcaagggactccagtgtatttgctgtgcacctctccaagctagcccagggcctgtgcaaagtgaatgtgggtagaggaaggagtggtaaggcgagtcttcaaagttgatatgccacagatgggattcagtgcagcattgcttactcttgtcactttgtgcaaagggaaaagtctgtgaactggctgtgtggtagattgtgaattcatctcaattgttttatatcgatacgtccctggagaaaatagatgtctgtgagtgagccctagacttcatgtctaaatttaatcgtgggtaagtctatgccctggtttttcctgtccctagaatccatcttataacaacttagttcctgctttagagatgtagtactttctgcttcatagctgggggagctccttagcaggctctttttttttgagacggagttttgctcttgtcgcctaggctggagtgcaatggtgcactcttggctcaccgcaacctccgcctcccaggttgaagcaattctctgcctcagcctcctgagtagctgggattacaggcgtgcaccaccacgcccagctaattttgtatttttagcagagatggggtttctccatgttggtcaggctggtctcgaactcctgacctcaggtgatccctgcctcggcctccaaaagtgctgggattacaagtgtgagccgccccgcccggcctcttggcagactcttgaaagccccaggggaagtcctgtggatttgacagcatctaagaggggggggtgggactcactcaattgaaagtctcaaaaagctgctccttttagtgatagcaacaaggagtgtcttgttctatcctctggagtccctgtgaggggtggccatgtctaagagatgctattagcatccaggcagcatgccacagaagtgaaagatttcatctggacttctggaaactggctgtagggcaaagccactgctgatactggccactcagtgccagagacggtgtctgtgtacaggaagatctgcctcactggctccaagttgctctaaattgctccagaagacagcagtataggctatgtataatttgtttcagtatggcatagagagacacaaatggatcattttagatttctcttggtgagcaacacttctattcatgaggtattttgttttcgattggctttgtactttgcaaattccacttgagcctgtgtaaaaaatagatcttattcccaataaagacatcatagcaaagatacaagtgtttgcctgggaattattttacatgaagttgtgctttgcttatttcttacagaactattgtaaagccctttgtcctgtattagagagagagagagagagagaggttttaaaagcaagacaggagccttggcttctatataaattgtgcatattactacttgacacaccatcttgatcaaggcccagcctcatcttaatctttgaaaatgcctgtctttcaagataccacagtttccacccttcctgccttccatcattattttgtaaacacctgctgcgtaacaccacctctttgatttcagactgcctgggttaggtgcttaacataccagacttgctttgtcctctgaaaaaaatagaaataattttggtaatattttcttttcaagattgttgtaaaaattagattagatgatacttgcaattgtttagtaccatacctgacacataggtgcttcagaatattatttagaacaaggcccaattcctgccattctggagtttatagcctggtaagagaagcagatgagtcagtaaatgattgggctcaatatgtgatgagttatataattcattcattagcagacatatactgagcccctgttacgtgttgggcaatgttgtagagataatgcagtgaaccaaatggataagctgcctgcttttatgaggcttactgttgaccagcaatataatagaattgtgcagaggggtgccctagaaacaggattatcagactgggatggagatggaaggattggtttatgtatcagaggagcccccactggaggaagtgagccttgtgttttcagcattgagtggatatatgttgagcaaaagaagccaaatacaaaagcatacatactaaaggatttcatttgcaaaaagtacaaaagaagcatggtaatagaaattccatggtaatggaaaacaagagcagtcacctttggacagaggttattgattggaaagggtcagaatggaaatgcctggcgcatctgtgtcttggtaagtaaacacagagctgtacacgcttatgattaactcagtttatgttatgtatgttaagaaattttaatggcaataatgagtgggcttatctacgcaaaaacagggaaggaataggaaaggctggggcaagggtgctatgttccaatgcggtaagtcatcctctctgcctgggttggaaggatgcatatggggatgaaggtggggtgacagcgacaagcatctgtagattcaggctgctatgagagaagagtttttttccccaggtgttggtcatgaaggcattttttcttaagaatgtagagtggcacagtagaaactgactttggtttgaattgcttgcctctgaacttctgtctgatcttagcatccttcagatgggcttttgagaggattacatggaatagtggatgttgagtgcagtgtctgacatgtagcatgtgtttaataaatacataagagagttaaaagtatgtgtgtggcggggcagtatttaattaattgtaattttaatacttggtgctcaaaataaaaaaccagggtgactgcattatgtagagaagtgcttgcttatctgaaacttttgatcctttagttgaataattatttttatgtaattatagcttaatattatattaaaagtattggtcatttttcctgtgctcattaaaccattttaagcatttgggaacagtgtaaaagtggccaaagaatttctatttcagtaagactcatatttggcaaaattagttgtatgagggatgagacaactaaatatgtcaagtttctcaagtttacggaaaggtttgagtgtgtgggaagggaagtggggaggaagcagagaaattagtaggatttttaaaaaatgaaacttaactgcttttgaaatgttaaacatcaaattatgggtatgctaaataccttttggagttataatgtgttcgtgtaatcagctccttattaacttttaaactgtcatatgggaagttccttttaatcaataatgagccaagttcattcagactcttttgacaatgatgactagtctcctgcttattttagactttccagcttatcacttttaaactactctcaccctgttttaccatacctctctagagaatctcttgttttctgggagtgcctttgcattggctgcctagaaaacactccattctgtgtttttacaccttgagtctctcagttggatctgccctctgttttaggagcgagcgagcccgctggataactgccctgggacacagcagcgggaagccgcctgcagaccgaacctgtaagttctctcaaggggaagcccacttgggaacatggatgggctctgccccctgctggacgccgggttactaacgagttatattgccacaatacttgcctaagtttcctccagggcttccttctgctttacaccaaaaatgtatgatccttgctttggaagtcagggggtctgaattcaaatccaaggtgcatttctttgttgtgtaaacgtgtcaaatcattgcttagcattgcagagcctatttaaccatctgcaagtcagttacaccattatatacaacatggggttattgtgaagattaagttaaataatctatgttaaaagccctacttgaactgtaaagcccttaaatttttagctattatcagtgggcaacagttgatcatgtttaaaccttctacatactgacagtctggatttaagctgaaaagtatttttaatctaaaagaaaattacctaagaattctttttgaccttctaagaaagtgtgtttcactattctagagaattagaaactggcgcagtgaaggggggtgttgtatgcctattagcttcctaactttgatgctgtggtttcttagattattacagttgcaaggtcaaatccaaagaattagaacaaaacattgttatcctggaacactcaaaaattatagctttaagcttagattaaaagccaaaatgactggtttgaaagttcccggaaatcaagctttgtattaaaaagcaaattaagaagtcacatgtcagcattttgtttgtttgttttgagatggagtctcgctctggtgctatctcagctcactgcaagctccgtctcctgggttcataccattctcctgcctcagcctcccaagtagctgagactacaggcgcccgccaccatgcccagctaattttttgtatttttagtagagacggggtttcaccgtgttagccaggatggtcccaatctcctgacctcgtgatccgcctgcctcggcctcccaaagtgctgggattacaggcgtgagccaccgtgcccggccacatgtcagcatttctgaggaggtctaacatgacttctcagcttttggttggagctcattttatttctaaacttttttttggaaactttcatgtgctgctgttgggatggggagacactctgatgagagccaggagaactgtgtctgttgcagattttgcatggccttggcacatcagcaactctttcatgtctcagtttccctaatgcagagtggctgttttctgttccattgtgtgacatgactaatgactcctgatcaacctgttattgaggggaatcatgcatcataaaaggcctctcaaatctgagcttctaaaattctaaagcttatagccaagcaagggagttgctagaaaagatgttctgctttttattagaagcccaacttgtttctctcaatgctggccctgaattgcagagaaaaataagtaagtgtacattattggattgcacatgttttttctctgctactggaaacttagtatgtcctcttttggcctcagcactgacccaggtggaaatcgttaggtcatttactgctaagcagccagatgaactctccctgcaggtggctgacgtcgtcctcatctatcaacgtgtcagcgatggtgagtgggagcgttcttatgggacactcgtggtccaggatgcagagtgctatagacccgaggagtgtcattttgtcatcattgcccatattccaaatcttgacatgttaatgtttgagatcacatatatgtactgtcttctcatctctaaggctaaaccatgacgttttcttttttccccagtccctcagtgacccagttcttatctctaaatattcgtcctttcaaaaatagcattcttcctgctatcctttacccaaagcatctcctttcccagctcagcccaggttcaaatactctcagccttctcacttcagggcctctgctcacgttctttccctgccatgtcattcattccccctcgaaagctttccctgtcccactttctcttctcaccgtagcacttagcctggggagggatgctgcctctcagctttttcatatccttggagcctggcacactccaaatacttgttgtttggtgtggactctgttctttttcacaggctggtatgagggggaacgactacgagatggagaaagaggctggtttcctatggaatgtgccaaggagataacatgtcaagctacaattgataagaatgtggagagaatgggacgcttgctaggactggagaccaacgtgtagtctctcagatggtcttttgttactgcaagatttgcacgacacttaccgggctggttggttctgggctagttttattgttaattttgtcacagcctatttaattaaaagaacgaaaacacttgcctttaagcttgccaggttgttctgctctctcatgagaagagcttggatacagtgagtttgcacagctcagtttttacctaaccacacacttgcagacctcctgaggtacacagaatagctgagcagttcacttcagggatcaggtcatctctgctcctcctagtttcaccatgttctggcaataaaaaacacatattatatcctggttttctctatccttgcattactaaggtgactgtctctctttatacatccttgtatggttctcccagtattagcaagattgtatatctgtaaagaatgtccagttttgtaaatatttccctgcctttttttttctttttttacatctgattttaatgcttcgttaacttcaaaaggaactggtagagttcagaaggtgagctgttgtttttctaaacctcttcccaggaaggggacattgacacttgaatttttgtcacctttttcctcattagaaggaaagtagaaagccttactttaggatttttaaaaaaaaatccatctcaccccatattgttcttaaataagtatagactaattaacctaagctacctttaacaacgtagaatttagatgggttcatatatgtgagaaaaacctgaatataggacaggggtcctacttttttccccacctctgtcgcccaggctagagtatagtggtgtgatcttggcccactgcaacctctgcttcctaggttcaagtgattctcctgcctcagcctcccaagtagctgggattgtaagagtatgccaccacgcccagctactttttgtatttttagtagagacagggtttcatcatgttggccaggatggtctcttaactcctgccctcaagtgatccaccagagaggagatcctcggcctccccaagtgctgggattataggcatgagccaccgtgcccagcctactttctaattaattaaaaaaaaaaaaaaaaaaaaaaaaaaaccttcccaaatgagctgataaaaaactgacgtgaggctgctttgccttcaataatacctagttttcagctgttccaactcgtttccaaatagaaattagctggaacacactacagtaatctcaaggaagggaaaattaggccttaaaagataccaagaagtcagcatggtacccaattgaaaccttttgaccttagtgggaattcattctatttgcactaaaagccttaacttgctgtattcagagtccctcttaactgtgagtttctatagaactttactttttccactagtgcacagagagagaaaggttatcttaatagtcggtttcatggagatgaaggatgggagattaagaggggggaaatgatttttactggcagctatattccctctctgttctatttgctttaacaaagggataaaacctggcaaagtgtacattattggaggactcaaatctgtatgtgacatgtcccaactactgtccgctaactagttatccaaattgtaaagctacagaagcccagttgaggggtaagtgtgcctggctcacacagcctgcaccctgtcacctcggcaatgagccagtgtggggcactggggacttctaacccttggattgctctttttgacctgtgcataccttctaattgtaaaatatatttcagaccgtgagtaccttgagatctgagcaactgtgttaatgaagtaatagcaatggtccacagtgaaagatgtgttggggtttgcaaaacaagcattccgtcacctctttaataatgtcacagactttttaaaagagaggctatcaagttgtaatataatctgtcatgttttatttaggaaggaaggtaaatttgtgcttgcacggggatcattttgtattatttttgctaatacccagttgaagctaaaaagcaactatttgaatcctgtgaattaatttataagaatgttaaacagctttggaaatacatgcatcttatgaatcatagccttatttagcaagatcaatgttaaagtgttgttatatggcaagtatttaacacattcacagtgtttgtttgatttcaactgtgaattgtcttaagttttttcaaacctagttgtttctatggacacctgctctgaattgtacattgacttcattactaaagaacaaaaatgttcatttttgtcccagtaaattgagactgcttgtacactttcagaaaaatatgtgaatttataaagattttgtagatacttgt

SEQ ID NO: 1604 - DNA, 136830 bp, Homo sapiens
tagaactctgcgctactgcccacgcatctcacaaagtctactacgccgcgcgttctcggtttcaacgcacctccaggattcagggcttcctaagctgcaattcagcagggctcccttgcttgttctcactctgtgcccccggcaacgaccccgcgcgcctacactcccgtgccgcctcagctactagtccgcaacttctagccccaaaacgctggagctcagaacccagctcaggtgcgctcgtcggtttcccagggagactggggctgattgtaggcacgcgggggcgggaagacagcttcttgcttctggctgcgatggaggcggatctgggcggggccgaaacgggggcggggccaagtgtgggggcgtagtcaggcgtgggggcgggccggcgccggcgccgcggtcggcggcagcgctctcctaagctctcgcggctgcgcttcggtcccggacccgggccacccacggggtagtgggtgctcctcggccccggacattgcaagccccagaaggtaaatttgcgtgggagccgcgcacctggagcgcgagggtacccatgatgagggcgggaggctggatggcgacagaagggagcgtcccgcggcgagtttcccaagaaagctgaactcgtcccaagtttcttgtgcctcggcttgcactcagtgaatgggtggcgggctcatttgctgcgggtggtcttttggcgcgggagggacgcggaggtgattggattaatccgcctgggcggcagcccagatttctgccgggaaccgcgcaccgcagtggtgcagtttttgcccgagaaagggcgggtaagtgcggtgcagtcgtgtcctgcgcagcagcagggggaccgccggtctgggagcacgcgagtcggccaggcgtccccggttgtccagaggcacagtttcctaacttctttcctctttaggcaagactaactcggtgttgctcctcccggcgctgacttcgaggcccggctatggacggcgagagcgaggtggatttttctagcaacagcataacccctttgtggcggaggcggtcgattcctcagccccaccaggttctgggccggagcaagccgaggccccagtcctaccagagccccaacgggttactaattacggatttcccggtggaggacggagggacgctcctcgcagcgcagattcccgcccaggtgcccaccgcctcggacagcaggacggtacataggagccccctgcttctgggcgcccagcggagagcggtggccaatggtgggacggcatccccggagtacagggctgcctctcctcgacttcgacggcccaagtcacccaagctccccaaagcggtgcctggcggctccccgaaatccccagcaaatggcgcggtgaccttgcctgcgccgccgccgccgccggttctgcgccccccgcggactcctaacgcgcccgccccctgcacccccgaggaggaccttactgggttgactgccagcccggtgccttcgcccactgcaaatggccttgccgctaataacgactctcctgggtcaggttcgcagtccggccggaaggcaaaggaccccgaacgggggctctttcctgggccccagaaaagttcttcggaacaaaaactccccctccaaaggctgccctcccaggagaacgagctcctcgagaatccttccgtggttttgagtacaaacagccccgccgccctcaaagtggggaagcagcagatcattccgaagagtctggcctcggaaattaaaataagtaaatccaacaatcaaaatgtggagccccacaagagactcctcaaggtgcgcagcatggtggagggcctaggaggacccctgggtcacgcaggggaggagagtgaggtcgataacgacgtggatagcccagggtctctgcggagaggcttgcggtccacgtcttatcgcagggcagtggtcagtggctttgattttgacagtcctaccagctcgaagaagaagaacagaatgtcccagcctgttctgaaagtggtgatggaagacaaggagaagttttccagtctgggaaggataaaggtaaaagtgggcaggagtgtggcacgccattcactaagcggaaagtaaatgtgttgggagtggggaggaggagcgtagaggaaacccgaagaagtcattccgttttaattctgtgttttgctcttgattgctagtgtacatccagctcttggccactttgatgctggcaggcacagccgagtttagtgcaactttgtgggaagaagtgaaattcatcacttttaaatttctaagctcaggcagaattgggggggacaagagtgaaatatggcagattattggctgagtgagtctttaccacttttaaaagagatagctgaaagggggaggagcatgttcagaaccgcactctgcagtcaagttgtctggagtttgcttagaggtttcagtcaatgatagctgttatcacagctgattcagaaaaatactgattcctgtttgagcctgttgattattttttgcttttacttactgaattttgagtggttactacgcacttgatgtcattcaggtagaatgtgaatttgaaaatcagttgccaggatcacaaaagacataaatattttgtcatcttttttgttgcttgtttttgtcaccgtggcctttggttgtgttttattcccgttgtatgcccattcatccttgagtgcatgtaacagattggcagctgaaaacttaaggttagggtggacactgtgtggtattgctcccctatattgtcccattagctgcacttattaaaatattgtcaaatatgacataaagaaacagggaaaactgaagaggggtattttggagtgtgtgcttccttccacagaaacaacacaggtttcagcaataaggcagattctttttggcagccacattttttcttggttaatcagagcactggaaccagtctatataaatggcacatatgcaaaacacaagcaagcctgttttattttagagcccgtggtcttaaagaaaataaattacataacattttatgtgttttttccaactctgcaagtatagcaaagttcaatttaacagtgatggtgaatcacgagttgtaaaatgagctgacctgctagttatttgaggattctcaatctgttttgacagggtgtgggggatcttgtacattttatttcattgtttcagtgaattgtagtgatcaaatgagtgaactcctccagggctcagcttctgtgcgctcttggaaatctaattaatgtaatgactaaaaaaaagtatttttacttaaaatagctgtattttctatttggctcattcatacatagtttgcttttccttttttttttttttttttacttttttttgtctcttagaaaaaaatgctgaaaggacaaggaacatttgatggggaaggtaagcatttaattttccaaactttcattgctgtttcaatgtggaataccaattataagttgaaatccaactgcagtaacaaaaatgcttacgatgagaaatatgtccaacttcttctcaaattatacagtccaaagcttctcactaagctaaatttttatctagtaatactaatggtgaatatagttaatggcattttttataggctgataactttttcagtcgatgtcctgggatttttaattcttctctaccttggctccatccccatgttcctcaggaagggtaagagcaagatctagctttttagttaaaaattctgattttggcatttagatctgaagtcatatttctttaggtcacatttcctttgacttagtattctgcccatatttccacatttgattatcatttctgacttcctgtttccttattaagtttcagctttggggaaactctaactctcctggctgacaaaaacatattcttaagacttttcaacccatgtagtatttttattaaggatctcaaaaaaaaaaaaagcagcttcaaccaggtgttcaaaccctaatcagattaatggacttttttaaatagatgggtcaagcgtcagccaactggaagagcatgaagggagcagtcccagctgtagcacttgttgggctagagggtcatggtggtagtgagggtagttaaatttttgtcatgttttgaagtgtgaagattttccaaccttcaaagaataataaagaagggagtgcccctccataggtcaagcaaatgtacaatcacccagagttataaaatatgtagccttaggtgattgtcaagtaattccctatataatttttataaagatgagtttcccattggaacatttataaatgacttatctataaaaattcattcaccgcaccaatcttaggaaatccagatatagtatttagctggttggaataagttcatctccctaattttataattgaggaaaccagaagatctgagaggtttggtaacctgtctgctgtcacacctagttacacagccagtagtaggacacagatcgagttcttagtccagtttgctgcttcttatagcactctgactatgaagtgaacagcatctacctaatatttacctaaggagatgctttacattccctggaatttgatatttattttgtgacctctgcctaagagagtttaaaatttttagattttttttgaagtcagagagtagacttcattataactagttttacgttatttccttttataaggagctgtttctgtgtatcctctcatttcttctcaaatataatgacctagaaatttttttcatgtacatacatatgtacatgaggaatgcaggattcttacagttaatgattaacaagaatgtaactaaagaagcagtgtgtctaaatggtgagaatctgtgatattagagccaggcagacctgggttcctgtcttgctgttcctgttcatcagttaagtgatactgagaaaaacccttaatatcacagggacctcactgagccacctcatgtgtgaaatgaggttaataatactgttgcctaagttgttgtgaaaatgaatgagaaatctgtcaacaatgttatgcatatatactttgtgccaactacttagtactttgaagactaggggagactcagcctttaccctcataatctgctttacatagcatgacaatcagagaccagtaaaatcttgaatagactccagtgttactttagtcatagtgcatacagaatattctgtagttgatgagaaaaggggcagatgcatgcttgttttggtagatgggaaagtcagttcaaactcaaaatgccccaaaccaaactcataatcttccccactaaacctgaatctcttctggtgttcccatctcctactttctggttgtgaggcctgcagacctaggaaacacccttaacacctccctctctctgcccccatatccggtctttcaccagtctgttctatgttatgtagctcaaatctccatcatctttcgttgactaccccaatagcttcttagtctcctaggtagtcaatgttttgctgtctaatctaagcaagtctttccttttcatggagtcccattgtgttcaggaaagaaatgctatcatgacagtgtgaaagaaactcaatccttttgtactcagggtgaaatccagtttttaccattgcctacaaatatttccttgatttggactgtctggctcatgtctctaaactcaccttgtacactgtggccactagacatacccaagcttttgccacgttgactttccctagttcttttaagatacagccatgcatcacttaatgatgaggatacattctgagaaatacacccttgggcagttttgttgttgtgcaaatatcacagagcgtacttaaacaaaccagatggtatagcctaggatatatggtagagccaaacctgtacagcatgttactgtactgaatactgtaggcagttgtaacacaatgatatttgtgtatctaagcacaggaaaagtacagtaaaaatacaatataaaatattaaaaatggtactcttctataggactcttaccgtgaatggagcttgcagtactgaaagttgccctgggtgagtcagtaaatgagtagtgagtgaatgggaaggcctagaacattactgtacactattgtagactttacaaatactgtacatttaagctatattaaattttaaagaaacttttcaatcattaacttcagcttactgtaacttattttgtaaaatttaaaaatttttgaatcttttcaactctggttttaatacagcttaaaacacaaacacattgtacaactgtacagaaatgttttatttcttcacatacctattccataagctttttcctattgtaaaaaattttcatttttactttttaaattcttttgttgaaactaaacacatgcattagcctaggcctgcacagggtcagaatcatcaatgtcactgttctccatctcaacatcttgtcccacaagaaggtcttcagggacagtaacatacatggggctgtcatcaatgataacagtgtcttctggaatacctcctgaaggacctgcctgaggctgtttcacagttaactattttttttttttttttttggtaagtaggagtgcactctaaaataatgataaaaagcatggtatagtaaatacataaaccagtaacatagtttattatcattatcaagtatcatgaactgtatataattgtatgtgctatacttttgtatttttggcagtacaatcggtttgtttacaccagcattaccatagacatgtgagtaatgtggtacactacaacatttaagatggctaggtgataggaattttttagctcctttataacatatgggaccaccgttgtagatgtggtttgtcattgatcaaaacaatattatgcaatgcgtgactgtattatgtttcctcttatgttcgcattatagcttttgtgtatgcttttcctgtagctctgtagcttctcagctttcagaccttagactttcctcattgaccaaatatctgactgccagactagatcacaccctactgacagtctgttctcacctctatataaatccttcagtttgtaggtatgtatttgtgtaagatcattatgttctcaaacttatagtgacttgccatcacattttgagtaaaaatcaaagtcctttaatggctgaggcaaggccctacatgatcagccctctggtcacccacaactcccatcttcttcttcttttttttattttgagatggggtccagtctggagtgtagtggcatgatctcggctcactgcaacttctgcttcccaggttcaagcagttcttctgcctcagcctcccgagtagctgggaccacaggggtgcaccaccacactcggctaatttgttgtatttttgatagaggcaggatctcactatgttgcccaggctggtctcgaactcctgacctcaagtgatctgcccatgtcagcctcccaaagtgctgagattacaagtgtgagccaccatgcccgccggcctcaactcccatcttctgtactttccccccatttccttgtactccagccatgcagtcctccttgctgctcttggtacatacagacataccaagtagactcatgccccagggctttgcacttgctgtgtccctgatgagatgctgtttgggcactagttcttcatcagagtcaacatcaagggccttttctttgtagttttgatacaggtggctcactttctcacctgttctatgtctttacttaattgtcactccagtgaggccttcctaaactaccctacttaacatctacatgccctcctcccagcgctttctaccccccttccctgtttcatgtttcttcatgacacttatcagcatcaaaatactatcaaagttatttgcttatttattgcagttctctcatgctttagtatcagctcctgaatattgagatttttagtgtctattattgtatttcacgtgctaagctgttgccggttcctagtaggtgttttctaagtaacagttgaatgaataaatgcatgagtgaatttgacagtttttttaattaaactgttagctcatgagaggtggatgagggcatgagagctcatgaggcatcagaggtgtctttcttttgttttccattttactctcagcccttggcacgtcatagatacacaataaatgtttattaaatagataaatgaatggtgatggaccttaaataaaagataggatgtaatttaacctaaattacagtgatttaacaggcctgactgtccttcatgagtagtggacagagacatggaaactgcttctgttggcattctctgtatgggctggtccccttcccctgcagttgagtttgagatagagctatgtgaatgagaaaatcacttttctgtaattattcttcagggactaaatctgtttgtctctctgtttataaaattggaggccaaacattgggtacatatgatgtttatttagaacaagtaacataatgattgagaacaattagtgacacataggccttgttttcttgcagaaaatgctgtcctgtatcaaaactacaaggaaaaggcccttgacattgattctgatgaagagtcagagcccaaagaacagaagtcagatgaaaaaattgtgattcaccataagccattgagatccacatggagccaactctctgcggtgagtgtttatcttcttttctatctgtggtaggaaaaaaacaagttttggaaattatgtgtggatttggcttttgttcttttctgccagtgatcctgtaactaaggagaaagactctttttagattgtgaaatgtttctcggaactctgcccgcactaatgagaacatgaactttgacacttctgatcaggaaaattaggtttgataaaataaagtgctatgagattgatgtactgtgacctctggaaactctttctgcgagatctctctttttgttaaatatagcctgcactttatcataattatggctatttacatatatatgcgtgtgtgtttatgtatgtatgcgtgtatatgtacatgtatgtatgtacctgtatatgtatctctgcacaatagaaagctagttacaattcttccttggaaatttttttttttttttttgagatgaggtcttgctctgtcgcccaggctggagttcagtggcgtgatctcggctcactgcagtctcccaggttcatgtgattctcctgcctcagcctcctgagtagctaggactgtaggcgtgtgccaccatacccagctaatttttgtatttttagtagagatgagatttcaccgtattggccaggctggtcttgaattcctgccctctagtgatccgcctgcctcagcctcccaaagtgctgggattacaggcatgagccaccgcatctagcccttccttggaaatttaatttgatatagaaatgtttatatattcttaaagctgattaatgaatgatattctgttccatctctgtgccttttttgtatgcctgtctctgacacttaattttgtgttgatgagtaatttctcctctctgcatcagacaccttttgttttttaactgtatatttttttcctcctggcttacaatgtcacagtttgatgcttagtttacttgataagagtttgggcacagcatttgcgaatatctgatgaattagcaagtagaaaggaattcccatggctggcttggttcaggggagctttgcatcaaaaacaagccagtacacctccatgagtccttaggcaatatcagagcagaggtgacagagatgtttagaatcaggaatcttgtgtatttagggaacccactggtgtaagaaaaggagttgttaatgttggtgctgtatagccagggccgtgggaatatgtgtatgtaaacggtgggagacaacttctgcttcaagctctaccttccctcttctaacctgtattggaattcaaaattcaatacaccaagcgctttctccctgtcttcttcccacctcctaattttgttctcaggagaatctgttcatttccagggcctctgaggtatagcacccttatgattatgccaaaaattaaaatattcacagtgtcaggggaagtagaatgaatatgtgatgctggtatatgtaggtgatagggagtggtgggagctgtggtgaacaggccttatataaattgagcagctactacttagctcaaaccaggtgagtgcaggggctcagtgtgaccagatgttctgataattagaaaagagaatgtacaaatccagacttttatgagtattttctcaactcaaattttaaagaaatgttgtgtgtccaagaaagtattcagatttgccctctatgctaacagtttgtaacttctgtgatatttttaaaatttttgcatgtggttaggtggtaaaagctagccacagaattggtttattagcagccttataccctaatctaatgatctcatgatatgtgtatcccaaaacagatatgtggaaaaactgatgacaaggtccattgaggccatgttggctctaaatggctgtcattcagttcattcagttgttggtatggaccatttggtagaggatccaggagaagaaagaaggctgtgaattttttgttttctctctgtggcagcagctgggtttgttagcacaggcctaaatcgtgctgttggtctctgaaagaatgctaaaaagaaatgtggatttttatgtcagttacaccctgatctcagtttagcccaagaaacaggctgccatatttatgcctcctggagtttggctttcatatacatgaacaaatgtatatacaattaaataatagtgcatatccttcagttcaactttgtttatggacttgcattttatttggcaaaaaatgaatgttgtgtcttttgtaaatgatattgatatcatagaactatcttgtaataaaatgtaaaactataaagtgatttctgattttagtgtatgttatcttggagttgagtgttcccgggaggcttgtgtgtgtttattgtgttgcttggcaattaaatttaatgaaagcagcatgattggacttggccacttagcattacttaggcaccagcctgcatttctttgtgccttttgtgtcttcttttcacttacattttactttaattttttttgttataaagtgctttaaacccatagaaaaattaaaaaataaataaagttaatcaatttctgtgtacctatcactcagattgaacaaatgttaatattttaacatatttgcttcattttctatttttttagactattacagcgaacccctccttcctttccagttcttttctccttcctacctccccagagataaccactatccctgacgttctcttctgtccttcccatgagggttttctgtccaccaaaaagatataaccagttctggcttttaggaaagtagatattttaacaccagaaagcagccattacctttttagaagctcatctgctactaaattttcaagttgtatttaggaccctaacgagcggaggcttcgtgcatcattaacaatgtcaggatgtttctcaaaagtgatcggcacctctatttctctatctgacccctcctggtagtgaagctgcagcgtttagggcaggtctcagaagactttcaactttaatatatatattcagctttaatatgtaatatataaatatatatgtgtgtgtatatatagagttggaggtctatatatataaatacctagtataatgtatatattaaacctagcatcatctacgtatataaaatcatccttccatgcttaattttaataatcaaaatagtaaggtagcccgtctaattttgagtataacattttaatgcaaaactcttcttaaagacaaggggttttctggcagtgggttaggtctcagttcggcatataccttcacttcctgctaaggagggtagggagtgagtgcacatgtgcattagccggtgttgttttattttctaaaaaatctttttattgcaaatgcctgcctcctgggatggtgaaactatccttatcagttgactataagaagcattcagtatgctgaatacttttgaagtgcagcaatttgcagtaatttatggttgttacgtaagatctttaagccttgagtctgtgctgtaatttgtctgggcgtgtttatgtttcctttggtttcattggaccatgctgggtaaggcagtgttcagctatacagatgacaggtggttccccatttatggtgttgggacaggtttaactgtagtgttgtcatttaggaataaaggagaattagaagaggcatttatttagttgggcctcagtagaataataaatgatagtcatttgtttaactgagcctcaatagaataatgagccacagacttctatattaggactaaagaaataaggctgcacacctacaactatctgatctggcaggtttgtagaagatcagatagttgtaggtgtgcagccttatttctgggctcttttttctgttccattggtttgtgtgtctgtttttgtaccagtatcatgctgtttggttactgtagccctgtagtgtagtttgaagtcaggtagtgtgatgcctccggctttattcttttgcttaggattttcttggctattttttggttccatatggattttagaatagtttttttccagtttgtgaagaatctcaatgctagtttagtaggaataggattgaatctataaattgctttgggcagtatggccattttaatgatattcatttttcctgtccataagcatggaatatttgtccatttgtttatgtcatccctgatttctttgagcagtgttttgtacttgtagagatctttcacctccctaattagctatattcctaggtatcttatttttttgtggcaattgtgaatggcagtttgttcctgatctggctcttggcttgactgttgttggtgtatagaaatgctagtgatctttgcacatcgatttcgtatcctgagactttgctgaagttttttttatcagcttaagaagctttccggctgagactatggggttttccatatataggatcatgtcatctgcagacagggatagtttgactttctttcttactatttgaataccctttctttctttcttcctttctttctcttgccagattgcactggccaggacttccagtactattgtattagtccgttttcatgctgctgataaagacatccctgagactgggtaatttatacaggaaaaagggttcaatgggcttacagtcccctgtgtctggggaggactctggggaggcttccacaatggtggaaggccaggaggagcaagtcacgccttatgtggatggcagcaggcaaagagagagcttgtgcagagaaacttccgtttttaaaaccatcagatctcgtgagacttactcactatcatgagaacagcacaggaaagactggcccccatgatcacttaactcccacctggtccccccaacaacatgtgggaattcaatatgagatttgggcagggaaacagacaaaccatatcaactatattgaataggagtggtgagagacggcatccttatcttgtgctggttttcaaggggagtgctttcagcttttgcccatttagtatgatgttggtgatgggtttgtaatatatggctcttattattttgaggtattttccttcaatacctagtttattgaggtttttttttttaacatgaatcaatgttgaattttatcaaaagccttttctgcatctattgagataatcatggtttttgtctttagttctgtttatatgatgaataatatttattgatttgtgcatgttgaaccaaccttgcatcccatggataaagcctagttgatcatggtggataagctttttgatgtgctgctggatttgatttgccatattttgttgaggatttttgcatggatgttcattaaggatattggcttgaagtttttttcttttgttgttgtatctctgccaggttttagtatcaggatgatgctggcctcatagaatgagagaggagttcctcttctccaattttttttggaatagtttcagtaggaatggtaccagttctttttacatctggtagaatttagctatgaatctgcttggtcctgggcttttcttggctggtaggctatttattactgcctcaatttcagaaatcgtgattggtctcttcagggatttgatttctccctagttcagtcttgggagggtatatgtgttcacgaatttatccatttcttctcgattttctactttatgtgcctagaggtattcataatgttttctgatggttgtttgtatttctgtggggtcagtggtaatatcccccttgtcctgaaataatgttaatggtcgtagttcccagtttgggttggtcaaatgtggaagggatttgaggttttgaaacctcaatgactttgaaaagtaagttttgacccctggagattatctggaactctactcagagacaaaaaccctgctgcacgcaggtaaatcaccggtgcctcacccaaaacagcagcacaaacattaagccagcagttcttggatctctgggaaaagcatgtgggtttgaaggaaaatattgattgtattagtcagggatggaacactgtgtacttgttacagttaatgccaggtgtgtagtcagctgaacttcaggttttccaaagggttcattcattagtaggaccccggaagtatttattgtcttttcttttagatagattttgactagagtttttgcttttcactgtaagtaccccctccacctctccaagatcatgtactatgcatgtatgaagaaatgactgttgcaacaccagtgtttgttatgttaagttcggtgatggaaccaaaaccatatttgccagctgtgccctgacctgatttatttgccatggggtgcgtttgtgtaatttccatcaccttgaaatgccagatacctttgaaaagggtgttctctgttcagcacctaatagagtcatcctctactgcactcttcttttgtacttgctgacatgtggctttatcagtaatcttaagtcattggaatgtttcttcagtttgctcaaatattttgaactctgtagtcagaaatggtttgatttcttaaagtattttaattttaattaaaatattttaactaaagtattttaattttaattaaagtattttaagtaaagtattttaattttaattaaaatattttaactaaagtattttaattaaagtatttttcagctctgtgctaagtgtgactaacagtgcaatgggagatctagaattcagacctcagtctctggttctgggctcagctcttaaagcacacatagtgtacctgtgggagactttctggaattgcaggatgagaaaggaagatttgaaaagcaggaattttattataaatatcatttcattccattgaaaatgcagcagacactttggcatcttagtagtttgaggtgatgggacttattattttagaatttactctgtgcttattgtgaaagacatactattttctagtaaaaatcagagctcaacaaatgtaatatacctgaatgtcattctgtttgcagaaatgcttaatgcatttaaacttattcttttccctaaattttcacatttgtctgaattttcagttgtttgtgacttgttgcttaaaatagtaatttctgtagttttataatttttcatttacagtttggcaacgcagcagtctcataagattatttttttactttagatggtgactaaaaccttttaccatatctttttttgtgtgtgtataagatatggaaaattattttcactttttataactggctcacatttagctcacatcatggtttaaacagaactgcaagcacatactagtccacattttcaagttggcttgtgggtcttctggaatccttgtgtctttataaacaaaaatagaggcccatgtgcctagacctgagatccatggtttggatatttttcccctccaaaactcatatggaaatttaattcctgatgtagcagtattgagaggtggagcctttaagaagtaattagatcatgagggctctgcctgcgtgaatagattaacagccgcagattactgggctaatggattaatgaattatcatgggaggggagcaggtggctttataggaagaggaagagagacctgagctagctcgttagcatgcttagcctccttgccatatgataccctgcaccacttcggggctcttcagagtgtccccaccggcaagaaggctctcaccaaatgtagcccctcagcctggaacttcttagcctctataactgtaggagataaatttctttgctttataaattacccaatttcaggtattctgttgtaagcaccccaaaacggactaagacataccccaattagaattactactctagctaagagagataaaggtgggggactacttagcttgggccagggactgggctctgtatgtggtcttgctttttatgtataattagattatggtacatttctgaaaattaacttgacttatgtaagcaatatataatatgtccttcatgtagagaataattcagacattttggaccaggtacagtgggtcctgcctgtaatctcagaactttggaaggctgaggcaggaggatctcttgagcccaggagtttgagaccagcctgggcaacatagtgagacccctatctcttaaaaaaaaaaaaaaagaagaagagaagaagaagaattgggacatttcagattagactaaaggctcttttggtcatttgtgcaatcccagtctctatccccttctccatagataatgctgctctcaatttggcaatactcttctgaaaatccacatatatacatttaaggaaacaatatagattacccatatttatgtaaatatacagactatttataatatacagcttgtttcttttctgcactatgtgtcttataagtcatttcatatctacacatgatctacagtgttataactgcattaatacataggatggatatgcatttagccatctttactgggggagtgtcatacatgctttaagaatctaataaaaattatgagccataggctttctctgtagaaaaatgcacacatgtatacatgtaaatttttttaataatttttgttttttcagttttagttggagagtatttttttcttgactttatttccaaatactaggagcaccttagtgtagcttgttatgtattgagtacagtttccatgttgttaatatcactttaaaaagtttttctgtatctgcattgttgcagcgttggaactttatgtaactcctaaaaatatagacagagattgaggaaaaaactactctggttggagctcactaattaaagggcaactgagtggtagatctgccaatatttatgtaattgattcttctgagagaacagtgaagtgttgggatatgggggtgtgtgcaccagttgcccgagggtaggcagagatcagaaatgacaggtgctccaagaaagcaggaggagatgaaaacacggttagttaattgttatgggcataactacaaaggcagatgtttcaactacaaacctacaacagggtccagacagagagggtcttcttacttcattgagtagaaaatcgatgagagagattgatgaattcattgtcttcatcaagggcctgccccacatgaagttctgtctatggcaggccctggagatagagcaagaacagactccaccttgcattcatgtccttgtaaacaacctgaatggcgagacagatgtcagatatcaaatcatcccatagataaatgcataattactattgtggtaaagctgtgaatgacttactggtgctgctgcaagatcttctagaaaagagcacctgtctgggcaaggtgcggtcagtggagagcaggtgtcagaggaggtaatgtgagctgtcatctggagggtccaggacgatagctggtggggcacagttggggagtggcagggtagaagagtctcaggtagagaaaatgtcatgtgcacagacatttggggtgatggtgggtaagaggagttgggataaggccagtgcagctggaacatcttgatctcctttgtgggtttttcctcattcctctgttctctaaattttggagggcccctgggctcatccttgggcctcttctcttacctgcactcatgtggtggttttatcaatcttgtacttttaaatatatcatatactcggatgacttccaagttattgcttactatgaaatcgaattaaattttggacttattctcaactagctatttcttttggggagttggaagggatacattcaagaataatagcagtctgtaggaagagaaggctcagggatgttgaagagttctgaataactgcatagaaaggctttttcatactgactttggattgcagattcatctatgggattcttgtatttgccctgttgagcttaatgtatcctcttgtggggtctccttcctcagtccaaagatagggctatttctcagggccacatccacacagtggttggtctccatgatgattggagagtgttgtcacctttaaaattactattgaatctttaaataaggaatccttaaaaatttgttactcaaattttgtggatttatctggagcacatatagcctgttaattctctagattattagcctgtactctaatatcttaatattaggatgtttattatctatatttctattattttgaggagataagaactatacagtcagtggacaacttctgtagcaggaagtattattgacagtaaaataaaattgcagattatttccctctttgtaggaaataagcctatccaactataataatacaaaaatggagcaatttccacttagcctggttagaaaccctgcttctggtagtggagtgcaaaggagtctgattgttgtgtgcccacctgggcaacagggagcccttatatccacatgggtccaaagttctgaatgagcagactgagttgcaggatagctgttagctctgggatcatcacagtattgatttgtttacatgcagttaaattactgaccacatatttgcaggagacttattgtgtaccaggattgtgttaggtaatttcagatacagtttatgtagtcccgggacaatgccacgagggtaagtacaaattctttactttgtaacaagtcagctgagaggccaggatgttaaatgcggctgctagttaaggtcttgagattacttggaacagcctctgcagtgacctcaaaagatggatacatgtacctagggctctggaagagcaggaactatgtttctcccaggtgctcagccaataatgtgactgcaactctgacttgggcttttttttcttctcataaattggcttattttccctttttactatgcttgtctttttcctgaaagctcctgaatactcagggtttctgagtgcttttttttttttttttgagatagtctaactctgttgcccaggctggagtgcagtggcacgatctcagttcactgcaacctccgcctcccataagcgattcttctgcctcagcctcctgaggaggtgggattacaggcacacgccaccacgcccggctaatttttgtatttttaatagagacagggttttgttatgttggtcaggctggtctcgaactgctaagctcaggttatctgctcgcctcggcttcccaaaatgctgggattacaggcatgagccaccatgcccagcctctgagttctcataacttacacttgagcacttgagactgtgttaacagccctgtccttccctcaagtcactctttcagcttccatcctattttttttttgagatggagtcttgctctgtcgcccaggctggagtgcagtggcacaatctcagctcactgccagctccgcctcctgggttcacgcagttctcctgcctcagcctcctgagtagctgggactacaggcggctgccaccttgcccggctgattttttttttgtatttttagtagagacggggtttcaccgtgttagccaggatggtctctatctcctgacctcgttttccgcccgcctcggcctcccaaaatgccgggattataggtgagagccaccgtgcctggccttccatcctatttttgaaaggatgtaggccagaatgccaaagtgagttacacagtttagttgcccagtttagttccttgagaaagagaattatattggctcagctactttgcccccgcttaataggtcactagaacatgtattgtcatttagctaggtgcttaactaactctgctccagtcagctttggcctccatgatgtactatggcacaaaatgtggtcccttggggctgctgcttttgcagaggctgtgagtagaatggtttttcttgtagaggtccatggaagtgttaaacgacatgactgactgacttttgtctagtgtaaatttatacatcatggagtggacattgtaaccatggtctttatcagcagcttaacatgataagaaatatgttttaccttataaaccagtatgtgtgtctgaatgtgtatgtttgcacatatgtatgtgtgtatatatctcaaagaaattttacaaggcaggagttactttatacttctgcttgcagtgtactatagtatttttaatttttttctgttctgttacatttaaatagataacgatcacttcatgataagactttattttgcattcaatgccagtttataacttataatttgaacagtggtaatatctgactccaaaattcatttgttttccactgcactgtagtgaatgaggcaaacaaaacaaggctaaaacccagcctaccctccaggagcttagaacctagagcagaagacaatagaaatgaaatgtctgaatgatattttgaaaggatgtaggacagaatgccaaagtgaatgacacagttgaaatcacagaaagcagtgaagtgaagatgaggaaagttttgtctataggatgtaacttaaactagatgggctatttgggcagaagaggagaaaataaaagtaatgaaggtgtaaattgcttgaataaaactttttctttttttttttttcttttaaggtagagataggaagacaggatttcaccatgttggccaggctggtctcgaactcctggcctcaagtgatccacttgccttggcctcccaaagtgctgggattacaggcgtgagtcactgcgcccagccaataaagcttgataggtaggcaaagggaagaagaaagataggacttctgtgtctgtttctcagatctccgtacaataaggtaattcctgtccaaagaaaccactgcctgctttgtacatctaatggaaagcatcagtttactctattacccatttttcagaaacagattttgctcaggttagatttttattgcaaaatctcagaaattcagagtcgctgttgttctaagtagcttattgttttggagtttctcattcctatccactggtcattttacaaaaatagcaagcaaaaataaaatagcaactaatatattggcatcacctttagaaataggtgttcttttcttccgcaagagaggaacatcagacctgttgtaccttccttaaccccttgactcataccttcactatgtgtaaatggcatcattctcagttacgcagactcctttatcctcctttatctctcatgcttgcagattggcctgtcatcactcattttcagcactgcctcataagctattgctcagtttggacttgattaaaatctttctttcttattgcctccctttaccttagcttctcatttcttttatctacaggtggtcatctctcatttctctagtttctctttggggcagcaacaaagaaatagaggtattattggcacctttaaacagttctacttgtctgccctactcgttttgtttcttttttgggagaggatgttgaagtagtattttagtttttgttattcgaagtgttgctttaattgcaaagccaagacatgtttattacagaaaaatcagaaagtaccaatagataaaaaaattgaactatctctttctattcaatcactattaacatttttgtctataacttttcagatttaaaaatatatagaaggattgtcttttacgcaaaaatcaataatgtagtaatagttttgtcacttttttcccttaacagtgtcgtaaatatcttttcatgttattaagcctgctgttttgtcacctttttttaacagtgttatgaatgaccttctatgtcattaaatattcttctacaacctttttaaagcccacatactagctcctcaaataagtggatgtttagctcttttaaccaatttcttgttgttaatcatgtgtgtgtttctaatttttcaatttaaaattcaaaatttaaggctgattaagttttttaaaataattatttttgaactactgaagtaaaagaaatacattctccttattaaaatattaaatgtaacagttaagactgaaagctgcttaactttaccaccattcccaacccctcagctgttaaccactgctataagtctggtctgtcccccagtattttattaaatagtgcacgtttaaaaattgttagtcttcggttaaattatagaattgccctttaccctgaatttattccctttcatccttgttacttctgtgtcattagcttttcatgtatttgttaacctcattttctcttcttaatttagctgatagatacatgagaactgcatctcttgctcatttgggggatagagaatacataaattttagtccaggctcagtagcccacagcgggaaatgcaggttagagagagccacaaggaaaagaggaatttgtttggtggtagaaatgtcaggattgatcaacaagttaaatgaccagggagccctgctgacagcttagctttcactgcagcagaagccaggaagccaatgagagatgttgtttctggggcattcagggggagcaacttaatttaggggaagagtagcttgcacagctcttaaaaactctgaagttttagaaggcagtgtgctacagtgattaagagctcaggctttgggggtggacaggccggcccaagtttgaatctcagctttccaattattagggtgaatgacttaacttttctgtgtctccgttctttatttgtaaactagggatagtaatgccttcctcacagaattgttacagggtttagatgcatggaaggaacagtacctggttcatggtaaacatttgatataatggtagtttgagaaataaattgagaaccaaccagaactctgaatcaggaattgacaagacatgggtagcaagctggtgagtgctggctgcaaatgaagtaatgcacgtttatttcctaaatgtacaaagcacagcagttcattcttgtgcatttaattacttatctgtagtttgtattctcagcctcatgtctgtattgaaatgatttggattcattcaggaatcctggctctgtctgtagatggtgatgcagggcatagaggagcaagtgtcctggtctgctttatctgagttttccattattttagcaaactcgatgttgcctgcttgaggctgagtacttgctatttcttgagattcaaacacttttttgaggattatagaattaagcttaacaataggacatcagagagatcagctttttgaacaaattaatttggatgtcactggcatattacctgatgcatttttaaattaagcatatgattttatgatatgtgctattatccttctactttttctttccttaaaaaaagcgttctctctctctgtttacccaccactccccagaaggatgacccatcttgacctcatgtctagtgtttggttatgcagatctctggccctttgaaatttgtgttctgtggcagctcctagctaggaaaagtgatgtcttagaacctttccttgtggatgtagtggggttaaagagagcctattgggtctggttacagaggacactctttctggactctggcagatttttcattttaaggatttcaagcatactctcaaactgctgctgttcccatgttatttacagtgaaagaactctagctcacttgtaattcagggatgactcaggttacattaagtctgtagaaaggacctgagagtgattgtgtcctgtggtataattttactttgaaatcccttcccatttgagctcttgagaaaagaagcctgtaagtagagaatcaccaatagacatgaaaagcaagcttactttcagcaaatgggtaaactccattgagttttagctcagatgggtgttcagtataaattagtgcttgatggagacagagtgatcttggattgtaaatctaatgtaatttttaactggctacatttttgagtctttttggtttgtgaggcttttgggttcttcccatctgttttccctagtggtgggcaaaaatagaaggaatgcacattcatctagaaacactatcgagtcatggagggtctgagaacaaagagggcatcagaacataaatatccctgtttacttcacagaaaatgattatctgatcagccaagagactggtgctaatcttggttctctccacagatgtaggactggctgtatccatagataagttctgtgtaaatggcaatttgagggatctatttggggcttagagaacttggctcataacctattccagttagtagagtcaaagaccaagaaatattacacaaagtttatagttcttttacacagttctctgcaaggtggagatgcttagtgtaactgtgatgagtgtaataatggactcacggtctaaagcttgtctgttcctttttagagtatttatctgagaagctcagacctgcaaagtactttagtttgggctgccataacaaaataccataaattggatagcttataaacaacagaaatttatttctcacagtattggaggcgggaaagtccaaaatcaaggcagatttggtgtttggcaaggggctgctttctggcacatagtgccttcttgctacatcttcacgtggtagaagggttaggggtttctctggggcctattttaaagggcgttaatcccattcatggagcaaagcttaatcacttcttgaaaggctccacctcctaataccatcaccttgggggttaggatttcaatatatgaatttgggaggacacaaaccttcagaccatagcacaaggtatcaaaaaggaaaccggcatgattttaggtggagtgtctaattaccttttggatctatactttgggagtttacccttttacaaatttcataaactatgttttgggtctaactagacagcatcatatccatagaagaaatatcttgtagtgttctttattaggtttagccaattactaatttctatctcatttcgacatgcaaaatatatcagttataaagatcacaggtcaagaatttcagcaccaattatacagtaaatttgtaattatgaatttaaaactattataacattagcaagttctatgcattcactatcttaataaggcacagatgtatgcttatatttttaacatgtcaaaactgtagtattgttcattttcttgttttatttgaatttttatccacttaaaatgctgaagatatagacatatgttcatatattctgtttaaaattcagaatctacagatttgaacagtttgtgaattggctggattatacaaaatcaagaacctcacattaaatccagttcttactgctttgttaaaaactacttttgcaattttacttgttgatgacatatttaaataagaaatttaaaccagtgaggaataagaaagttcaaatgaggttgctttggctgtctgtgtgtttaaaggagtgttgctttggctgtctacatgttcccatttgtacccagctgaagctggtatgaaatgtatattttaaaaatgaggccggacatggtggctcacgtctgtaatcccagcactttgggaggctaaggtgagcggatcgcctgaggtcaggagttccagaccagcctgaccaacatggtgaaaccccctctccactaaaaatacaaatattagccaggcactgtggtgcacgcctataatctcagctcctcatcctcaggaggctgaggcaggagaatcgcttgaacccagaaggtggaggctgcagtgagctgagatagcaccactgcactccagtctgagcgacagagtgagactctatctcaataaataaataaatacgaaaaaggagcctgtacaattttaatttctttcactttatgtatcaagtaagactcataggttttagaaactggtatattatattttctttcccacgaatggagacaatagaaacacttgaagaaatgggataaatttgacagtactttggattctcatagcaaaaattggtaaacttcaaaaagcttgtctattttaagactataggtataaacatatgtttttcatgctacaaagcctggaacatcaagtgatttttacttaggtttacagataaggtccctgtgtctgaatttgagaattttcagaggtctttcctattaaaaactttgtacacattctttttccccttcttttcttccttttcctttcttcctccctcccttcctctctgcctttcttccttatttccacttgatgttattcacctacattctcattctcccctgattgtctcttctttgctctctctcagtcttcttggggtccccttttcagatcattctctcccctcttgggtttcatctctccaccttgatcagtctctgaaatcttcttgcctgttcatgaccttctacctccagacacctgctataaggtgctacttaatttggagttgactgtggaaggatgcctcaggtggacaaaatgactcctctgggccttggaggaagaacctctagagcctgttctgttacaggccgtggaaggacagagacagaagcacaggcccaggagcagcggcctggcagccagccatgaggagccgctttgtcataccttagaagaaactttcaggctccccaaatgtgtgacacttcagttttctcaatcagaatacaagaaggcttcccggaatctctttttctagcactataattttgttagttccttactgatggcttgttaaaggaatattttactatatgtcatgttagtattagtgaaagattataattctgtatattaatactttacctttgtcaaaactaccttctctttcccctcaaaaaagcaagtactttagttgtgggtttgccctctcttttgataggacaaagtactcttaattcctcagtaaagtagctgtcatctgtgtaggtcgctaagcccaggtttttcattctcttctccttaagattttttgggtctgaaccccatttgggtggagatgccactggcatggaaattcttgctggtgacctcacctgcagagattgtgggcatggcacctgtatatccatctgccggactttgggtcatgcaggaaatcctgtgaaattcctgctcagggttaaccaaagggagcagctctgaagggttacattcttctggccagtctcctcccttattaaaatgtgtaaagaatcctttttagccatgaattcttgctgacaggctgacccagggtcaggatggtgggtaaagctaagaacattccaagatacatgtggaccaaaaaaacacatgaaaactggtacagacttggtattagaaggggtcttagtgatgctagcccaacccttagaaatgggatgcctttcatataaagtagggggtccctaaccaataatattgactaaaagcatgagccctggagttggactggcgtcgatgcagatcctggccttgttacctattagctatgtgctcttggatcctaagcctcaattgttacccccatctgtgaaatggggaaaagaacagtatcagctttctagagtttgtatgaggattcaatgggaaaaagagtataaaatgcttagtatattgtctggcacactataaatatttattaaataactgttgattaattaataaattaatattgatgaattcaacattttgtatagtttctcctaattcatttttgaagggcatagagttatgccttgaataatgcccttgaaacttttaaagtattaataaatgagtcaactctactttgctttttctcctaggtgaaaagaaagggattatctcagacagtaagccaggaggaaagaaagagacaagaggtatgtttctaccgagcagctgctttagagctctggagtgtgcatgtcggtgtctgcttttttgtgttttcacttactgtgtgcacttgtttagtgttgccctttgaaaatgtatttgtttaacaaaagcagtaagtgatcattttaatgtaaagctacgcataagcccccagaaaagaaaaaattttaaatatctcaacatcactcaacatcgtttgattttaaacaacaaagcacctagttcaggtatttaaactgagagaaatatgataaaaaatgaaaccaacattagatcttagaactgaaaaaggatgtttatggaaaaactgatagtcacgttagtctgtagacaaatgtagcctatttatgtaagataccctaggttagggaaagctggatgtagcatacaagggtctctgaaccctttttgcaagttttctataaatttaaaattataccaaaataaaaagtttatttagtaaaaaaaaaaaaaacaggttaataatgcagttttacaacttgaagtttaaatcaatgcaatttgagaaaattgcttattgtaataatattgtgaagctctcaaagcattttcctcttgcttcctgcatattattgtgtgtgtgtgtgtgtgtgtgtatgtcaatgcatatacatacatataaattgattccacaaaggacccaaggatgtccttttttttttttttggttggcatagaataaagtgaaatacaagggtgcagtatagtgccattttttcaagtttaaaaaaaataatagtatagaactttggtgtacccatccactgagaattaacaaatgtataacaatcgtaatttttctccttttttaaaaagaacataaaactgatagtgtagaaggcctgcattctcttcctcagtcctgtcctattcctttcctccccagagacaactataattatgaactggtacatatacttccagcctgtgttttaaaattatgtataacatacacacacatatttgtgcatgtgtgttaaaatgtatatgtatgagattctatgcatattttttggttttctgttttttacactcaacattatttttgagattattcatgttaatgcatatgaatctagatcattcatttcaatcatcatatagtactctagtctatgaacaccacctttaaatattttttatctatttttccaatgctggacagtaggtgggactttttccttcattgttaacattgtgacataaaaatgtttccctctccttgtggataaatttaaaagctcctccaagatattaatcccatttgaacatttttgttcttttaaaccttatataaccttgcctatttctatcatattctgaaaatatttattcagactttctattcctatatagcaattcctacctgctatatataacaggtctaacctaatttgcttttaaatagttgatggtattattgcaggatattttagcaattattttattaaacttattataataaactgccaattatttaccttttcctgtgatctattataaatagttcattaagtctttttgcccagtttgagtatttagattagattacacactctctccttgatgtaatcagaagtaaggagtgagcagagtgggggaaaagaaggaatgaagtgactttggacagctgtctgctgtgacaattcattacacactgaacatctgtctgtccacccaacttgaaacatacctcaaaatttctttcaaggaatcaagacaaaagccaaatgcatgagacattataaccctaaatggcttcctttggagataacaaagggcttatttgtttatgcccttcaggaacaaaagaaattatttaaaatgttgaattcagcaatattaatttttgttctcaaaaccctcaattatcacttaatcacattaatcagttagcatagtacagcattgaagaagtgaaaaatgtctttgctgttgcaaatattttaagtaattccaaggcatcgtatacatcaacacctgaaatccattatttatggtccagaagggaaatttttctttaattcgctttgtgtatagtttttgggggttattgtattgattgaaaaaattcaatacgcaggttaaatgagactcttaacattcttactctttactcttcagatagttacatcacttaatttcatgaaatacaactgaggctagattagcacatttaagtaagacccaagtccctaaaccttacggaagttaaaagtggaggtgagcactgagattagcacttctaacctgatttataaaatatggagcacccatcagcagctgggtgtccacctgcttgtgcctttcctgctcccacccagccacagtaccctctgctctttggggcaaggacttgaaggggtggagccctggagatcagggtgatgaagacagaattaccagggagctttccaggaaggctgtgaatcttaggcctgcattttccctatatccctttttagaggatctgaatttgattttgttaaggatctagatgaattccttacgcagggcattggaatcttatccacatatgtgggttggtatttcatcattaacagttatcaggaaaaccactgtgtgcctgccactgagagtctctgcagagagtcctttgctccttcttgagacattgatgagagtagagaatgtgacttgttgaatagatggaattactttcaattgtatgagtttatataaaagaattcctgtggttgataagaaccttttgagggtagacacagtcataccagaatatttgctgttattgactgaaaattagtcagattaagcatagggagaggaagagtgtgacacacaagagggaagggaaggaaggtgtgagaaattttctctgaatctcaagagatgaccataaatccttactgtccctaaagcagcatgctttgaaagcagggctggaggagatgaccccaaaggttaattaatgtctcactgagattttatgacatgccctcgcttccttccatagattctaccccttggcaaaggcatgacctcaggatgtgatgtcaagtcatccacatgatttcatttttttcatatttacagatagtgattattttttaagatttgggtaaatgtatattatataaagagagtagttttgtgatgttgtttctttaatgttctttttgtactttccaagatactatacctgaaaagtggagtatcttgttattcttacagcaaaattatgagagctatatttagttctttaattaaaagaattaataatacatttctttttccttcttaccaggctatctttgaagtcatatcctctgaacattcatatttactcagcttggagatcttgatacgaatgtttaaaaattctaaagaactgagtgatacaatgactaaaaccgagaggcaccatcttttctccaatattacagatgtctgtgaggcaagcaaaaagtaagtgcactgcagtctgcctttggtcgtgccaagaagttgcgtactaataaacactttgttatctctaaaggaaggcatttctggttatcaagtctcattcagttggcttttgtcttgattccttgaaatacattttgagatatgtttcaagtttggtgaatagacagatgctcagtgtgtaatgagttgtcacagcagacggctgtcctaagttatgttattcctctttccccactttgcttgctctttacttctgattacatcaaggaaagtgtcttcgtttggtgctagtctgtgatattcatccatttcagtaaagaaagagtaagccttaggcttaggtcttctgcaggcaatatctggctacgatttaataatatatattttcattatatttaaggatttttgctttactttttgtcatgaagagtagataaaatcatataataaacttttatacattcaaaacttatatttagcaattgttaaaattttccatatttacttatctattatttttgcttaatttttttccaagtatatacattggatgttttacttataaatgctccagtattcagctcttaagaataaggttattttcttacataactacactgttgtggttatacttatgatgatgcttttatgattttattccatttaagttttgtacgtgtaagtagtagagtcacatgttgcaaaattccaaaaatatgaaagatcctacagtaaaatgccattcatatactgttccctggccacctgaaacacaaccagagtcaacatttgtttcttgtgtatctttttagtaatactttatgattatgtaagaaaatacatgtatatatatatttttcttgtttttacttaaatgttaccatactataaacactgttctgctccttacttttttttacctctatcctggagattatagcatgtctgcacattaaaactttccttattcatttttatgttttttccttgcaattatttgttgaagaaatccggtcatttgttctgtagaatttcccatgaggcacataatttatgggtggtgatcaataccagatccattaattcattaaggattgtaaaacagtgttactctaatttatcgttctttattcatttattagctgaaatatttctataaagggaaaggtacatccatctattcatatattcagtggtaaagttcacgttattctatttattagtgctcaaattgttccatctttgatcttaacaatttttgattattttcttgctatatgacattttaagatgttaaaggatcatgttttacaattcctgctccaggcctggaatcaaccatttccccaaagagctctggtgtcttttgaaatgaggtggtatttaaaacctcagtgagtaccagcgtgctcattgctaagtggttttaggctgtttcagtagatacccagaaaaaaaatccaaatttttctctataaaactagatatattaaaagcccatagacactccaaatttatcaaagtatatatattaaataggtacttttttatgtatcaattatacctcaataaagcttaaaacataaagaagaaagtctagtttctattcttgtcccctctatcctattctcttcccatatagatactcttaaataagttgtttatctttgttttttaaaataagcatatgcatatgcttatgtatatgtattcccctcactttcttagataaatgaaagcatattctacttatttttctcagcctctttattcatgtaacaacatatattagaggttactccatagtagtttatggagatgttttactcctttctccagctacaataattatcatcgagtaactgtgtagtagtttattcatccagccgcctatctgtatgagcattaggattattttcagtctcactgttacagatagtttttctttgtgcttacaccctgctatatattagccattctatctttgagattttctagaattaggattgctagatcaaagggtaaatgcgtatactattttgtaagatactgccaaattcttcttcaaagaaattgtaccattttgcagtaccaccaagaatagatgaatgcttgcttccccagagtctttctagcagagtatgtcaacaaacctttagatttttgtcatctaacctttagattttgtctgataggtaaggaggattatctgagcatagttttagttagcatttctcttataagcttttccatatgaataagagccatctggaacatagtatgtgtcagtaaaatattactaaactaataatattcctctatgatgttggaacaatttaaaatttgagataagcactaacattacatcaacaaaagtcaaggaaggagaggttttctaatgctcgctgaaacacaagaatatttgctttgactagatcagcaatgttaacatgtaagattggcttagctagtgaaagagaattatctgcttaataagaaggagagggaaaacgtattagcatttttttttctgctcaaaaagttagaagctgttagaggcatcttatctgaaaaagttaatacaagtagaaatgatgaacataactgaatttatcaaataccaaaatattagaatccagggtattccttgaggcttgaaggacgtgtacgttcatttatttagttattattttagttatcttttatggaatacttataattcataccaagcattatgttgtagccttttcaatagagtatgtatgtatccttaaatagactgccctcagtgaacaaagtcttaggagaaataacaaaagtataatgtagttcatggttagtaggcatgtaaagatcatcactctaagaggccaggaaaactgaaggaaaattctaaaaggactgtaatagaaatatggttttagtttaataagctatgtatacctatataatgtacgattatttaaccaataaaatgctttaaaggaatatttaataatatggactttaatatattcagattttaaagcaggtctaaagagtgggatttcatattgttctagattttaattatttgaaaggtaatttatcaaaacataaaggataattatctttaatgatagaattatgagttattttaatttctgtctgtgtacttatctgtagtttcagcatctgcaataaacataatgtagttagaaaaggaaacacaaggaaatgagaaacaagcagtaagaaatatgagcccagaataaaacaggggaggtcactggatatggctgacaaattcataattggttaaccttgaaataagtcattttatttaaagtatagactaaaattttactttaatttcagtcatttacaaaattcatttaaggttttattaaaaattttatctctgtcatagcttatcgtaaggggctattttgaacatttttgtctattttttatttaaaaaagaaaacagatacttttcatcctccattaaaagaaaaacaaagaaatatctgtattctttacatttttattttgttttcacttcaaatgcaatgctttaatatggatatctgcctttgtaataatttgatctctgttatatttcaactaggaatgttcagcttttacatgataactctgtctatatcataataacttacattacaaaagtgtttttgatttagtttgaaacactcatttcagatacagcctttttgaaattcaaagtactcagaagatttatttgcaaaggctatttcatgatgtaaggcctgcttgttgaacttcaagagtgacacccaagtgttggtaactacttaatgtattactcatgaaagagtttgcagtcccaagaaaatgcgaaataaaatcttgagtaaaataaatgatcagtgtctgaattagatattacagagtaagcatggtattgttaagtatgtcataaccagggctatcttcattgttttacttttacctaatgaaaaattatagctataggtgatgacatattcaatataggttgcggtcagaacatcctggacatccaaattaacagtgtgttgtctagtcccctgtattgtggcttaggttgttgactgccaataaataacactaagatttatgtaagttgacactatttgaaaacagacaagcagggacaacgatcattctgactgtgtgtgtgtgtacgtatgtatcagtagtatgtctctgcaaaattcttttcttcttttaaaacatttctcatttcagttaacacttagggcctcctattctgcaaggctcctaagttccaaagcatttcagctggtggcatctccccaggggccgttggttcttgggacccatggtagttggcgaacacctccaatgtatttgcagaggcgttttagggcactttccttgaaatggaaaggcttgggtttggctggaggttatgggtttaaaggcccttggtgaaaatcaaaggagagcatgagagcagatgttcgtgaaggccattatgtgccctgctgaggcattttcaccatttcctaaagcctatgtggaaacatttatcaattaagtaggggactgattttgtggcattgtagagaacagtatggtgtttgtcttagcagagaggtgaaaatgttaaaagatttgaggcaattgaagtaacacagctagctagggtggaaactgacaggggcctccaagggatattgagagatatttagaatatggactcttgaggacttgctgaaaaggcggggtcctcctaggtttgcctcccaggtttctacctggttgactatcattggaaattgtattaaccaggatataagagaaacagattggggcttagggagggagacaaggaattcagtttggggcattttgcatttgagtgcctggaacatgagagtaaggtatttagttaaaaagagaaaagcaggttagaactacagaaaaatcttcagtagggatgtcaatttgagtcacagaggtggttcttgtcattttaagtttaaatgagataactacaacttgtagcagtggtttgtaagcagtggtggtggtatttaccccctaaggatacttggaaatgcatttttggttgccccagtagacttggggggctctattgacattagtaggtgggggccagggtgccaggcatcctacacttagtaggacagtcccagataagcctgaattgtcccacccaaatgccactgaagccctttttgagatgcatggagtaaaaagaagacgaatgtcagaattttgacaaagaaacatttaaggagcctgtgggttggaacagaaatgagttaaataggataagaggaattgcacagtgtgcatggatcttaagtcctttggctgtaaagggtttgcctctcttattaacaccttcctgttactctgtctcttagtgccatggcctaacaattgtttgttttctaaccctccttaaaaggagtatttggggagttagaatcctactgattgtttttaccctgcctaagaagggtgacacactttccttttgcatggaatgattagagctaaattctttaaatttaggtagtacctagatgactttgggtcagtgtcagggaaaaaggctttgacttccaactctacttccttcctgtttaactgtaccaacttcttccctctgactcaaattcatgagcttttcctggtttcatgatctccttgtcttttaaggacctcggctatcttaaaagcctgatcatctcatgaaaaatggagtatttgatatcatctttcaattagaaatgaataggcttaattcataactaaacatcacacatagtatatactttgcatattttcatatttcctttgatttttttttggttcttcccctacaaaatctacaaaaatctatggttacttaggataatttatagataatccctgtgttaatataaaaagacctataaatgtgattaacttacaatgatttgcaacagaatatgatctaacaccaattgtttttaaatttaagatacatccctattaaaagactgatactattaggaaagaaaattgtcttttgtagaagactgaatgttaacccttctcccatatttagaaactctaaggtctaaataaggtcttttgtgttaaaaagttttctgcaaaatgaaaattagatgagtctttgctttgatgtttcataaaaagatgggtttttactctcaattctgagttttcattctaaatacctaggttatgttaacagtctttcatttaatttttttcaataacagagtgtgctgttattagtaccctataaaaatatgctactgaagacctttgcaaggtacttgtttctctttttccaattacaaagttaaaacattggtattctttggaaagccatttaaaactaaaactatgcttgtcttcaatttctgcagagtaaagtaaaaatatccatcaatgtgcttttgtgtcctgaggaactgaatttgttcccaacatataatgagcagtgaatgccaaattctctggtttctgctttgtgtagcagagtaaattacaataatagtaaacatacaaaatagtacttaccccgcacttgcttctccagaagttttttccctaattttaatcaaactctattaaaattgaaatgtcatatgacattaaaaactaccttacatgcacttgctttaatattattttatgaaatgagttcatattaccaaaaaatgacaatttatgtaaataatagtatagcatatctgcattatgaaatacgtttctatttggtaattaaaattctaaactttaatgcataagcaaataacagtaaaccttcaaaagtcttttatagtatgaatattaaaattttaactttcctgactaattcttaaagctaaattttaaaggaaaaacacattaaatttaactaggccagagaatatggaacattttaagttgtagaacctgtttaatttttgccctgaagtaatggctgttgctatttttgttagcaaatgttattttcttactccatatatactcaagataaacttaccccagagtctttggtaaacaaagccattaccttattttcctgaatataacagagaaactttattctttctaaaatcaatttcttcaactgacagttgaaagacagtgacattcagaagccactctttatgtcactttttgactgtttctctatcctgagattaatgacaaagaagtttatttgaaattcacccgaagtattttcacaatacttcaaagtaagtctacgtgagtattctagtccatgttgttcagctcttatcaacaaccagtgtctggagtaatagtaaaagaaataggtagttgtttaggtattatttcaataaagaaagaaaaactagtgatgttttaatagatgcagtcctttggataagacctcaggaaagcagtgtgggatctgaagtctttgtacaattgaacaggaggccagttaaagatgactgattagagacatgcactgtattcattctcttctaaaaatcccagtaaaaatgatgggaaggtcaatacacaaggaaaaagaaaataagaatgagacaacagctacaatattttggaacctgaaaaacctgagatggttgtccagtaatgcaggaaagtttaaatctagactggtagtgaggaaaaccaaggatcaaccagattgaaatcccagaacctctgaaaggtggtgcattgattgattgattgattggttcttccttcacaaatctatggttacttggagtaatttatagataattgctgtgttaatagaaaaagacctataagtatgattaacttaattaatttggtctaggactaggttaaaggtaattcctaggtgcaggaattgatgatgaagttgggtaaaggtgtgactaaaactgcaagtttcatgcaaatctgtttgagaagtagtcagatcctagatcccctctttggctctacccagcaagatgatgaccctctttaccccagcagcagggcagcattggtgaatactggaccaggagacccaggaccacataagaaggggactgttgtacaggaaacgaaggtatagtggcagttggcacccacagccttctgcgctactctccttttggaatgctggtagccaggtttgtgtgtgtgtgtgtgtgtgtgtgtgtgtgtgtgtgtgtgtgtgtacactttgtcccttttctgtcaaatagtgattggcatagtataggttaagtaacattttatcatctttgttaatggatttatgttcaaatacattattattaacatcattattaggttttgcaggaaacaataagttgagtattacagcagaaatataaaaagcctcaagaaatatccattttagtaacatgttaggcaagtacttgttgactttaaatcttaagtttctttctcatttaataaggatgatagtatacttaaccttataagattgttttgaggattaaatgatatacataaaatgcttagcataacactagacaagttctttagtagcaattattttgttgatgttattactaaatgatttttatcatctatgtctggtattctgaaatgtctctggattttgtatttgttgacttttgtaaatatatgcctctgccagcattggtctaggactaaattaaagaataggtcttgttttatgcagcatctagtgcaatggtttgcatgagtttatttttaaaggtagttgtggcacaatattacattttagcaatcatctttattttgacattgagtgaatcaaagtaaatagattcttccataatcataaagaattaattgtgacctagattaggactaaaacctgagctattttttccaaccagcctggtgttttctttgtgagtggtagattccttgaatcagtgcttcagagcaggccctggcatgcttcagctgccaattagaccattctcctggtcactttttgcaggcatttggacccattatgttctttttgcattgcctttacaaattctaagtctgtggattctgagttgtcacatggagatttaaacttggataatgagcctggttgggacagactaaagtgttacctacttagtcattagctgttatcaatcttaaactagggtagaattttgtggaaaaagaaacaatgactggggtttggttgcagtgtttcatctgcattgcatttatagctgtggattttgaaccattacatggatttttgactctgccagttgtgagtaaaacaagcaggaccacacagtttttctggctgatggaaaagattttaatttaaactttgtattctagccaagttaaagctagcacttgatttaagtggaagggagatggttgatgaattaagtttcaaaagcagactttttaaagccttctaattgcttatcataggatgttgcctctaattgctgtgcattaattattagcatctgggcatcaattttgtgtttctccaaaaacttttcttatttcatctgatttaatccttaatagcatgctgtgaagtatgccaaatccttgagtaatgttgttttgctataatgttgatgaggggaaaaatggattcccagccagggccattgcatgtgtggagtttgcatgttctcccggtgtctgcgtgggttttctccaggtagtcaggtttccttccacctcccaaagatgtgcacattaggtgaattggcgtgtctgtggccccagtctgaatgaatgtgggtgtgtgagagtgcactgtgatggaagggtgtcctgtccagggttgacacttacctcgccccctgagctgccgagataggctctggccaggtgtgaccctgaactggaataagatgcttgggaaaggaatgaatgaatgaatgcaaatgattatgaaatataaatttgtattatatatgataatcatacaaatgcactataataaacgatgcttttagaaagcgctcattgagccgccgtatttgtgattgtttttgaaccgcatgatggtaggaggtgctccttccaattttcactttgcaaacatttataccttgatttaacccactgctgtcactcactgattcaccaaaaattgggtaaataattgtcttacttgtttttacttctctttcttaaatgtatatctagcttacatttatttcagtgtttaatattagaagtgttttgagtgtttatttagaagtttggtgattttctttttgaccagaaatatcctgtaggaacttaacttttgtttatatcaatgagcctttggtaaaattagtttagttatacatcatttcacttagagtcacagcccccaaaacctatcaacaacattgtgtggacttactgtactaccatttcccttttgtgggtaaggagactgaggcccaaattagttacgtggatttgtttaaagtcattcacctaactggaattgtacctagtgagttttttgattcttcataatgtattggcatagactgtttgttcaaaaatacatatatattgtaagtgcagttaagggttcagtctacagaactaaattttaatttaaattttaatctgccagggattacacatctggaaaattatttgaacttgctcctgttggtgtacatcacccatggagctagtcagacggagtgatgagatttttatctcatatttgaatgtctttgacctcttagaatatggagacttaaaagcaaagagcatcttgttttctgtggcacagctctgtggcacatcataaaggtcattgtcttattttctcatggacattgttcccgaagtgaagaatattgtccatatctttagcataagcagtctgtgaatgtgtcccaatggtttggcattgcagtattctctagaaataacctaattgattataaaagtatcccataatctgaagtgtgtggagtttgtatttattaacttttgcatgtatgctgtctatgtactttcctcagattaaaaaaatacccaaataacatacactaccctccttaaactactttacagtgatttgaggaagaaaagaaaatgtatgtttggaaagtgccaacttaattcaggttgtaattttctgctttttggtctaaaaaatctgttttcaaaataaacttttgtagaaaatgattttgcaagtctttttttaggacttaaagaatttcttatatcttaggtgctgatataaatactgagcaacctcacagcaaaatattttaattttttagagtatcaactttatgtaaaaaagctgtgaaaatatgatttttaaaaaaaattttgaaatcacctatatgctaagaagaaggtgaagactgttttagtattaattcagtatattattaccattctctaattgttttaaggatgtggattaaatcatgtaagccttgttttttaattttaaaaatatatttataaaaaatatcctgaggaacatatgatgaatggtatttgttaaagaacttaatagatactttatacagtgtttcctttggatttcaaaaaggtttcgggaaatgacttggactttgaaaaaaattttggtggaaaggttccatagaaatgtcaagattggctaagattgaccttgtcacttgtgggggattcaaacaaaggtccctttgtaacaagaaaaactgtctctgtattgggagttcattggaatttcttttctagcagagaagagtaatacgaatgaccagaacagggcacaataggaatgtttgtgttcatctgctgaagttgtcctgtgatgtagcttctacttcttattctcttgagtcttgtatatatttgatacacactacttagttataaatatttaggtgtacatttgtgaatgtttttagatagctctgaaaaaatctgctgtgaataagatgctttccaagaaatcctcagcaagcgttcttacaagttgagattttacttgaaggcattcagttgaaaagaaagctggagtgattaagttatgaaattattctcttggatttatctaagtggcattaaggatttttaggaagactggtttaaaaaatgtatgtcacaggtatagatttaattattttatctttgatttttggaggatctcatatggtcgtttgagaatctgtgtttttcaggttttaaaaatattaaatatgggaggagtttggtttacctcacttatgcttatgccattcctaggggtcactgtatgcctcctgttttgaaccttgacttattttttaatcctttttcttttttcagtcttcctggccaatacccagtttactttcacaaagctgcttttgtgattgtaatataattttatttgtccagaatattattttaccactgttttaataaatttagagatcaggatatcattttattaatatttcagagagagagacactaagtgattttctgttacttatggagtaccttttccaacttagaatggggaaaacagtataattatttagaactaagatacgttttctctgcatgctgttgaataaagcatatttttccggactctttgaagaccccaatatttggaaactcaggtgttcaaactggagaaacttgcctgcctttatctattttattccagactttcctggcatgaactaattaccaactttgaatactagtttttattgatcacatttctttttcctgagacctgcataaggaatgttaatctcatccttagacagatcactttgtccctctgcatgtcagctgctaaatgaactttccatcagcatggaactaatgtttatcggaataactaaataatctaaaaccagggccctaaggtttcacttgctgtgagtctgttatcaccagctcacactggagaattctttttcgtaccattgctttttctaaacaataatttctatccatggtatgtggatttggaagttagtcttttagagacttagctttgcagacattaccttaggctcagaagtctgacttaaatcagggtctggatgtagtgaaagcctcctggggatggtttgaaaaaatctagctgtacatgttgctacagtatttatttatatctatttttattttttatttttgagacagagtctcgctctattgcccaggctggagtacagtggcgtgatcttggctcactgcagcctctgccttccatgttcaagcgattctcctgcctcagtaggagaatctactactcctactgggactacaggcacatgccaccatgcctggctaattttttgtatttttagtagagacggggtttcaccatgttagccagaatggtctcgatctcctgacctcatgatccgcccgccttggcctcccaaaatgctgggattacaggcatgagccactgtgcccagccagtatttatttttaatgtgggaaagagttgctagaggtagcaaacatatgaataacctgaggataggaaggtaacgtatgaaaatggttttctgagagggaacgttcatgctctgaaaaacagatggagcagaaagctttataaagaagctgccttttcctttcctctggaattgttgaacaacatctttgagggaaacatgacataatattttgataattttagtgagtgtatgtatttgagcaaggctggtattgagttgtaggctgtttggcatggtaaaagtttgaattctccagagctgcttttaatccatttgcaatgcctgtgttttttcttgtgagcagtgtgtatcctcatcaggggctgcctcaatgcttatccatctggaggaggctactcagctttaattaaagaaacagtggttgagagggtccgcctacaaccactgaaagtaataaatgtacatggtgtaaaattcaaatactgccaaaaagtatgcactgagaaacaagtccccctgtatgactggtttggggcgtagcttccagagatactctctgcacatacaagtacagtttttttaatacgatgattgcctaccatacacactgtatgcaccagtacctatttacttttagtccatcaaacagccagagtcttaagaataacaccgagtataattttttaaaatctttgtatgctccccaaataagcccaagttttctttatgtagtttcttctacttaggaactttaaatgaataggtccacatgagttatggactttattgtgaaaatagtcattgctctgaatatgggattcttattgagcattacatctgattccttgataaaatattttaggatgagagcacctactgtgtaccaggcactgtgctaggcattggaaatgtaacagtaagcttgacaagcgaggtccttgtccttgagacctggtgggataaacacacacagaacagatgcctgagaaacagagtattccttaaagtaggaccttggcctggatgggggaactgaggaagtgacctttccttaccgctcaatcttctttcctttcctcctttgtcaaattaatctcattagattaatagtctttatcagatgttttaattcaaatataattcagtctagtctctagatatagaaatgccatactagtcacatgttaattgttttatatttgcaagtaacttcattaaatgggcacctgggatgtatggaacagcttaataaaccaacatttctgcactgtagttaaattgatcctttagctacaatatgaaaatttttatttaaagaaaaacagagcctggattatgtcacagtgcaaaatacgaaacatatttctagtttgaatgcataattcttggatttccctgcctctgaatgatttctaaatctggaagatttggatcctgtcaatttatttagcttacggaaaagtcatctgatctatacttcaggttcattagaaactccttttacatcatgtccttaggtaacagttttatgaaaatttctgtaactcatgattgcagttttgttcttacaatctccaggtattttatttaaaaataagaaataaaattgtacaacctatcaactgtgtgatcattagcttgattaagatatagctcacctgctgttaatttatttatcttagtaagccatgtggtgtgcatgagcttattttactctttcactttgttctgtgattaataaactacttccatggaattttgggattgagtttagaggccatatatcccattctgtaatttacagatagtatcccagatctcacagctaattagaattagagctaaggctagaactcaggacttctgacccattttataggaaagggtggttcactgtgtttttagtatgttatatatttacgtggcttaaaagtccaaagaggctgtacacgttggctcacgtctataatcccagcactttggaaggtgggggtgggtggattgcttgagctttggagtttgagaccagcctgggcaacatggcgaaaccctgtctctacaaagtatacaaaaattagccaggcgtggtggcacatgcctgtagtcccacctacttgggaggctgaggtgggaggatcacttgagcccaggaggcagaagttgcagtgaaccgagatcactccactgcactccatcctaggtgacagagactctctgtgtcttaaaaaacaaaaacaaaaacagaaaaacccaaaaatggccaaagattatcaaatagcatctgtttatatactgagaagcccagacgcgttgactctgttacccttcaccttctgttgatgtattatattagttgtcttgtttatcctcctagcatttccttatgtagatacaggcaaataaaaatggtttcttattgtcccacttttctttaaaaacagcgtgctgactgtatatgcgattctgccacttttttttttctctcaagaaagtttaaatttaagctcctgaaaaaagtcagtgtgcctacagataccactttattttgtccacttagatcagaactaggttgctatctttagcttaattctagcatatgagaaatgtgagatagttctatgaagactgtagtgaaaaaaaaaagattagaaatgtaaagtacaaggtgggaaattattgaaattgctattatttaacccaaagaagaaaaagtttgggcattattactttatagatgaggaaaggggaggctcagatggaggtaaagtaccttacccacagtcacccaagcactcggagtctcaatgggggcctgcactcagattagcctgccagtattgaagtctcaattcctcatctgctacaggagcctgatacatttgtgagtgacaagtatagtcgatactcattatttgcggattccatatttgcaaatttacctatttgctaaaatttatttttaacccaaaatcaatacttgtggttttatggtcattcacagtcatgcaagcagagcagcaaaaaaaaaaatgtgtttcctgacacgcgtgtttccagctgaggttgaacaaggcagtctctgccttttcttatactataaacaagtgtccttctgatggtcgattaagtgccacagttttttgtatttttgtgctttttgttgatcattttgctgtttaaagtgatcccaaagcatcgtgcaaaactgtttagtgtttacaagaaggctgtggtgtcttacagagaaaatgtgtgtttaaggtaagctcatagtgctattgtaagttagagttctagtgctgtactgctgttggcgtgagttcaatattaacaaatcaacaatatgtcatagttttgtgactgcagtgatagtgccattggcgtgagttcattgttagtgaatcaacactgtatacattaaataaggtgtttttaaactgaaacactcagaaaacaaagttatgtattgatcagttgatgaaattattgtgaccagaggcttgtaggaacccacactgtgtttccactagttcagtattccagtaattcaatgttcacagcaacttcatggaacataacttctgggaataatgagaacagatagtaaatgcaaagccagaagtagtcagcttcctgccagttctagctatgttttatttcttttcattctaccctaaggtacaggaggaataatttagtttagctataagaaaaaaaaaaacaactagctgggcgtggtggctcatgcctgtaatctcagcactttgcgaggccaaggtgggtgaattgcttgagcccaggagttcaagaccagcctgggcgacagagtgaaaccccatctctacaaaaaatacaaaaattaacctggtgtgatggtgcattcctgtagtcccagctactcaggagctgaggtgggaggactgcctgaaaccgggagaggtctaggctgcagtgagctatgattgtgccactgcactccagcctgtgacagagtgagagcctgtctcaaaagaaaaagaaaagaaaagaaaaaacaaacaaacccatgacttcctattgagataactcaggactatgaaatacaaggttaaattgcttattataaaacatcataacaattgagacattttgaaagttgctgacagtggtgttactgatagtatagcatggtgactaagagtgtcatcagtccacctggattccattcccttctgtaccatttgtcctgtgtgaccttgagcaaaatacctaacatctttgtgcttcagcagtcatgtgtgtaaaatggagatgataccactaactacttctttgggttattatggaagttaaacgaatcagtcagtcagtctatggaaagccattagactagctcctggtatacagttagtgctttttaaatgattagagtaattgcatctcctcatttgcccaggataattttagttgtgattagctgcccctttcattctcaaaagatatcccaatttggaggataaattgtatggtcaccctctaatgtaaggatgattcataattatcagctaatactgaattattggctatttctgtaaatacctgttgggacgattgatttctttttcttcttcaagaagtaagttgaaaaactccctcctcctggttttggagggctgcttggagaagagaaatgggagaggaacaggttgagtattcacatgtggcataattgtgtgttgtttccttattttgtgtttttgctcagtgaaagaaagtggtctagaatctggttctggcatagagagattatatctttcccactggacagctctttctctagtagccaggaaagacttgtgggaaatatagtttatattttagaacagttttaggttataggaaaattgagcagcaagtacagagttcttatataccccctgatgctgctcccaccccacacagcttctaccctactatcaacatcccacatcagaatggtacatttgttgtaattgatgaagctacattgacacatcactatcacctaaagtacataatttacattacggtttgctcttgatgttctacactctatgggatggataaatgtataatggcatgtgttcatcattattagtatcatacagaatagtttcactgctctaaatatcctctgtgttccacctgttcatccctccctctccttaagcccctgacaaccagtgatcttttttattatttctatagttttgccttttctaatgctgttgagttttgcagtagttatttgtcccttgtcccacatagtcttttgagatggctatgagacataagaggcactattgaacaggcaggcaagcaggtttggatttgggccatttgaaggctggagacatatttgggagtggttagcatgtagatggaatttcaagcaatggtgctgaaagagattattggagaaagactagagatagagaagttaaagctgagcaccaagccctgagaccttccaacactaagatattgagaagttgggggtgggggaggactggccaagaatgctgagaaggagatgccagtgggagtagaaggaaaccccggattatgtgtgctctagaaggcaagcaggatgtaattttttttcttcttcttccatatttataaaggaagaatcaacataccttaagaatggtttcaatctcttgtggcattcttttgaggatcagtattttgtgccatgtcaatgagatacagagttgtagacaggaaaggctctgcgcaagaagcaggtgcgaccggctcattcagggtgtcatcagtgtaaaaaggatacacttttggaactctggagtcatggcatggcccctgtgccttccagaagattattggagtaatcagcatcacttccaaagaagtgaaaagtgaaggggaggtagagcacttcagtaaatgcagtagatgctgttgaagtttcacagtagctgtggaatgtggatgagtcttctgctttcatttgttttcagaatgtggaaagcacaggttgtgtttaaagacaggccagcctaggcagagcctgccatggccaggcaccatggtgcacacctgtaatcccagcactttgggaggacaaggcaggtggattgcttgaggccagtagttcaagaccagcctggccaatatggcaaaccccatctttactaaaaataaaaaagttagctgggcgtggtggtgtgtgcctgtagtcccagctactctgtaggctgagacatgagaattgcttgaacccaggaggtagaggttgcagtgagccgagatcacatgagtgcactctagcctgggcaacagagcaagactctgtctcaaaagaacaaaaccaaaaacaaaagcaaaggaagagccagccatatagaacagatacattcattctaaggggaacatgttcatcctcaatatgtttcttcttataaaataaacatccaagggtttttttgggtcatttgtagtgatttgatttccaaaaataattagctttataaacataaattgcataagtaatgtccccattttataactctaagttgtcattatggaagggataggctgtgctgtaaaattgttgactttgaagtaaaatgcttattaaggatcatgagtaccaattttcacatatgtcgtagcctatgttgtagccaaagtcgacatttgagaaatggttaaggttttacagcaacgtttactttattatcagaatatagtatattcagtcaagtactattaataccatttcatatcgtaattatgccatttcaagggaatttattagaaaggtttacatggattcttctttgcattaccctccactcctgccacccccccaccccacctgcagccatccacgtaaaaattcattatgttactgccttggatttttgccaatatagaataaataattggatttagcttctgttacagttttgtctgtctcagattatgaatgtaagttggtaagattttctgccaattttaattcaccaagattgcattaaaattatgaagagacaattgaatgtaatttttctttcctttactcctgtaattgaactgtaaaagttctcaattaattacagttcttacagagtatcaattattgcaatttgcaaactccagagcctttataatgaaagataaacattttacaaccatacatttgtcaacgtttgatgctaattgcagcaattaattcgttctttaatgtttaatgttttataggttaatgaaagctggcattctcttccctctttatgttaatatgagaaacttttcaggagtagggtacagattgatacatgtataaaactatttttgcaatctattgcttgtcttagcaactaaatgaaaaccagaggttgcagaggtttgcttattcttttctctgcatatgtagagtggaggcctgcaggttcctgacaaacaagagcagaagtttaatgagtccctaaaaactcagtttgtttctaaataaaacataaatttggagagttgaaatgagtgatttcagaaacctttttggcttgggtgaaaattagcatcttctcaagtatttcttaaatgccttgtcatttgaagatgataatagtatctatgaccatttattcagcccagtgtgctgagtactgtggtaagttcttttagtactttatgttatttaatccagaattcagacaagatctgactccagagctctctctacagggagacaagttcaaatacctgccctggcagccaggccatatagcttagtaaagtaggatgggtgtgagatgggtctgagtagtgggatcaccataaactgggctgtgagtacagcgccagtcattccagccatggtggaatgtaagctcagtgttgccagatctactgatgtttcagaaaaagtgggaaatctagatgtgtgggtgcacttccttaatttttaaatgtttggagctaatttaggtttttaaaatacatgtgtagggcagtttcaacccaccagccatccatttgagagctccgaagcacactgtgttggcttgatcttttggtctgaattagcttgatacaatggctggggcttgtgcctatgcatcaggtggcactcttgaagttcctcagagagcctctctacaaattcagcaggggttggagggaagaagggaaaatatatcttaatgaattatattaataaatactaatatgtaatttgaggcattgaggaaatacaattatataactttcagtgataaagcatgctgatctttccttcattttccttcctgttacagttaattgggcaatcagttaaataatatgcctttgtcagattttttatattagagcacctaaaggatcaggtagatttcttttttatagtattaacacagaagtaaaaacaaagtagcctttctttaaaagaatgaggaaatgtatacatacatatacatactcatttttttttctgaattaaaaaatagttaagaaatttgagttggcttggcaaagaaaactgagaaaatgcttaaaattagaaaatatatagacatatactttttataaacattgcaaagaaaaatgatggagactatttttatgttcaatctctaactgtcctaggcatagtgtaagtgccctccgcatgcaagtcatgatttactgtgaatgggtctcctgtatatactgctttcagcctgtatgttttttaaaaaattgaatttaccattctgtgtcataagactagagggtaaagttcagattttgaaagtctaagaaaatgtgatggcatcccattcatcttgtattaaaggttctataaaccgtaatggttagatctttgacctctgttcctacacctgcagctagtcctaaatcaaagtgtttaagcctgacatgggctgtacctgtaactcagtgtggaagctgcatattgtaggctatttctactgttggagagggagggcgggcattgtggtaactctttttaccttttcatatgttcattaactttccaaggaaatgaaatgcttccctcttctttttctacggttaaatttcaagctagtgttaaaaaaaaaagtgcaaggaattaatgtaccaaaccctggagatgtgtaaaagaaaaacctttaaaattgtattttcaaaaatcttgagtccttttaacattcctatagataatttagtaaagataaatcatacttactttttcatgaagctaattgcctctggtttgtatcccctgagaaatactaatttacaaattagaacctacaaatgatttttgtttcaaagaccacttttgtttcagagaccactttccagggaacaattctcaataacggaaggagggtgttttagttcccccttcaaaggaaggtattggcactgtatgttttgttttgttttgttttgttttacaaagaagccagatggtatttattttgcatagctgtaataagttctaaggaaagcacttggaaatggtactaatgtttaatggaaagatgtataaacccacttgggaactgtaaagcattatgcaaggtatagtttagctatttaatataataacaggtaatcattctgtgctggctttgttattagcacaggtgccagggcattttggggctctgacattttatagaaaccagagtagctgctgacaactcaaacagtattgttaccgtggcagggcctggatcccacagtctagctatccagtggtgcctaccttctgttctgcaggtatatctttctccatcccttttaaaccggagactatcaccctgtgaaaggatcacagtgcagccttcccctgagtaaatgacaaataggcagtttctttagtatttttcacattcctgcacctggctgggagccagctctgcttttgtggcagaaagtgaggctggagagaatgtttgggagccaatctttggtagggaagtgacaaaatgcaagggtatatgtatatgggccaaagttaagataaacttttttttggtagttttcactgtaattattaagaggcaattaaaaaaaagaggtaacactagaaaatgacaaactcccagaaggtgtgattacttacaaatcagctgctctgggtcctggtgagtgacatagtcctggtgatcagtgtcagcatccttcacaagcaatgaaaggagagttcgcaatgacgctgcttcacaggatgtagatgggtccaggcatttaggctggctgagaggcataaagtggctgagatttggttgggaagaaccaagatgaggcgtgcctctgtgtgctttacgtagacggtgttgtatggttagaagccagtagttagaaattcggtttgaaaagccgggtctgatgtttcagagaaaaagggtaatgcggccagagacgtttttagaagcagattttggtagattctttttaccttttaaaaaaatacatatatatatctttttatgagatgaggttttcctacattgcccaggctagtctcgaactcctgggcttaaacaatcctcttgcctcagtctcctgaatagctaaaattataggcatacacctctgtgcctggcttggtagagtctctaaaaggggattgatgcaagaataaaagggagaagagtaaataccataaaaagcccattgcagaaggtgtgtgtttcaaagccagggtagagaaataagtaagggatgcatgtataaaacagaacaacattggtgaaatgtgactgtttatggtttacaaattactgattggcagcaggaaacatagatttaagaatatacatgctacagaaatttccctaaagaagtaacgtattttataattctaaatttactgttattaaagttagaggctgccagcagcttggttatggtcaaatgccaggtaagattttgggatatgaaacatttgacccttctgaactaagttcacatgcattggacctctccgaaagccttgtaagagggtataaaagcaaacttcccttagcttcctacaagtgaaaccattatttcctcttaccagggtaccttgcatggtgattaggcagaaggataagagttgtgatgtgttaaaggctgtgcaggactggctttagtgtggacataactgtctctaattccctggtgtgactggggtgggggacatgttggctgaattccctctcactgaccctacaaatacaaagatgcttaacattccacatctctcagccatttggatctatagagtggtttcggattgtgttccatcaggcctggaattccctgaaggcactttagggtctgccaatttgggtgtcagggaagcaaataactgggccctgggcctcctgaccctgctacaagcagaacagctctcttttattgtggaagtcttgggacttttcataagattcacttgaaaagggatgaaacacatacaaaatccactatctggggaagcaggaaaagagagcattctgtatgtgaacaaaactagctgatacaagccccggccctccatccatttctctagctgctgcacttattaaaagggctttattggccaggtacagtggctcacacctgtaacaatcccagcactttgggaggccgaggcaggcagatcacgagatgtggagttcgagaccagcctggccaacctggtgaacccctgtctctcctaagaatacaaaaattagcctggcatggtggtgggcgcctgtaatcccagctactcgggaggctgaggcaagagaatcgcttgaacccgggaggtggaggttgcagtgagctgagaccatgccactgcactccagcctggttgatagagtgagactccatcttaaaaaacaataaataaataaataaaaataaaagctttattgagatcacaattcatatgccatacaaataacccattaaaattgtataatttagtgatttttagtatagtcatagattgtgcaaccatcaccagagttttacgatttcatcacctcaaaaagaaatgccctacccattagcgctcactccgcatttccccccacacttccccagctctaggctgccaccagtctactttctgtttctatagatttgactgttctggagatttcatatgaatagaaaatataaaatgtggtctttgatgactgctttcttttacctagcataaagttttcaaggtttatccatattgtaatgtgtaagtaagtacctttcattgctgaataatatgttattgtgtgaatataccacattttatttatccattcattaattgatggatattgggttcttttttattttaaattatgctgctatgaacatttgtgttgaagtttttgtgctttcgatttttatttccctcgggtatatacttaggagtggaattgaagggtcatatggaaactatgtttaacattttgaagaactgccggcctcttcttaagtggatatgtgtagacttgcagctggcctctttaccacctttgcacctcagttcagctttttccagccctacaccctgcccttcaccctgctccctccagggttactttcctaaaataccagaaaccctagtggttctcttgttactttgaaacaaattgaaactctctaatagggcatttcgagttctacatggtctaggcccaggctatgtttataatttcatttaatagtaatttccaagttcttgcgtagatgtttcattatacaagcactagatgtttcattatacaagtcagtgattattgaacttccttttagttatggacccctttgaaaatcatccaatagccatacgtttcttgcttcctcaaaaaaaaatatgcatgtataattgtactgacaacaacaaacctggcatgcaagttcagagagtttgtgattgctctggcaccattagcaaaccatgaagttcaccaacacattggctgggcacaatctgagtgttctttgttcaaactactctctcacctctcttctcccttttctccttcctgctgattgcctaatgagaagctttcttgctttttagagtatctttcagagaatctgctggaaaggaaggtggtttggctcctttttccaccattgctgctccacagttgtgtgtgcagtcctgcagcagggccttgagggaattgaacagagagggctagcctctctgagaactagatggtgagtgccatgaagacagagacttttgttggaattgtcctgggctgtgtattttatgtgtctagaatagagcctggcacatagtaggcattcactaagtagtcactgaaagaatgggtagggaagggaattgaatctggaaccatcagctttctgggatggatgaagctatatatagtagggcccatgagttacaagggacccgtatgcagatactggatgttggttactgggaatggaacaagaggttagaagagagtttctaagacagattaagaggatgtattagttttctattgctgctataacaaattacaacaaacttagtggtttaaaacaacacaaatttattctttttcaattctgaaggtgggaagtctgaaatcaatttcactgggctaaagtcatggtgtcactaggctgtttccttctggaggctgtaggggagaatccgttttcttgcctttttcagcttctagaagtcacttttgtatcgtggcttatgaatttttctgtcttcaaagcctactgtgtaccatcttctctgatttctacttctcttctgactcttatcctcctgcctccctctcttataaggacctctgtgattactttaagcccacctggataatccaggatgattttcccatctcagtatcattaattacttctataaaatcacttttaccatgtaagataacatattcacaggacatggacatttttgagatgatggacattaataatggacatgtacatggccatcatttagcctgccacagggggctctaaaaataaacatggcgccctttgtgtttttgccaagtgtgtctgttccttgctcagggcttcttaattgtgacatgacttcttcctcacaatgattacgctaaggccaaggacagtgtttgcatgtaaagaaatgttccaccacttctcagttgctgagaactgttagttttccctggttcatttctctcccacatgtaactcactggggaggtaccaacacaaaggacttaaaaaggtctgtgctgcatcctcctctaattttgtcattggtaagtacctactaaaacagtagctatcagaatgggaatgagaactaccagagcatttttgtttagaactcttttttcccctcacatcccaaaccacttttaatttcttatcctcttattatcaatccagagataaaatttcagaagaaaaggctaaaatagaatatgagaagacatatagtctgctgaaaaggaagtctcttgagacctttaccagatcaggatgtaggtaggatattttctgattgagaagcaactgtcctatatttgtgtcgaatcaacacatttcctatcactgttagtctctggtgaaggattcatcgatgagcttcatcttcctcagcactgattttgatgtattgttaatggctgcctggagtgcaaactctgcatgtaggcagagtgccagacagttactgatgcctgccatgggttagtggcggtgcgcttgccatgcttttattctccctgatccagtatgtcaaaagaaactgacttcaaccttcagtgtcaatgtgaccaccaaaaaaattccaaataaagcagccccaaatcttacttaccggcagcagaatataaattcattttggtagagtacagaatgttctgtattaggaaagtatttccagcagcacatacttcgctgccacttatctggaatatttctttgtttagggaagatattttattatataacaacaacttagacatgtgaaatctgcctggtatgttacaagtctccagcctaagtgaatatgaccttctctggtaggatactgcagccatttagattgacagctcatttaagtgagggagacgtccaagaatgatttcagtttgctttaggcagatggatattaatgaagaaaaagtaccttgaaaggatgccattctgaggagggcaccggacagcggcattgattataaccagagctcctttttttctgtgtttccagagctagagtgctgagtgctgcgctgcttagtctctctgtcatccttctgaattggataggggaggggctggtctggcaggtttttcagaaaatgcagctggcattgaagaaactcagattggactgggtctctctttagtaatcctaattgaagaattgtaaagacttgtgctgggagtttgtgtcttcattggtggcccttcctgtacctagcacagttctgggaagccaacttgtggtcaattaaatatatgttgacttatcagtgataaaagcaaggtagagactgacccaatttgtgggcattactttcttagtaaaataataatagaacgaaattcttttacatgtttcacctttatcattttttatttaaaacaataaatttcatttgtttatgtattcactgatcaaatatttgactgtctcctatattccaggtactatggccaagtctgggtgggtgggtggttgggtgtgtgtgtgtgtatatatacacacacaatatatatatacacacacactatatatatatataaatatagtagtgaacacaacagacatggccccatcctctaaaccttgctaagagagacaaaagtaaacaaaaattataaaagaattaattgccatcatagtaggtacactgaagaaaatatatggggatttatgaagtcatagaacaagagaacttagcctatcccagcaggttcagggaaagcttcctggaatagatgaaatttaatctgatgcatgaaggatgagtgggattcatgagggaaaaaggggagcgagaataggagggccaaaatgaataacccccagagggcttcacagggcacctgtaaaccaatatttgatcacactgtgtcaaccaggaccagagcacattgctggctgtgattttcctgattatctttcttggaggctgaacctgatatggttgctgacccttctgttgtctgcacattttgtcatggcgtggatcttactgtgaacatctgcactacgttgatttgtgtaatttatttgctgagaccattcaacattaatcttggaaaatgatctttttctttgcagttccagctgctactcttcttgctggatgtcttagttgagggttggccagtagtaacaggtgggcaagatcagctcaccgctgagagctgaggcagcaggtgttttggttcaagcacagggtctggctctggtttcaaatgaagttgtgacttaagcactctttgccttggttttcttatctataaaatgggtataatgaccatctcataaagcaggcttgctgttggttttgttttttcctcaaaaatgtagtgccacatttaagatcatcacataataaagcaaccacaaaagacctaaaaaaaatccctgcagttttaaaaaacgttagaagaaaggttactagaccataagcaagctccacatcaggctcttttttcaaacatgggttttagctgaatcatcttgaacctcctgggaggtggaccttatatgtttggtaggaccattatctgcacagctgaggagctcaccttggcagactacaatcatttaaagcactcatttgaagtatgggtgtgattttgcttgtgatggtgagttaacagccaaacagggctaacttgtgtttctggttaggagggaatgtttctaggcagcttttcctggtccacagaaggtttctctttagtggtgagattggaaatgctttacagggaaaaaaaagataaaggttgtgtaacatgattggttataaaacatgaacatcttggtaatactacaaagaggaaataagtggaagtattatccccgaaaaaaattcatagaacttaaatacgtatttccattaaaaagttgtcctcctcgtaagccaaattatttcattcaagtttcatccagggaaccagaatacttttacttttgcttcagatttgatttgattcaccggcattcttggttcccgaaatcatacctcattttttagaaatactttcttgatctttttgtagctaactcacttagtaaagtatgcaaattttccaaaataactaatagatcatttaacatagaaagctttaaattatgtcttaattatgtcaatgtaaaaataaaaggtgggtggtttggtttatattgaagtaagtagcataaacagaaatttaattagtaccttatttttaatatcgtactttggcaaacctttcacagtgataaatgaaattttccttttcattgggaaaagccaagttactgttgtttttggttatatagttgcattccttcaggctggtaacagtgtaagctaaagacaaattgtaagagctacttgcctcaagatatttatatcctagaattataacggccttatggtttcttcttttttcaattttctttctttttttttttttgagacggagtctcgctctgtcgcccaggctagagtgcagtggcgcaatctcggctcactgcaagctccacctcctgggttcacgccattctcctgccgcagcctcccgagtagctgggactacaggcgtctgccaccacccccggctaattttttgtattttaagtagagatgaggtttcactgtgttagccaggatggtctcgatctcctgaccttgtgatccacctacctcggcctcccaaagtgctgggattacaggcgtgagccaccgtgcccggcctttcaattttctttaaacaattttctttacatttgcattacaaaacagttggagttaaatgacaaatatttcacatttctatgaaaaacagctagaaatcaaatagtcttaactatatagtacctagaattccagttcctctgaattttcacagatgtgtatttttagctgtccattagacatctccaaggcaaaattaaatggagctcttcctgctgcttctccctgttcctaaatctctgtcttcattaatggtttaagaacccactttattgaccgggtggaaaccttgaccagaaatctcagcatcttccttgacttcccatctaatgcgtttcttgagtctattaattttatctccagattgttaccctatgctgggtcctcttgatttcccactaccaggctttattgtcagcttgcccagattagccacctaaccggcctgcttgccatctgttcctccctactagtaatccatccttgctctgctccagttttctcggattgagtgatttattggcttccacacctccagtggtttcttattgtctacagattaattgtaaacttcccagcatgcagtataacctttgcaatcaagctcagccctgctctgcagtcttctttctgtgcccttgttcctcctggagtggagtctgtacctcagctccactgaacttcccagtttccccaaccagacccacgttgcttccactgcccattgtgctttgctcccctgctcccgtcatgtcatccttcgcactgataatccagcttacacgtgtccttacctgtgtttaccacaagagtggtcactctgccctctggagttttctttgtaggcctctttggttttttactcaccatacttctgacaccaaatgtgtgaattttttttttataccaaccgactctctaacccttgagacaccaattgtgtgtcctacagttccggtcctacaatttaagttcctacattaaccaccctgagtttgcatcacactccacaggtttaaggtttcagcccacaatactgccctcatttaagacggcagatgcaagtattgggtccccaggttacccacacttctcttctacttggctacaaagttgtggggggatttccacaatccacccctatttcaggccctgatgatttgctaaaatggctcacagaactcaggaaggtactctacaatttctgctttattatatagggtacgactcaagaacagccaaatacaaggattgttacagggcaaggctggagggggtgcaggtactgcagaccacctagtccctctcagggcctgctactctcccagcacctcaaggtgttcatcgaccctccctaaccccatcagttaagggttattgtggaggctccattacataggcactattgattaaatcattgttccttggcaattgaactcaaactcttctcttcttatgactggagataggcaggcatggctgaaagttccagctctgcaatcatgccttggtctttctggcatgctgagagccatgctgaagctatctaagggtccccagctaccagtcatctcactggcatacaaaagacactcctgtcactggagattccaggtatttcaaggagctgtgttccaaggaccagggatgaagaccaaatacttattattaccacacctgtgttatagatcctgtattgtaattggctgcatgcctcccatcaaccgctccactgtgagtgttgggagggaaaggatcatttcttactaaattttgtttaatgagctaacctctccttggcatataattcagcttcttctgttttggttcaagtattatgctaccgtttctctacacacacttagacacacacacacacacacacacacacacacccctatacacatactattgtacagtcagtgtggttaaaattccactgataggaatataccccagagacttgaaaacagacacaagaatagatattcgtatgcagatgttcatagcagcattattccaggtagccaaaaactggaaactactcaagtctccatcagcagatgaatggataaacaattgctatctatatgacatatataatgatatatatcatatgtgtattatagatatatacacttgtatgtgtatatctatttaggtgaccctaaattgctatctatttatacactaaatctggtaaccctggccgggtgcagtggctcacacctgtaatcccaacacttcgggaagccaaggtgggtagatcagttgaggtcaggagttagagaccagcctggccgatatggtgaaaccccgtctctactaaaaaacataaaaattagccaggcatggtggcacatgcctgtaatcccagctactcaggaggctgaggcaggagaatcacttgatcccgggaggcagaagttgcagtgaggtgagataatgccagtgcactccagcctgggtgacagagtgaggccctttctcagaagaaagaaagaaagagggaaagggagggagggatttaaatatcatgtatattatcagatttaaaataatgtgattgtttttattttgagaaaaaaacatatactgttagatttatttcagacttttttttttttttttttttttttttttgagacggagtctctgtcgccaggctggagtccagtggcgtgatctcggctcactgcaacctccgcctcctgggttcaagcgattctcttgcctcagcctcctgagtagatgggactacagctgcgtgccaccacacctgtctaatttttgtatttttaggagagacggcgtttcaccatgttggccaggatggtctcgatcccttcaactcataatccacccgcttcggcctcccagagtgctgggattacacatgtgagccaccacacctcctggcctcagacttattttttaagcatttatttaggtgttttgctcatgtatttttccatacaataaaatatataagcattcactccccttcccataaagaattcttgaaaaataatgaaatatgtttagtctaaagtacctgaaggcagagcagatcaatgtttgaagccaaacacttgaagcaataacttgatttttttttttttttttttggttttgtcttgtcttgaactcctggcctcaagtgatcttcctgcctcagcctcccaaagtgctgagattataggcgtgagccacaatgctcatcctcaaggaggtgttaatatgatagatttaaacttagataaaatttttatagattttaaaaatattttttagttggtactgtgtactgttgaattttcaaaccccgtgtaataacattacatgaggctaatctgttatctgttagagtgtatgaaagaagtgttaatttttttttccctttggtttttcaggttctttatagagttggaagcaagacatcagaataatatcttcatagatgacataagtgacattgtggaaaaacacacagcatccacatttgacccatatgtgaaatactgcacaaatgaagtctaccaacaacgaacactacaaaaattgttgtaagcaatgtcgaatgctacagttttaatcatctaacctagttttaattaggctacattgactgaaattaattgatcttttgaattatatttagaaatgcctcctgataggctatttcccagaggagaaatgtttaagagcattacttttagggtgagggtgtttaagtagaaaaatctagtgtgtagagaattttctctcttacgaaattatagcttgttattgatgtccttgtttagtgtttcgttgtttttaattgttgcaggaaacagaggtggtcctcactctaaacccgcagttttctaagctttttactggcaattaagtggttttcctgaggcttagaggggattcttgagttgattgagctaaaagctaagattcagagttttctctactattctgatctccctccattcaattgacaacgataataaattgttcataaaaattgctgattattccccccacttgggtagttagagttgaagagaggagggaagttctgaaggaaagcagtagaaaaaagtaatgttcttaaagatttcagttatgcagcaaaagagttaagcattagatttcctgccacatcttttctttttgtcctttttaggttactgagagttttgatgtgatgcatatgccatctgtgtccttaaaagagtcaccaattgttcagtaatgcctatatgtattttaaagagtcctgtttatcacaagtagctgttttacagcacagttgtgcactgctgtaaacccagtttgggagcttaatggctgttatcgttctcaccccctcctgtgagttgtggcatttatgaccacggcatggagcttcggtcaacttctgtgcaatatgtgagacccctatggaggagtaggggttgaggatgactaacttatggctgcttggagaaatagtcaaagcctctaagctgatgagaagggctgatgatggccccctttttcctccacatcttcatgacattttcatatagccagggtggaaaacacacagctgctaaccccaatgagatttttagtataaagcagggtttgttcgcacaattgacattttggactggataagtctttgtggtgggctgtcctatgcattttaagatgcttaagggcatccctggcttccatctgctagatgccaaaaatctccccagacattgcagaaggtcccctgagggtaaaaccacacccatcacttcctcactccaccacgccctggtgggaaccgctgctataggaacagaggttctctgtaactgttagagaatgcaagttcatgtctgaaaacaaagccttgaattagagataaatttgggtttcattttgttttgcaggatttaaaaaatgtcactaggtactgctatacatcatgtgactcttaaaggttttatctaaattagcttaatgataacatcatcagcactttcacgtggcaattagtagtgttttcaggggatttgttgcagttgatgtgatttttttttttttttttttttgagatggagtctcactctgtcacccaggctggagtgcagtggcgcaatcttgggtcactgcaacttctgcatcccaggttcaagcgattctcctgcctcagcctcccgtgtagctgggactacaagtgcatgccaccacacccagttaattttttgtatttttagtagagactgggtttcaccgtattagccaggatggtcttgatctcctgacctcgtgatccacctgtctctgcctcccaaagtgctgggattacacgcgtaagccactgcgcccagcccgcagtttatgtgaatttaaggttagaacagtggctttcaattctagctgcatgttagaaatgccttggggcctgaaaatgagcaaatgtacactgtccagagtccatcccagactatttaatcagaacctttggaaggtgagggaggggactgggacctgagttatttaaatatacaactaatttagaggtttttgttttttttttttaactttctaaaaatcttgtcaaagctatcagtaaaaggaaacttaaaacttctcaattagagaaaatggaaatgaattgtttctgtataatttcttttcatttgctattctggcattctccccctccctgcttttagtagcagccttgaacaagattatttaattttcaaaataacattttttttaaaaaaaatgactgctattgtcactatcctgcttccttctcccttcatgggagtacaatatccatctacctcctaccctccttgccttggaaagtggcagtggaactctacagagctcctcatgggatgaagtgaggtaagagagtgagaaatggggggacaagagtgtcagatttaacattagaaaacttgggtttgaggccaggcacagtggctcacgcctgtaatcccaccactttgggaggccgaggcaggtggattacttgaggccaggagttcgagactaccctggccaacatgaaaccttttctctactaaagatacaaaaattagctgggcgtcatggcacacacctgtaatcccagttacttgtgaggctgaggcatagaattgcttgaacctgggaggcagaggctgcagtgagccgagattgtgccattgcactccagcctaggtgatagagcaagactccatctcaaaacaaacaaacaaacaaacaaacctgggtttgacttctgtctttggcagttactaagtcatatttacttggtgaggtagggacctttctgcattccattttcttactggaatccctatctggccttccttaaaagttacgtaggtggttccacatgaaagaatgtatgtcacagtatctcgctaagtttcattaaaatgttatagcagcattaatacttttcttgcattaacaggagaaaaagaggaatatttcgactgatgtgatgaaaaggttttctgtctcagaaagaggatctttgtggcctaaagcctctgaagtccagtctaactgttaatttcttatgccattgtctagggctggagaagtggcttaaaacatattatttatgatcttattaatgatatatgtttatagatgatcggatataaaagacctagtctgtatactgatttatgacccatatattcaccattatgataccacagcttcttcatttgcttaccttccacttgtataaatttctagctcctacatgttttgccttattgttaatactgttatgtgaaatccacatcttattatattcagccttgaatataaaaggcagacaagccattcgtatttgccagtgtaattatgtgcttatgatattttcatacagtttaaaatagttgatgctatatggatttatcacagtattttgtaatacatttttacttgctgcttaatttgaggaggaaatattttgaagtttctcttttctttgttttccctcagagctaccaatccatcctttaaggaagtattgtcaaggattgagtcccatgaagactgtaggaacttacccatgatctcttttctcattctccccatgcagagggtgacccgccttcccctgctgatggatgtaagacatgacggtggctttttcctctgtggatagctgtgcttctctaaatctgatttagaaaattattattattccacttaaattgatgcatatttaaaggtctaaaaatcccccaattaagtgagaaggtgttgtttgttcagaaagtctcacctgtatctgatatctctggaaattatctttcatttaggcttctatggtcattctgaagaaattggatctcatcacccacttactcagcattttttgaaataggaagagttgtggcttctttatgtcaggaggcctggattccaattctagctaagccattaggcatgtgaccttgagcaactcagtctctttgggcctaagattcctcagactgatcactgagatcccttcatctataatgttccaaggtgccctgggccttccatttcatacaggaatgagagtctcttcagcatgacaaggcatagtactgcctgtattatgcattgtgcgaagtgagtgaggaaagcccagcttccttcttgtgttaggcagcattcatgaggaaagcaagtgtttttgactttgaatcacggcaagacatgactgggaaaagtgagtagagtctgcctagtagtacgtgcagctggaaagacaggtaggctatgggcaggagagcctgccactggctgcactggagctgctggggcagcaaaagagaaaagtggggtggctcgacacaggtgccattctagcagtggatcacagagtgtctttttgatctaattagaaaatattttgttatgattttcctactttaaaattggatcataatgttgatataaggtcaactttttacatacctgattttgactaatcaaaacaaagtaaaatatatattaaaaattatgattaaggttacaaagtaaatttcacattctgtatcccattgtaaattctaaaatacattctttaaaaatgctgaaattttgaaatgtgtaaaagcatggaatcatgagcatttagctgactgctgcagttttggagacgttttgtcaggtatttcaggattcatagcaccttgtgctcctcaagtttacttcgatctactgcctttacaccttctccacccatcacctgtaattcaggaacttcccccctgtgtacatattgggaagcttgcagttttgaacatttcactttctgatttttttttgagatcagtatttatcatgtttaaagatagaatgtggctaagttatcagaatcgaatttttgcttaagaaggaaactttggtccatataaggaagtattatttcaaacatgactatttttttaagcaagaagtgaatgccttgtaaatacaacatttcttgtaatattagacttttgaattttcagggttttcttcttctgaaaatgcattttattcctctttgagaattgaaataaaagaacaaaaataaataaaatgcattttaaacatgttttccagattttatatatgctgtgatggccaagccttttatatcctctttaaatttgagaaaattacttgtatggaatgggactctaaaatctaacacattatgttatacagtgttggagattcatgccatgattgctcagtaggctttaaactttttttaagccacagacccccccttgagattctgagtaaagctatagcttttcttcccagagaatatgtgtatgcacaaaattttacataaaatatcaatatatggaatccagctaaggatgcctgctctcagggacataaaccagtatttttcatgctgctttcatacccattagtgggccataaaactgatttttgaattatgagcatatgtacgttgctcataaagtggttaaatattgtttcataaaatcctggttcatttatgtgtgcatgtgtgctggttgcagtgtaaaagtatttcttacagtgagtcatagtcaaaaaatataagaacctccacagatggtgcactctgtgtttctcacatagcagatagttaaaaatcttgatgcctgactttcagatggcttggcttggtgcttctgtacatttaagggaccagtgacttgctagtagccaactactttctacctctgcctgatgcctgttgctctaatctgtttctcatgtgtggaaatctggccatttaggcagaatgtaaatgtatttaaaatagtgtctcttcaattttacctcatttggaaattcagttaagcttgttcattaaaataaacactttcagtaattaaagtggttccctgggctttgaatgtgtgtgtatagctttaaagttatatgtaattaaatttaccgtgaattgaccctgtttgacctgattttcctatcacaaatgaaatttctcagtataaatatatcaacagaaaacctagcaggctttttttcctttgctggtttttttgggtttttttttgactgttttttctttgagatgctgtcacccaggagtgcaatggtgcgatctcggctcgctgcaacctccacctcccaggctcaagtgaccctcccaccttagcctcctgagtagctgggaccacaggtgcacaccaccatgcctggctaattttcttttagtatttttgtagagatggggtttttccatattgccctggctcctggactcaagtattctgcctgccttggctttccaaagtgctgggattacagacatgagccactgtgcctggctgttctttttattcaaaatgtatcatctataaatataattgcctctaataataatgattataatggtgataattaaagtaactcttatttattgagggcataccctatgccaggcactaataaagaactttacataaattatcattaacacttctaacaaccttgtgatgtagctggcatcaccccagttttacagatgaggaaagagaggcttataaagatagagttagtgacttgctcaagatttgataactagtaagggcagacctgggatttgaaaccagggttacccacctctgaattctatctttcttaaccattccctggatggacttggatcctgtgtttaaagattatttcctggtttttaaattgggttttaatattatcctcatactcatccgtaatatcgtgtttggcattgtttgctatgagtaaaaggatatggctggacattggttttattttacttaataaaatagatcaataaattttgttcacttttatttcattacagactatctgtcaaaaaacacctaaggactctccgaagtatgaagtctgcaaaagagccttgaaggaagttagcaaggtaactgttgggtgacagtttgtttgtaagacaggaaaccattcagttagctcagacacaaagtgtgtcttggcttgatgctgaaaactggtagagtctcacagccatttgtacagcgttctttaggtagttgcaaaacaaaatcatatttgctatactcaggtgaagttggtatttttactgtttcagacagttttgttttaagagcctacagatacctcattttcttttggtggctgaatagctgtttattcatttctcgttcagtaaatgtttattgagtatcaaccactgtgccaagaatgatgccagttcttggaaatgcagtgatgagtgaggcacgtgtagtcactgtgctcgtggaatgtgcagtggaaagaggagggcagacattaaacagagttacaatgaagggtagtgggtgatgtgatagggaagtccacagtggtgtctaagctgagacctaacacaggagtggctgtgagcccaggattgggggaagagagtgtctcaggtatgtgtagaggtccaaaggcaagaaaatattggagattttgaagaactggaatgttctccatgtggctaggatgcaatctgagagacagcactagggaaccagctgtgtggggccttgttatacatgctaggctgttgggggcctgatcgtaagatgatgtagaggctaaattcatgtattatgaagatgatagtggtgatggggccagttctgaggccagtgatagttgattaggcaagggatggcagtggcccctattgacatgatggtaaggtggtgagaagtctacctgtatactggggaggcagacttggaaactgattgggtgagcacatttcaggacagaagtcaaggaatattgtctgtggcttgggcagcgaggtagatgctcttccttcatctacgatagaaacatagggagagtggataagttccatttgggttgtgttgtcattgagattcctatagaacgtccaagttggctaaataaacaaatcagaagctcagagaggagacctgaactggagacatggatttgggaatcatcagcatatggacaatagttgaagctgggtgagtggatgaggttacttagggagactggaatgagaagggcagtgagcctgaggaatgaccatgaggaatgctagcattcatagtcttattagggaaaatgagccagtggagaaaactaaaaagaacaaaacaaagtaaaacataccagggaagaggaaggaaaaccgtaatagcttggcaaatggcagttaatttggtggttaactctgttgaatgcttctgaaagataaagtgggataatgattgaagttatccttaggtttatcatcagtaggttgtatactggggttggggggcggggatagggaacctgagctgagtgtattgagaaatgagagggaggtgtgaatatgcagccagccggcagtggtagctaactgtctaaattcagggagtagaaagagaaagagctgtagctgaaagggaagtgagagagggtcttcgttagtgtatttgtttaaagattagaaaaatgtaggtagggttagctactgatagaaatatctagctgagaggaagcaatagaaggtgtaggtgtcactgaggatactgtatgaggttggcacagaggagcaaagataatggtagcatcagaagcttcctaaatgtctccagttacatagccctatatgaattgggtatggctttgtaccactttgctatgaagtactgtttcttttagtcaatttacatcgagtcaccattttacttaccctcttccttgccaataatatttacaaaatcatgggttttattagttgtttatttttctaacatttttgtagtaaaagtaagtgtatctgtgagccacttaaattcatctcttcatcccatcagtggtctgcacacctattttgggaacagtaagtaaagaaagcctgacaagtgagaagttacctaaggtactattgccagtggtgcttcctccaagacctcaagtcctgtgctgctttcctagaggaggaactggggagggaaacgggggaaggtttttaggagaaactactagagaagttctagtcttggacataaatgggattttgacaaattttgcctggttgttactaagaaattgaaaaaaaaaaagaatttgcacagagaaaaaaataggaaggtactagtagttggttgttgaattaaacctggaatgttacttaatttttttcaagaattttacatctcagttacagtagattactacattccttcaggcatctcttgttcacttgatttcatactgatactttcaggaaaggctggcaaaaatgtaatagaccagtgagttgctttaccttgatactataagtatacaaaaagctatcatgtgaagagatgtcattccagtgacttgctttctctgaagggcatcattcctttctctctattgagcatgaatcatgaatattagaaatattccttcagtctcccagcgttacagggaaactgaaatcgttgatatagtcagctcaataattaatcttcttttttatttgtaaaggttactgatgaggttttatagaatctgggaaaacaatatgaatattttcagcagaaagagtatgcatagagagcatttatggtttagaatgaaaatgtagaactacacttgtttgctttatcagagaaattgggagttcccaatattttattttagagagttaaatttggtatgttgaggcccaaggtttagaaccagatgctgccttaatgtcttgggtaagtctctctaggtagttactcattcttggaaaaaaagagtcataccattttggtagttaaaataatgcagtttatttgcaagatgcgaataatactttgctgaaattgctcatgcatgttgccttaaagactgtgacaatttctttaatttagggccttggaaagacttactgacctaatcaaacaactcaaaaacaagaacaacatttctataaaatgaaaatgtgcttacctcctgattttctgttaacatgctggggggagaaattctagggaatctgataatttccataggaatctggtaattcagctcatctagagtgatgtgtaccatgtaaggaatagtgatcaagagatggtcttatgccaaatgaatcttccctgttatttccttctgtttactctcccatggaaagagaatgtctgctttaactctgacctcatcaaaattccgtttagagttggagatagtgttacattatgagcctttctcccagaggcaaaatagtcaagctctatttaatcttttcgtataacgtattgcttcagccatttacaaagaagtacatgtgtatgacaaatggccaacaaacgtgaaaaaatgctcagcatcactaactataaaggcaaattaaaaccacaatgaggtaccaccttactcctgcaaaaatggccataattcaaaaataaaaaatagtagatgttggcatggatgtggtgaaaaggaaacacttttaccctgatggtgggaatgtaaactagtacaaccaatatggaaaacagtatggagattccttaaagaactaaaagtagagctaccattcaatccagcaatcccactactggatatctacccaaaagaaaagaagtcattatgtgaaaaagacacttgcacactcatgtttatagcagcacaatttgcagttgcaaaaatatggaactaatccaaatgtccatcaaccaatgaatgggtaaaggaaatgtggcatatatacaccatggaatactactcagttgtaaaaagaaacaaaataatggcatttgcagcaacttggatggagttggagaccgttattctaagtgaagtaattcaggaatggaaaaccaaatatcatgtgttctgacttataagtgggagctaagctatgaggatgcaaaggcataagaatgatattatggactatggggacttggggagaagggggaaaagggcttgggataaaagagtacacattgggcacagtgtacactgctcaggtgatgggtacaccaaaatctcctaaatcaccactaaagaacttctccatggaatcaaaaactacctgctccctgaaaagtattgaaataaatttttttatagataagtagatacaaaagtatttttattattttattaattttgtgggtacatagtaggtacatatatttatgaggtacatgagatgttttgatataggcatgcagtgtgaaataagcacatcatggagaatggggtatccatcccctcaagcatttatcctttgagttaaaaataattcagttaaactctttattttaaaatgtagggggttattattgactgtagtcaccctgttgtgctatcacatagatcatatagtaggtcttgttcattttattttttttttatacccattaaccatccccacctcctccccagcccccgactacccttcctagcctctggtaagcatcattctactctctatgtccatgagttcatttttaaaaaaaatttttaaatcccaaaaatgagaacatgtaatgtttgtctttctgtgtctggcttatttcatttaacataatgacctccagttccagccgtgttgttgcaaatgactagatatcattctttttcatggctgcatgatactccattgtgtgtatgtactacattttcttcattctttcatctactgatggacatttaggttgcttccagatcttagctattgtaaacagtgctgcagccaacatagaagggcagatatctctttgatatactactttcctttattttgggtatatacccagcagtaggatttctgaatcatatggtaatcaatttttagttttttaaggaacctccaaactgttctccatagtggttgtactaatttacatgcccaccatcagtgtatgagggttctcttttctccacatccttgccagcatttgttattgcctgtcttttggatataaaccattttaactggaataagatgatatctcattgtagttttgatttgcatctcgctaatgatcagtgatgttgaccttttcatatgcctgtttgccatttgtatgtcttttgagaaatgtctattcaaatctttgcccatttttgattggattattagattttttttctatagagttatttgagctccttatgtattctggttattaatcccttgtcagatggctagcttgcacatattttccttctattctgggggttgtctcttccctttgttgactctatactttgctctgcagaagccttttaacttgttgtgatcccatttgtccatttttgctttggctgcctgtggttgtagggtatttttcaaggaatttttgcccagaccaatgtgctggagattctccccaatattttcttgtagtacttttatagtttgaggtcttagatttaagtatttactccattttgatttgatttttgtatatggtaagagataggggtatagttttattcttctgcatatggatattcagttttctcagcaccatttattaaagagactgtcttttcctcagtgtatgtttttggcacttttgtcataaatgagttcactgtaggtgtgtggatttgtttctaagttcttttttctgctccactggcctatgtgtctgtttttatgccagtaccatgctgtcttggttattatcgctctgtaatataatttgaagtcaggtaaagtcattcttccaattttgttctttttgcttaggacagctttggctattctgggtcttttgtggtttcatatacattttaggattttttatatttttgtaaagaatgtcattggtattttgttaggatttacattgaatctgtagaattctttgggtagtatggactttttaataattttaatttaataatttaatttaataattttaataatattgattcttccaatccatgaacatggaatattttttaattttttagtgtcttcttcaatttcttttatcagtgtttcatagtttttcttatagagatctttcacttctttggttaattcctaagtacttaattttacatgtggctattgtaaatgagattactttttaatttctttttcacattgttcactgttggcatatagaaatgctactgatttttgtatgttgattttgtatcctgcaactttactgaatttgtttattctgatagtttttattttgtggagatcaaatataagatttttttttattatactttaagttttagggtacatgtgcacaaggtgcaggtttgttacgtatgtgtataaatgtgccatgttggtgtgctgcacccattaactcttcatttaatattaggtttatctcctaatgctatccctgccccctcccccgaccccaccacaggccccagtgtgtgatgttccccttcatgtgtccatgtgttctcattgttcaattcccacctaagagtgagaacatgaagtgtttggttttttgtccttgagatagtttgctgagaatgatggtttccagcttcatccatgtccctacaaaggacatgaactcatcattttttatggctgcatggtattccatggtgtatatgtgccacattttcttaatccagtctatcattgttggacatttgggttggttccaagtctttgctattgtgaatagtgccacaataaacatacatgtgcatgtgtctttatagcagcatgttttataatcctttgggtatatacccagtaatgggatggctgggtcaaatgaaatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatagccagtgatgatgagcattttttcatgtgtcttttggctgcattaatgtcttcttttgagaagtatctgttcatatccttcacccacttgttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccatttgttttggtgttttagacatgaagtccttgcccatgcctatgtcctgaatggtattgcctaggttttcttctagagtttttatggttttaggtctaacatttaagtctttaatccatcttgaattaatttttgtataaggtgtaaggaagggatccagtttcagcttcctacatatggctagccagttttcccagcaccatttattaaatagggattcctttccctatttcttgtttttgtcaagtttgtcagagatcagatagttgtagatatgcggcattatttctgagggctctgttctgttcccttggtctatatctctgttttggtaccagtaccatgctgttttggttacagccttgtagtatagtttgaagtcaggtagcgtgatgcctccagctttgttcttttggcttaggattgacttggcaatgtgggctcttttttggttccatatgaactttaaagttgttttttccagttctgtgaagaaagtcattggtagcttgatggggatggcattgaatctatgaattaccttgggcagtatggccattttcaagatattgattcttcctacccatgagcatggaatgttcttccatttgtttgtatcctcttttatttcgttgagcagtggtttgtagttctccttgaagaggtccttcatgtcccttgtaagttggattcctaggtattttattctctttgaagcaattgtgaatgggagttcactcatgatttggctctctgtctgttattggtgtataagaatgcttgtgatttttgcacattgattttgtatcctgagacttcgctgaagttgcctatcagcttaaggagattttgggttgagacgatggagttttctagatatacaatcatgtcatctgcaaacagggacaatttgacttcctgttttcctaattgaataccctttatttccttctcctgcctgattgccctggtcagaacttccagcactatattgaataggagtggggagagagggcatccctgtcttgtgccagttttcaaaaggaatgcttccagtttttgcccattcagtatgatattggctatgggtttgtcatggatagctcttattatttagagatacgtcccattgatacctaatttattgagagtttttagcatgaagggttgttgaattttgtcaaaggccttttctgcatctgttgagaaatcatatggtttttgtctttggttctgtttatatgctggattacatttattgatttgcatatattgaaccagccctgcatcccagggatgaagcccacttgatcatggtggataagctttttgatgtgctgctggattcgggttaccagtattttattgagatcttatcatctgcaaacaggataatttgatttcttccttccaaatttggatggtgtttatatcattctcttgtttgattgtactagctaggattccagtactatgtcaaataatggtggtgaaagtggatatccttgttatgttccagatattagaggaaaggttttcagttttctccattcagttgatactagctatgggtctgtcatatgattttttatcatgttggggtatgctccttctatacccagtttttgagggtttttagcacgaagggatgttgaattttatcaaatgctttttctgcacaattgaaatgatcatttttttttgttcttcatttggttgatataatgtattacactgattggtttgcctatgttgaaccatccttgcatcccagggataaatcccgcttggccatgataatctctctttttttttttttgataatctttctaatgtgttgttgaattcaatttgctagtatttttttgaggatttttgcattaatattaatcatagatattgtcctgtagttttcttttttgatgtgtctttgtctggttttggtatcacggaaatattggccttgtagaattagtttggaagtattccctcctcctctatttcctggaataggtggggtagggttggtattagttctttaaatgtttagtagaattcagcagtgaggccattgagtgtcaggctttgctttactgggagacttgttattacagcttcaatctcattacttgttactggtctattcagctttttgatttcttcttggttcaatcttggtaggtggtatgtgtatgggaattttccatttcctttagtttttctttattatttgttttctaccaattttgggtttggttgagtttcattgttagtttatttttcttttccttttttttttttttttttgagacaagagttttgctgtatctcccaggctggagtgcagtggcatgatcttggttcactgcaacctccgcctcctgagtacaggcgtatctcatgcctcagcctctcaagtagctgggactacaggtacatgcctggctaatttttgtattactttttagtagagatggggtttcaccatgttggcaggctgatctcgatctcctggtctccagtgatccccccgcctcggcctaccaaagtgctgggattataggcatgagccactgtacccagccttttcctcttttttgatttattcacttacagctataaaattccctctttatactgcttttagtgtatcacataggttttgatatgttgtgtttccattatcatttgtttcaagaaatttttacatttccttaattttttctttaacctactggtcattcaggagcatattttttaatttctatgtatttgtacacgttccaaaattcctgttactaatttttagttttatttcattgtggtcaaagaatatgcttgatattacttcagaatttttgaatattttatgacttgttttgtgacctaaatatggacagttattgagaatgatccaaagaatgtgtattttatagctcctggatgaaatgttctgtaaatatctattagatccatttggtctatagtgcagattaagtctgatgtttctttgttgattttctgtctggaagatctgcccagtgctgaatgtgggatgttgaagtctctagctattatggtactatggtgtatctctttctttacctttaataatatttgctttatatatctatgtgttccagtgttgagttcatatatatttaatattattatatcctcttgctgaattgacctcattatcattatatagtgactttctttgtgtcttcttgcagttttttctggaaatccattgtgtctgatataagtatagcaactcctgtttttttttgttttggtttccattgacgtggagtatctttctccatcctttgtttttagcctatgtgtgtctttataggtaaagtgtgtttcttgtaggcaacagatcaatcagtcttgttttttcatccattctgccagtctgtgtcttttgattagagagtttagtccatttacattcaatgttattattggtaagtatggacttactcctgcccttttgttatttgttttctggttgttttgtggtcttctattccttctttccttcctttttgtcttcctctagtgaagattatttcatctgatttagttttttgctttttattttttgtgtttaaggttatcatgaggcttgcaaatattataacccattattttaacacaataacagcactatttgcataagcaaggaaacaagcaaacagaaaactaataagaactctatgccttaactttgtacccccacttttaatcattttgttgtttctgtttatatcttattgtactgactatgccttgaaaagtggttgtagttactatttttgattggttaatcatttactcttctacttagggtaggggtagtttacacaccatagttacagtgttataatattctgtgtttttctatgtatttactattaacagtgagttttgtaccttcaggtgattacttattattgattaatatcattttctttctgattgaagtacttcctttagcatttcttgcaggaaaggtctagtgttgatgaaatgcctcagcttttgtttgtctgggaatgtctttgtttctccttcatgtttgaaggatattttcactggatatactattttatggtaaaagttttttgccttcagcacttgaaatatgtcatgcccctctctcctggcctgtaagctttccactgaaaagtctgctgccagatatattgcagctccactgtatgttatttgtctcttttctcttgctgcttttgttttatttattttttgtagagatggggtctcactgtgttatccagcttgttctcaaactcctgggctccaaaagcttcttaagctgataaacaacttgagcaaagtctcaggacacagaattaatttgcaaaaattgccaacattcctatacaccaagagtgggcgatccaagagctaaatcatgagtgaacttccattcataattaacacaaaaagaataaaatacctaagaatacagctaacaagggaagtaaggacctcttcaaggagaactacaaaccactgcccagagaaatcagagatgacataaacagatggaaaaacattccatgctcatggatgggaagaattagtatctttaaaacgctaatactgcccaaagcaatttatagattcaatgcttttattattaaactgccattacattcttcacagaattagaaaaaaagtattttaaaattcctatggaacaaacgaagagcataaatagccaaggcaattctaagcaaaaagaacaaagctggaggcatcacagtacctgacttcaaactatactacagggctacagtatccaaaacagcatggtactggtacaaaaactgacacaaagaccaatggaatagatagagaaaccaaaaataagaccatacacctacaatcatctgatcttcaacaaatctgaccaaaacagactgtggagaaaggatttcctattaaataaatggtactggaagaactggctaactgtatgcagaaaattgaaactggattcctttcttataccatatacaaaaatcaagatagattaaagacttaaatgtaaaccttaaaactataaaaccctgaaagaaaacctggtcataccattcgggacataggcatgggcaaagatttcatgatgaagatgccaaaaacagtcgtgacaaaagcaaaaattgacaaatgagatctaattaaactaaagagcttctgcacagcaaaggaaactctcaacagagtaaacagacagcctacagaatgggagaaaatttctgtaatctatgcatctgacaaaggtctaatatccagcatctataagaaacttaaatttacaagaaaaaagaataactcttttaaaaagcgggcaaaggacatgaacagacacttctcaaaagaagacatacatgcagccaacaaacatataaaaaaaaagctcaacatcactgattagagaaatgcaaatcaaaaccacaatgagataccatctcacgctagtcagaattgctattattaaaaattcaaaaaataacatgctggtgaggttgtggagaaaaaggaatgcttttacactattggtgggagtgtatattagttcaaccattattgaagacagtgtggtgattccttaaagacctacaaacagaaataccatttgacacagcaatcctattactgggtatgcaccgtaaggaataggaatcgttctgttataaagacacatgcacatgtatgttcattgcagcactacttacaataacaaagacatggaatccagttaagtgcccatcagtgatagactggataaagaaaatgtacatatacaccatggtatactatgcagccacaaaaaagaatgagatcatgtcctttgcagggacatggatggaactggaggccattatccttagcaaagtaatgcaggaacggaaaaacacataccacatgttctcacttataagtgagagctaaatgataagaatacatggacacaagggggaaacaacatacactggggcctattggaggatggtgggtgggaggagggagtgaattaggcagaatagctagtggattctgggcaatacttgggtgatgggatgaactgtgcagtaaaccaccatggcaaatgtttacctatgtaacaaacctgcatattgggcatacatacccctgaagctaaaataaacgttggaaataaaacaaaaactgggctcaagtgatcccttgccttggtccctcaaagtactgggattacaggtgtgaccgctatcctcagcctcttgctgctttcaggatcctttctttatctgtgaccttttggtgtttaattattaaatgccttgaggtagtcttttttgggttaaatttgcttggcgttctgtaaccttcttgtacttggatacttatatctttctctaggtttgggaagttctctgttatatccctttgaataaagtttctaccccgtctctttctctacctcttctttaagcccaataactcttagattttcccttttgaggctgttttctagctcctgtagccatgcttaatcattttgtattcttttttctgttatctcctctgactgtgtattttcaaatagcctgtcttcaagctcactaattttttcttctgcttgactaattctgctattaaaggactctggtgcagtattcagtatgccaattgcattttttttttttttttttttgagatggagtctcactctatcacccaggctggagtacagtggtgcaatcttggctcactgcaacctccgcctaccggattcaagcgattctcatgcctcagcctcccaggtagctgggattacaggcacataccaccatgcctggctaattttttgtatttttagtggagacggggtttcaccgtgctggccagactggtttcaaactcctggcctcaagtaatctgcccacctcggtctcccaaaatgctgggattacaggcgtgagccactgtgcctggccgccagttgcattttttggctccagaatttctgcttgatttcttttaattatttcaatctccttgttaaatttagctggtataattctgaattccttctctgtattatcttgaattccttgagtttcctcaacacagctattttgaactctttgcctgaaaagtcacatatgtgtgtttctccaggattggtccctggttccttatttagttcatttggtgaagtcatgttttcctggatggtgttgatgctagtaggtgttctttgtgtctgggcatggaagagttagatatttattgtagtcttcactgtttgggcttatttgtacccatccttcttgggaaggctttccagacatgtgaaagaacttgggtgttgtgatctaagctgtatctgctttaggggcacccaaagcccagtaacgctgtggttcttgcagattcatataggtaccaccttgatggtctaagatctggaagaattctctggattaccaggtagagactcttgttctcttcccttactgtctcccagatacatagcctctgtctttgttctgagtcacctaaagatgagggtggagtgacacaagcacccctgtggccaccctcactatgattgcgccgggtaagacctgaggccagcacagtgctggatctcgctcaaggtctgctctaaccactccctggctactgcctgtttactcaaggcccttaggctctacagtcagtcgacggcaaagccagccaggcctgtgtccttcccttcaggccagggaggtcccccaggccccaggtgggtcgagaggtaccgttcacaaacggtctaaagtctaaaacctcagaagtctacttggcattctgttgtactgaggctgagctgccactcaaaccacaagatgcagttcctcccactctaaccttccctttccaaagacgggagcctctctttttagccaccaccaccccaggccacaaggagtactgcctgactactgttgatgttccctgaagatccaagggttcttaagtcagcttgtggtgaatgctgcctggcctgggactcacccttcagggcagtgggctcccctctgacccagggcaggtccagaaatgccatccagaagtcaagtcctggagtcggggaccccaggagcctgcttggtgttctaccttcctgtgaccatgctggtacctgaatccaggaagtctcagaggctgactcagggccctcggcatagtacctgggtatccaagctgtttattcagggcccaagggctcttcagttagcaggtattgaatactgccaggactgggttcttttcttcaaggcagcaggttcccttctggcgattctcatgcctcagcctcccaagtagctgggattacaggcactcaccaccaagcctgactaattttttgtatttttagtagagacggggtttcaccatgctggccaggctggtctcaaactcctggcctcaagtgatctgcccacctcggcctcccaaaatgctgggatgacaggcgtgagccactgcacctggccgccaattgcatttggcgccagggtatgtctacaaacgttgtctggggccaggcacaatggctcacacctgtaatcccagcacattgagaggccgaggcaggcggatcacctgaggtcaggagtttgagaccagcctggccaatatggcgaaaccctatctctactaaaaatacaaaaaattagctggttgtggtggtgggcacctgtaatcccagctacttgggaggctgaggcaggagaattacttgaacccgggaggtggaggttgcagtgagccaaggtcgcaccattgcactctagcctgggcgacagattaagtctgtccccccaccaaaaaaaaaaaaatttgtctgggaggtggggcctggaacgggggcctcacaacagtgagcattaccctctcccactgtggctgagctggtatccaagatgcaagacaaagcccttcccattttttcctctcgtcttctcaagcagaaggaaggggtctcttttggagccccagctgtgcttgccagcactcacttggctgccacagctggtgtctcagtatgtcatgtgagcccccattccattgtctctgggcctagttcagcactaggacttgcctaattgtcacagtccttatggcctaaactgcctttcaagttcactgagagtcacagagtgctgtaggccttggtggtgagaactcaagttcagactgctgggataagtgattcccttctgactagggctgatttaaatgctccctccatggatgggtatcagctgagtttggtctttttttttcctgctctaacaggacagcattgagttcagtgtgtcacaattgctgtgttttctttcccacagtgcccagagatgctctctgcaacatgccgctgctgtaggagacgggggtgggtggggggtggcatcagggattcaagactgttttttctatctctttagtgcctcttttcagcaatacgaagataaaaccaggtactgagagctcacctaagttttggttcttatgaaggtgttttctctgtgtagatagttgttaaattggtgtccttgaagagggtagtggggaggatgatcagtggagtcttctattccattatcttagttggccttgggccaatatatatattttaacatgcaaacaagctgtattggtcagtgcagaaaattaagttgcagaacaatataaatagtataatgacacctagaaaataatgtatatgtgtgtgtgtatatatatatgtgtgtgtgtgtgtgtgtattttattgatatgtagaaatagtcccagaatcatgcacattacactttcaaccattgttagctgtggtaaagggaggagagtttggaagggaggaagtaataaggctaagtacagctctgtaagaacgtatttaagttgacattggtatattttaacagtgcataaagtggccaagtgcaatggctcatacctataatcccagcactttgggaggctgaggtaggcgtattgcttgagcccaggagttcgagaccagcctgggcaacatagtgagacctcttctccacagtaaatcaaaaaattagcctggcatacagctgtggttccaactacttgggagactgaggtgggaggattgcttgagcccaggttgttgatcatgccatgatagaccctgtgaccatgatcacaccactgtactacaacctgggcgacagagcaagaccctgtctcaaaaaaaaaaaaaagggaaaattggatacaataataagtgtacattgcagaatatttggaaaacttaagagacagtaaaatgcatcagtaattttatcacttaaaggtgactactgtcattctattttgtatccttctggttggctttctgttccaatattagcatatgactgtaaaggaacacttaaaagtggtctccaacctttttggcaccccagactagtttcatggaagacgatttttccacagacgggtggggggctggggggtaggtgggtggtaggtggtttcgggatgaaaccatttcacctcagatcatcaggcattagattctcataaggagcacacagcctagatccttcacatgcgcagtttacaataaggttcacactcctatgagaatccagtgctgtgactgatctgacaggaggaggaggcagagctcagccagtaatgctcacttgccctccactcacctcctgccgtgcgctggattcctaaccaatccatggccctgggggtgggggatccatggtatatatggtacctatttcatttaacattctaagttgtgctccattgaacattgtcttacctaaatgattgtgcacatctaaccatttctaaagataaattttcagaagtgggttcatgggaagaaaaacacaagaatgttttaaattcttttgtatataatgccaaagtgccttctagaaaagttcatgtccacatccaccagtagtatttcagagtgtctatcttactgcatactgccaggatcagatattctattaatctttgttaatttgatggatcaaaaagactttgtgttttaatttacatttctttacgagtaacatagagagagagagagagtgtgtgtgtgtgtgtgtgtgtgtgtatatatatatatatgcttttgttccaggcctaatatatatttattaggcctgggacaaaagctttagtgaaccaaatttaataaagctttggcataaattgaaggaaggtacagtaatatactgaggctgctttcaataaaaacagcagaacatgtatgttcaaattaatgcttgtcccttcaaaatactaattaaaatcaactccattgatgcaccattgcttaagacatcttgggaatcttgtgtttggtctgacttctgaagcacctttggtttctttaggatttccctagtggtggcatgactccagcttttgctgatgggctcagaatttggaagtttaagaaataagataacccaaacttaataatgccattttttcttttcattttatgaagggatagctattggcctggtgtgctggctcatgtctgtaatcctagcagtttgggatgctaaggtgggatgatcacttgatgtcaggagttcaagaccagcctgagcaatgtagtgagaccccatctccacaaaaaaagacgggaagataactatgaataaattgtttcttttttttaaaaatgacttacaaataggctctgaaggtggtttgtttatgcagaaacatttgcagaatatcccattgggcgttaggtgctatattgggctctgggcttacaattacagaaattttatagtctgtgctctccagtctttttggagaggtagtgcccacattgagcactgaaagacaagtagggggatataaatctagataaggagtcagtcggacagagtggggtgaaggatgttcagacagggaaacacacatgcaaaagagggaaggtgggacacagcatatgcatccaacatttggtagggccgaggccccacatgggagcagtgagaggttagggatcaaggaagtaggcaccagatcatgaagggtcttgctaagactttattctgaaagcttcagggagccttttaaggatttctagtggagttgtttcatgatcagatctgaacttagaaaaactgacatcttatttttggaggactcataagggtagggcagaagtgaggaaaagaattaagcagccagtaatccaggcagcaagaggtctgagcctgagttcagtggccagggcaggtagagagaagtgaacagcaggacagcatcattaaggagacttggattgtatgtggagggcaaagcagagggaggggtctgagtggtgagggccaagttttggaggaaagtggatgatgctgagttgagtcaccaggatagacagtgtggagccagggacaagagcgtgatgaaggagatgctcaggtttggtcatgctgaatttgaaatggctctgggaaatttaagaagaggtgccgtgtagatagttggatcagagcctaggatgtagacaaagtctgggaacatagatttgggagctatgaacacattccccaggagaagtcacaaaaatgtcccaagcagcaggagcctggtatggtgcttgggtttcaccctgatatgccctgttcctttcagggtattgcagtttcaggttgctcctgtctcacacctagatattttggctcttagctttgatcagatatagctatcaatccctgcatcagtgaactcacaggccacagctaaagatatgctgtcattgaagacaggtttgccctctaaatctaaaaaccaagtgagcaattagaaattgtttaagtgcccattaataggaaatagaataaatatattggggaaagtccatataattattatagcataaattggatcatgtcattcccccactgaaagcatgctggtgactttctttttgcacctggaatacaatccagacaccttaagaccttgcatgatctaaccgtggcctatctcttttggcttcatcccatgccaccttccttcatgccaggatcttctttgactcactcagtcacacactttctcatctcatcctttgctcatggtgtcccttctctgtgaaccatcttatcatttagtagtaactacttctccttcagctttcagcttaaatgacctctcaggagagggtcctttggatccctccccacttcccactcccctactcacctgtgtttttactttatgatctcagtctgtgatttttttttttttgccttttgtctgcccttccgtgaggttagggattgtaagtattataaccctagtacctgaaacatagtaggcactaaataaacttttttttttaatgaataatattttagaaggggaaatatttttgtcttaattcaagctgctgtaacagagtaccataaactgggtggtttaaggaacagatatttattgctcacagttgtggaggctgggcagtccaagaccaagatataggcagaaccagtgtttgctgaaggctggtttcccggtttgcagatggccaccttctccctatgtcctcacatggtggagagagagcagagagaagaagaaagctatcctgtctcttcttataagggcactaatcccattcatgaggactctactctcatgacctaataacctcccaatattatcacattgcctcgtaatattatcacactgaggttaggatttcaacatgaatatgggggagacacaaacatttagtctgtaataattgataagtgaaaaaagaaaaaagacatacaagcatagaatgatcatttccaaaaaagaaaaatttctgtacatatatgtgtgtatttatatgttcatatataacataggaaaaaaagagaaagtgtatgacccagtctgtttccaactacatctgtgcagtgggagtaggtcaggaccttttatggcctattttatttacttctatattatagtatttatttttatagtgggtatgtttatattattaaaaataaatccaattaaaatttccagtccttttaacaatcacatttgtttttatggcaaatgactctaatatgggcatttttttttccagattttccagttaatgagatacttgagatgcaaaatttgttttgatttagaccagtgaattaagattaggtactcattaaacgactgtgaaagtcctttatagataattttgctttatagataatttagtgcttctagtgaaacaaatttaactgatggccttagcttggctattgttgaagaatccttcactgttaggctcccctgcaagacttccctcttcagcacttgtttttttttttttatttttttttattttttattttttttttatgtctatacaaaatatttatttttttattatactttaagttttagggtacatgtgcacattgtgcaggttagttacatatgtatacatgtgccatgctggtacgctgcacccactaactcgtcatctagcattaggtatatctcccaatgctatccctccccccttcccccaccccacaacagtccccagagtgtgatattccccttcctgtgtccatgtgatctcattgttcaattcccacctatgagtgagaatacgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtacatgtgtctttatagcagcatgatttatagtcctttgggtatatacccagtaatgggatggctgggtcaaatgaaatttctagttctagatccctgaggagtcaccacactgacttccacaatggttgaactagtttacagtcccaccaacagtgtaaaagtgttcctatttctccacatcctctccagcacctgttgttccctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcacccactttctgatggggttgtttgtttttttcttgtaaatttgtttgagttcattgtagattctggatattagccctttgtcagatgagtaggttgcgaaaattttctcccattttgtaggttgcctgttcacactgatggtagtttcttttgctgtgcagaagcttcagcacttgtttactggtcacatgctttacacagcactctgcttagattttgcctttgaggttggccatctcccttcagctgctctgatttggaagaagggcgagggttgcagctttccctgagatagggtgacctttttttcccttctgtcttcacatcctaatcacaccacttctaactggatacgaatgtcttaactgtgaaaaactgtgagttctctgtcagaaatgaatctctagggcttcccaagtggtaattatttcctgtgagagttctgcttttgaaagtgaggtttctctccttgacctttaaccctcgttactcttctgtgttcccagttggttcgactatgcaatgagggcgcccggaagatggaaaggactgagatgatgtacacaattaactcccagctggaatttaaaattaaggtattctcgtaccttgttcattactgttcttgcctatgtttttctctaaatagagagagacagttgagggcaacaaagtagataggaaattgcttttcaaagaagggtcataaattgctaagagggagtagcagatgcttcaggcaattttgcttttgcttgtaccagacagagtgaccttcctccaggccctgaagccaggcattatctaagaagcacttttttttttccaggaagacaccaagcttaggggaataaataaaataatagaatagggtagttaaaataatagaattttagaattgaaaggagattccttcattattctcaaaatgttctgaaaaacagtaatattccatgagctggaccagtgttctcctaaattaaataaggacactccttttctcgtttacaaaacagatcgttaatggataatttttttcaagtttgtttttctctcataatttttttgaatatgtgctgcttgttattccttgtctgatactgctcttgagcagatgacaagatgaacaaaaaagaagaaaatgacagctaatggcaaatctaggtcatggccattcttttgttggctcatggctgagtttttaatgggaagtgagtgctcacgattgtgactctattgttttataacttgtaaatgtaattaaacaattttaaatgactggtcatatttttccctagtaaaagtgtttctatttcatgcagtcaaattatagtgatcagcatttcatggtattctgtaaagagcagattctctgccatgtcatgtagtttgaggattactgcatgcttgctttggcagcatatatactagaattgaggatcactgatatagtccagctacacccttttattttatgaatgaggaaaagaaacccagagaataattgtcagcagagtcacttggctagtggtgataaaatcaggactaaggtctagatgtcctgacttgcaggtcagtgtaaactcttctactgtaacattctgactctaatggtttagatgcagaaacacaaactgtaaaagggaagaagatgggtatttgccaaaaaccagacacacatgcacacacatgcatgcacgcacactttaaatagttttaatgttcttgtacagaattttatagcaattaaaaaacccatctttctcccaactctcagaatctcgttctctctaatttgtttctaaatattttggaaagtatatctgacaagtttgttttttgttttttaatttcctccttttgaaagatgaaaaattccctaaccatttttcttttcccttcttcactgaaagtcacttggtataagattactttaagaaactctgtctaggccgggcgaggtggctcatgcctgtaatcccagcactttgggaggccgaggtgggtgaatcacctggggtcaggagttcgagagcagcctgaccaacgtgatgaaaccctgtctctactaaaaatacaaaaattagccgggtgtagtggcaggcacctgtaatcccagctatttgggaagctgaggcaggagaattgcttgaacccaagaggcagaggttgcattgagttgatatctcaccactgcactccagcctgggcaaaagagcaagactcttaaaaaaaaaaaaagaaaaagaaaaagaaactctgtccagtacccaaaattaatttgtaattgaaaaatgctaaccccaaggatcattaaaagtaagtgattaactgaggtcaggagatcgagaccatcctggctaacacagtgaaaccccttttctactaaaaatacaaaaaaattagccgggcgtggtggcgggcacctgtagtcccagctactcgggaggctgaggcaggagaatggcatgaacccgggaggcggagcttgcagtgagccgagatcgtgccactgcactccagcctgggcgacagagcgagactccgtctcaaaaaaaacaaaaaacaaaaaacaaacaaaaaagtaagtgattaacatcagttgagttcctgagttttggttgttttcattcaatgattaaaatatttgcgagcataaagtatggatttacagtggagcacctcatttagaacacttagaattactaattattactaattggaaatactcgtaaaatcttaggaccttataatactatatgaataacagtggacatttctatttaatttattttaatgatgataaaatagaggttcaatgaggttaaatgatttatccaagtacatggcaagtattgtaagaatagagcagatttactgagcatcttccatgtggaaggcagtagataaaaacgtgatcatccctcccctcatagtctagtagaagactgctgaaaatcaaaggagtcagcaaagtctacagctgtcacagtagctagaagactatggaaaatactggaaatggaagggagatggacaactctaagagcaagagacagagagggctgggggacttggagcagtctggcaaggcttaatgccagaggtgtgtttgacctgaatcttgaaaggtgagttaagaagggccttagagcagaaacaaatgcacagtttccactcctgtggcccaggaattgtaagcattcagtgtgggtagacttggggtgcaagaggagcagggtggagctacagtagcaggcaaacactcctgcggacagccctgtgtaccaagaggaggagctgagtgaggtcatttgggagccaccgaaaagttctaagcagggaagtgaagcaatcagatgtgtgtttagtaaagacaacttcagcaatggggaaaggcttttccaacttactccaaatccagaagtcattaaaagaaaaaagtcctaattaatctatataaatttttaaaaaatttctctatagagggaaaaagaccatgaaaaaagtgaaaaggcaaatagcaaactggagaaaaaaatagttgcaactcacatatagacaaagggtaaatatccccgatgtataaaatcaaaatgataagagaagacccactagtctacaagccaaggagcaccaaagattgccagcaaactaccagaagctgggggagaggcctggaacagattattccctagcaccttctgagagcctggccttgctgacactttcatcttggcctgtcttccaaaactgtgagacataaattcctgttgtgtaaaacaaaaaaaaaaaaccactagaaagttgcaaattagaaaactgctaccagaaaaggaaatccaaatgatgacaaagttttgaagatgctttatttcactcagaggaaaattgctaattgaagattagcagataaagataatgaacttcaccttttagatttataaataattcaaaagtttgataccccattttattgatggaattggagaaaaaggcatttttatatgttgctggtgggaaagattgttttaccccaatggtgtgcaatttggcaataactatcaaaattacaaatgcaagttactacaactcagcaattttacttctaagaattctacagatgtactcatgaatgtataaaattaaacacacactgagctattattatagtgttgtttgtaatagtgaaagatgaggaaaaacatctaaatatctatcaaagaggattaattaaataaattatagtatacgcaaataatgtgataccactcaaaagaataaaggagaattttagatacctatatggaaagctttcttatatattattaaatgaaaaaagtaaggtttagatataaaaaaatacagtttgcttttgcagatgaaatatttggacagatgcagatgaaactagttattggtcattacccgtgaggggcagtggtcagggagtgggccttgtcgggttgactgggtggagagccacccactcactcagataggaaattcaggaggaggaacaagttttgggggaaggtaatgagttctattttggccatatttggtttatggtatggccataggtgctactactatgagaatattggttgcaaatttactaagtagtgccattttcacatttatctgatttaattctcacatgaaccctataatgtacccttattattaacttcactttatagatgaagaacctgaaactagagagattaaattctttgctcaaggttatacaccaagacgttataaagtctagattcaaatctttgactccagagtccacattcttaacaatgactgtatgataatgataatatggatatttttctaatttggaggaaagtaaattttgtagggcatgtgtgtgtgtttttcattgtcatttcacacgttttttatttttaattttgcttatgattttctggaagactgtcaagtgctaaactgcagtaatatgagaggagatggaaagcatccctggattggcactttggaagctagtgtaaagttagagcacaggctccagaactgacctgcctgagttgcagtagaagctccaccacttactagctgtacaaccttgggcatcacttaccttttcatgtcttggttttctgaaccctaaagtgaagctgatgatagtactttccctcatggaattattttgaaaattaaattatttaagagatataaagggtttaaatagacctgatttatagtaaacaagcagcaaacattgttgatgtgttttatcagagtagttaaatagatgtgggtgcattgaagagtgagtgggatgtgaagcagttgaagcagattagacttttcattccagaagcttgactatcaagaggatagggcagtgatgataactagaggattcacaaagtcaagggaccattttttgtgaatagtcttcaggatagtttgcagaaagggagccaggagggagagaatactaatgagaggggaataaatcaagggaataaggccttagagctgaaaacagggtgttgaagacaggagagcttatcctctgagatgggaggaaagaaaatgatggttgtagagaaaaagctggtcactaaaccaagaagatcgaaaaccagagattagtttgtgtctcaaatccagtgttttttctccactagaaaacagctttctttaaaagttgcctctacagagttgggaagaattttgtttttttgtcttgcgatggaaagtttgaccttatgaataagcacatggagaagttgaggtttctcaggctgctttaggagacatacattcagtgtgattgagtggagtggtggtatgttagttgacagaaggctttgctggttgccatttgggggccttgctaacaatggaaatccaagaaaaatctttgtgctgtagaggacagtttgttagtttcccaaaaatctaaacataagagttactactatatgacccagcagttccactcctaggtatatacccaagagaactgaaaagagatgttcaaaaacatatacacaaatcttcatggcagcattgttcataatagccaagaaagtgaaaataccccaaatcaacggatgaattgataaacaaaatgtgatatatgcatatagtaaaatatttaggcacagaaaggaataaagttcttatacatgccttgtggatgaaccttggaaatgttatgctaggtgagagaaaccaaattcaaagatcacatattgtataattccatttatatgacacatccagtatagacaaatccatagagttagaaagtagattagtggttgccagatgcttgggggaggaagagtggcagatgactgctcaatgcatatggggtttccttttgaggtaatgaaaatgctctggaattacataatgttgattattgaacaatattatgaacatactagaaaccactgtattctacaccctttgaagtggtgaaatggtgaatttcatgttatgtaaattttatctcaacattaaaaaaattatttgctcttcagcagctctctcttttcttgctgccccataaaattagttacattttatgccaaggctagctttctaggatgccaggtaatagaaaaaaaaaaatgaaatgtctgtgctccataggcacagactatttcagtactatttaggatagtatttcagtactatttaggatatatctttgttcatgaatttcttttctagtttctggttcacacatggattctagtctcagcatttccttactaggggaattcactcatgctcactttgggctgttctgatttcctttatttggatcattttaatatctcttctttaataaaacctatctgattgagttcagtcttctaacaataaatctgaaacataaactatatataaaatgttgggcttttgttttcaaaagaagcatagatgtattgaaagcttttgtcaattttaggtgtttataggtagaaatttagttttgcccctagtggagtatgaggactccataaaaatgaatctgctttaaaaacaataaaacaatttaaaaatctttctttctccaccccctaaatcagaacagtcacagggcagcatgtgcactgaaacttaaccataatattgtccttggttcatcttgtagggttatacgcaatagcaagatagtcctgtgtttcctgtaattccggcccttcagccggacctaccctgacacaaggtgacctcttgtatgtgctgcctagtctgccggagttatctaagcaatctgtcgacctttaaggtttcagctgtctctgtagggtaattgtctgatttcgagattttgggggttgggaacttcataaactcccttagcagccagttttgaaaagtttggggttagccataatcttttatcttcgttttttggaccttcaggaaaatagtatataaatgataagcaaccttcttataaaagctctttataaagtttaaaataaatatgaaatcctttcttagccttctcatttcctctctaatatcctcaatttcctttagctatttttaatcattatttcctgaaaagggtgatgtttgattgcatcacatttctgcattatgttttgtgtgtccaagaacttttgcttattttatggatgtagtcttttaaatcagagttttggcagtaaacatttctggtaacttaaaaaaaaaaagctttcaagggtaaggattgttctgtagttttgagagttttccagttggcttgtacaagactgaataaagaaaataaaaaagcagtatgtaattttttggatacagccttttctatgatattataatgattatgatggattattttggaagaacctcattttcacagccagaaagtagtatgatgctttcaggtacaaacttccatgaagcaagctaccatgatcttaagaacaggtgttctcaagaatatggctaaatagataatttgtagacaaaaaaataagcatgtaggtttttttctcttgaaagaaacctttttacttcatgaagtaaatgtagacttttatatttgtctcgttaacctatagttgtgtttttctgtatgtttagattctgatttgagatatttaaaataactagttgattctgatatattttattactaggcttttcaattgtaaataactccttactttctttttcagttaagagttaatagaagggtcataattttttattgatccaataacattttctcattgagttttagtttcatattgggaagttaatagttttttatagtggaagatatattgttctttttcattttttcttgaagaatgcactgtacttctgtatttatagttcagttttatatgcctataaaacaatgatgcatactatgataagtatcatttgtttgaatgtacgttttagcttttactttcagtaaacttaaaaggatttcaatttagctttggtcactgggtttttctccttttgtagccttttcctttagtctcctcttcccggtggttggtaaaaagaggtgaattgacagcctatgttgaagacactgtgcttttctcaagaaggacatccaaacagcaagtctacttctttctctttaacgatgtgctcattatcaccaagaagaagaggtaagtctttatctggtgttgctgactagacattccagttttaaagttctgtaattcagatgcctgttagggtgatcatcctttaaaagctagaaatgttggaagtatagtttctacatactgaatcataattgcatctatggttcattttctttaaattgcttatgtagtttcagacgaatcattatctgcatcataattcttgccaacctctattgagccactgttctaagcattttacacatttatatcattcaattcttatgatatccctgagaaggtagcactgtttttattctcattctgtgtttttcagactccttctaccataaaatttttgtgtaaaacagaaaaaagttggtccagttgagaacaggttggggagcaactctagtgctccttttaacttaatttaaaatgcactgcttttaatgatccttagtctaaaacattcccctgtgactgggaaggtgttagccatactcccttctgaagggaatgaagtaaatcatttgattggcagagtgtttgttcttcttactccaggcttctagttctgtgtttgtgtccagctctggtgagatgtccatgaagaatattgtagaaaccttttctttccagtatttcttctgtcagactgtttctgttctacacacacacacacacacacacacacacacacacaccccttcagctctgcctttctctagggaacatactttattaaatgcacccaacacatgtaaggtcctatgtaaatattccgtctttcctagaatatgaacttagagtgaaaacttaaatctgtgggctgttatttccacatatgagggaaatgatggtggcctgaattgatggcatatggtgggatcaggggtggtcctggggtgcaatttaggcaaggtgaagagaattatagaaacagatctctatgaaaatacaaaataaatgtccaaatgtatcaggcatatttaattaaatgctagttctgagttgctgactttatagcttgaaaattcaaactaaattaaaacagattgagttcttctttttgctccttttaatcagaccatattatgaattatttcagctgagtggctgtctagctgaaatgaaatgttagtatggtcttccctgagaagccataatgtgacaatgatacatacattaaaatgctgatcattatttttcatacttaggaaaattctatttccatatctccaaggagaaattacttctcttacctggagtagtctaaatagttctagcagctaagtaaaaatttttttttttttttttttttgagatagagtcttgctgtgtcccacaggctggagtgcagtggcgtgatctcggctcactgcaggctccgcctcccgggttcacgccattctcctgcctcagcctctcgcaggcgcccgctaccacacccagctaattttttgtatttttagtggagatggggtttcaccatgtcagctaggatggtctcaatctcctgacctcgtgatctgcctgcctcagcttcctaaagtgctgggattataggcatgagccactgcgcccagccgtaaattttataaagaaagatgggagaagaattataatttttatgtttttgtgttttgttggtttcctatgagatagcatttttccttggctttctccaggatgttttgtttttaggggagagtagttatatatgtctcttcaaatgccagaactcttgacttttaacatcttccagctgttgaaatatttgttctgtctcagtagaccaagagctttaactaaaatttgatttaaatggtaaaatgtacactgacagtaccaagccaattttaaatataaatgtaatttcgattatgatgactttggtgacttaatgaaaatattaaaggtatttaaaccagtacagtgcaacttttgttcttgaatttgcacagacctactcaataaatatagactattgaaagtcagaattaaggtatatgctcttctacttagtagcgtactttgcccttcacagatggtgttgctctcctagctatcccacatttatttgctcaggtaaatttgaacttgtattattaataaagagcaatgccattgggagtctttgagaattttttttttttttttgagacgggcgttttgctgttgttgcccaggctggagtgcaatggcatgatctctggttcactgcaacctctgcctcccaggttcaagtgattctcctgcctcagcctcctgagtagctgggattacaggcatgcgccaccatgcctggctaattttgtatttttagtagagatggggtttctccatgtttgtcaggctggtctagaactcctgacctcaggtgatctgcctgtctcggcctcccaaagtgctggaattagaggcgtgagccaccgcacctggcctttttttttttttctttttcttttttttctttttcttttttttaagagcaagatacacagctccaatggagaggacaacctgagtacctaacttggcctttaccaaaactagaattttttttttgccttaccaattagttcattatatttctagggtgttcttaggtaatagtattggagacctaattgtttatgacctgaatatgtggtgaggttacatgcaaaccacagaagcttcataaacagacttggttaaaaatgtacactatgcctgaccgtatttacatgatagcttcaaggaggcgaactgcaaatgctttgcatgccagaggcaacagtaaaggagatacaacaaccctgaacaaggcgataatttaggcttggccacaagttacagataaaggaaaatcacctgtgccagcgcttgaggactgatctagccacccactgcctaattctaattccaggtttcagtcaaggaacttagcagctgggcttccagtggttttcctcttcagggaggtttttcagctactgagaaaagctgctcgggaggacagttactcttcctcctccgatccagactggcagaaggtttatactgggcacattccatagattgctgaggtgtgtggaccccctccacttcacagtgcatgtatcactgcttgtgcttgtaaagctggcttgatgagtggccatgacactgtctttgtgacaggaattttcacttttttagaacattaaaaacaagcttattttaattattaattttttttttagagacgggaccttgttatgttgcccaggctgcagttcagtggctattcacaggcatgatcatagcacactgcagcctcacactcctgggctcaggcagcccttccacctcagcctcctgagtagctggggctgtgggcatgtgcctttctctttacaagaaagtttaaagttttcattagccctggctgctagtgagtcactctgttaatagcctggttctaccagatttcaaaaggatacatgattgattactctggatgagggatgaggacatgaacactttggtatttgaagctttgactagaagttatctgggtactgcaagagcagacttctcaaccttggcacgattgacattttggggcctgatgtttctttgttgtagaggactgtcctgtgcaataatgtaggatgttttagcagcattcctcgtctctatccactgttcgctagtaacagcccccttacaccctagttgcgacaaccaaaaatgtctctggacgtttttgcctaatgtccccatggagcaaatccctgctagttgacaaccactatactagcatggtagtaaactaaactagctttgcctttggagtagtgaaggtgtgaaaatctatcagactgacacagcaagaatagtaatattgtattataaaagtaatttattgtcaagttatactcatagattaacaaataacattataatatccaatatgtgcctactgataacttattataataaagatgaattacagactgtaccttcatgtataacctatggtctaaatactgttgttcctagttttgaaatacaaaactgaatccaagatctaactaggttcaagctactaaaagatttattttgtaagatatagtcccttctatctggcttaggtcttctctaccaatatcacctgaagctgaaagcaaaattttccttcctgtatttgtttccttactgtgttagtttcttacagctgctgtatcaaagtgccacaaacaaagtgagtggcttaaaacagtcagaatttattgtctcacagttctggaggccaggattatttccatttcacagatgaagacgctgaggaaaagagagataaaatatctttttcaaggtctttcagcagagccaggattctaatctgagtctttgtttccagaggctcaatttctttatgttcattacttcttcattttatttttctagaatatttcacttttcccctcatcctataaagttattgggggaaaaaagcatagaaacttacaacttttttgtttgtttggagaaacatcttttccaaagtaagcttttgttgagtatttttatagttttactggttgtaggagaaaactagaaccagtaccaaatcatatttgtgagttttcctctgccattagctaatctagcatcagaatctggggaagagtttccctttgttaacatttccttcctgcagacatttaagacaggagatttctacttcctgatttctggttccataaatactgtgtatagcttgagccctggttacaactttctaggttttataaaaaggttttcaaaatttttaatttttttttcaggttttataaaattttctgtaatagcaaactactaggtcattatcataaggtcaaggacttaagttcaaatttggattttcccaaatagtttgaacacccagtggctcaaagctgtgcaggctcccttgaaaggttcatggcctggtttggttccattttttgctttttccatgagaatgctctttcctattatagaaagctgaaaatcacctgatacctgtttcatctgcagaataaactcgttcctagggaagtcaagagtatcctggctaaaggaaaggcagtaaaaatgattgcaagctcctttgttcctgaaacacatgaagcttgcttatttctgaccattttggaattgagttctaaattcaagatggcaagatggggtggaaaagaaatgggagccctgtttcctttttgctcctttttttcttccgctgtcatttgcagccttgattcctctgatgttatgaggtattgtttcccctgcatctgtaaggagagttggcattgctgttaaatgttgaaagctgccactactgagaagcacaatatcgatgcctggggtcagaaaactgagctcaaatcctgggcaaattacttctcgtctctcagagcctcagtgttctatctgtaatatggggataataacatcatcttcatcatggagtttctgtgagaattaaatgagataatgcacataaagctcttactacagtgaatatgaatagtcctgctaagtaactgatacatgctatcattaagattatttttggtattgtgttctctctctaaagattttgccgtaaatcaaattattgcccttctgcttctagaatattttattgtttttaaaaaatgattttaaacctttacgtaattgctacatagctgaaggtacggcacgctctaggaccagacatgaatttatggcctccagaacatgagcagtttaggaataaatgcctttaactctatgcctttccctcctcatgaaacccatgtcaggcggcaagtgagtgaggaaaaactattggtcaatttttattctttataaattggtgtaaatcatgtgtacacgttgtagtagcagttttttttttttttcactattcctaaatgactaggagacactataacattgttgctgaaaaatgtgaaataaatagtatatttttcctttttattgatgtcgtcagtagtgtggtactcctgaattggagtgtggggttgctgtataatttggataaccttgttacccacttaagaagctgtgcctgctcttcagggcttgcttagttcagcttatcccagggagagagcttcagaaaggtggtgacagcctctcagaactgtccatctcctctttttcaaggactatgggttcagagcatcccatgagcagccacagaagtgctgggctgtggcatctggtgacccttggtgacagggatggggcttcctggcccttttctgggtcactggccatcttttttggtggcagtcatactgatgaatggggatcctcatctccactatttgttatattattaacaatgaaataggatgtatgtggcatgtttgttagacttcagaattagcttgaggaactgagcaagtaagcctatttgaaatcagtttctggataaatattgtgccttgttttgctggtctgagcacttgccaaattgtggatttcttgacatgggtatttagctctaattatgcttggtccacttgtgcatttgcaaaacatataattatcaggcttttaacaaaatgtcaggcaatttaaatggatggcgttctgttaagaaaataaaaaaaatagctgacatttactgtaagtcaggcatgattgtaagtgccttacacacaatgaggtaataaatgtattatctcatttaatcctctcaacaatccagtcaagttggtactgttattcccactttacagatgagaaaactgaagcacagagaggatcagtaacttgctttggttcacaaagccagtgagtgagtgggtttctttctttctttttttttttttgagacggagtcacccaggctggagtgcagtggcatgatctcggctcactgcaacctccaactcctgggttcaagcgattctcctgcctcagcctccggagtagctgggactacaggtgcttgccaccacgcccggctaattttttttttctatttttagtaaagacggggttttaccatgttagccaggatggtgtggatctactgacctcgtgatccacctgcctttgcctcccagagtgctgggattacaggtgtgagccactgcatccagcctagaattgggtttcttaccagacattccaaatcatggctctactcttacctgctgtgccatatttcattcctttaaaattgtatattattccactaaaaacatgttagtagtataattctaaaaccaaattgaaatggaaatcaacctcagtcaagtgaaaaaaaatttttaactccttgacttaaaataaatttcagcataaattcaatgtccttcatcccagcaaagtttgactagagtgtttctgttccatttaaacacacgatcaagtgcgacggtttaggaatcatgttttttagaaggagaagggaaacaagttgaaatctacagaacactttttctcatacatatattggaggaaagtaggaagaatttcctttgatctcataaaccccattaactcctgtgtatcagtgctactgggggggaatgtcagagccattaaattcctcagagggatttaatgcacgacagtctagaagaggatcttggagagtgtccccaaagaagaatgacttagaaatgtcacagaaggcattagaagatagagtttcaggattcacagttgctcagtgtcactagattctgtatacatgcaaagagaaataatggtgaaatccaggtgtttaatttggtggggtgatgggccatggtggccttcggaagccatttcactggcctgtaagcacaagggtctgaaaaaacgcaggcagctgctaactcaggaaacatttgttgtggcaccagcacattctagtaaatatttttttcgggacagaaaagctatgtgaatgttctaaagcctatggaaaggaaactactgaataggtaaaaaataaatgtcactatcttgagaatatatgccaaaaatcatatgaatatcaatgatgtgataaatctcaatagcatcttttcttttaaattaaacctttttacaaaaggaagaactggaagtgctgcttgggtttccatctgtcggatttgggccataaaacagagttttaaaacaatgtaagcgggtacgtgagagttacacctacagctggggctgagagacgtgggttgtgggaaagctggcttgtgcagtctaaccctttcccttgcctccccatcaccatccttcctttcactatcctgggtgcatcttggtaagctagcctattttccattcctgttcatccgtattaagtatctaaaatgcttgctaataaggattaagatgagaacttgccctaaggtatgtacatgtttaacagcacctctctgaccacaaggcaggccgttaaaggtctgtatccagcagaaagacctgtcttgtcacttagtttttcttcacaactctttatgtacccagagcttgggtccaaggaaatatcctggtttaaggagtgagattgggatcaacattttaaaaaaatatttgatatgtttccccaaatgtcccaatattatttattgattaacccattaatttttttagagatttgaaatgtcacctctatatccccagacatgtctgtgtcaactcgcaaacccactattctgcttcacaattcatcagtcaactcgtgcccttgtcccagtctttgaatttctgcagctttacagtatgtttattttttaattttttaattttaattttaattttttttgaagcggagtctcactttgtcgcccaggctggagtgcggtggcgcaatctcggctcactgcaaggtccgcctctcaggttcacgccattcttctgcctcagcctcctgagtagctgggactacaggcgctcaccaccgcgcccggctaattttttgtatttttagagacggggtttcaccgtgttatccaggatggtctcgatctcctgaccttgtgatccgcccgccttggcctccctacagtatgttttaatacatcataaggctagtttattcttttttttttccacaatctttctggctatttctgcatgtttattttttttccgtgttttacaatcaactcaactatttctactccctgccatctctcaaaaaacccttgcttgtgttttcactgggttgtgtttaaattatgtattaatttaggaggaattggtatcttgataatatcaagcttttctattcattaatttgggccttcttctaaagttgtttaaggttatctacatatagaagaaacctgttaagtttaatccatattaagggttttgtgggttttgtcataaagtgggttttgtcataaataaagtgacatcttcattttatattctaactgggtgttattcatatatacaaaagccattttttaacacctaatcactttactgaattcactctcacttggtagtatattttcagtcaatgatgtcatctgcaaagagttagttgttagagggcagaaaagacattccactatcaggtagtcacttcagttgcatccttaagcagccacagacacctagagtgatgatagctgtcatatctatgtatttttgatgaaattcttgttttttacttttacttgtaaaatggttcaaccttgcagaaaattatcaaacatgaacatacctatcatccatacttaacagatactttttgccgtattagtgtcagatccctcctttttaaacaaaaaaaaatatataaaacacttcagattacccaaagtccttccaccctcagcccttcttcctcctcttctccagagtacctgctccgctgaagttggcatctctttattcttgtgctaactactgcagatacatatatggagctttagtatttttaaaatgtatgcaagttgtatgcaaatttttaaatgtcttcctgatttcaaagtaataaatatatgctcagaatgaaaattctaacctttatagaaattatgggacagaaacttaaagggcttcataataatctccttaagaaagccactgttgataataaggtatatcatttttctgcctttgatgttatgttgcgtatagtagaaccaaacactgacctgcttaacaaagaatgccctccagagaagaaaaaaacaatcagaatatgtatttaccatcatatcctgttctctactagtagttctttattttgttaaaaacaagaaaagaaagaaatctcaacaaaggttactaggaccttaagtggatttcaacagaggaacccatcactgtttacacttcaagcaacagacttatatagatttgattcagttgaagcacctgataggagctgctgcttgcacaaagcagacgccttgatgagcagctggtaaacttggagcacatataagacaatcaaaggaagtctccatataaacttctccatgcaaggaaagatggtttttccatttgcccttttctgagcactttaacttcctcattacatgttccaaattgtttcagagactatataaaccatatgtttgttaaacgatagagacaaacatggggaagtctgattagcatcagcttccctcaggaagggggtttctttcccaaccctgtttagcctgctccatacttattggacatggggtaaataagcagagatgggaaacgggctttaaacagctgcacctggctatagagtttctgctcctctttctactgaagcactactgttaaatggaattgtttctttttatagtagatttcctaaaagagcagtaaggaaggtgtaaagacctacattatttattgcataatgcagaagtttactggcctagacgaagtaatgatattggatattgggtgatagtaaattactttaaaaacaaacaaaaaggccaacatgtttcctgcattttgttttggacccagaagtccagtgggccaagttccttgttcaggcatattcaatgacacaactatgcagatgtgtggaaataaacacttgaggtgaaatcatatagctgtgattagggcagccacagtttatcattcaaactggacatttgagaggactacaggcataaactgagcccagcagccatcctgggtcttaatcagtggcattgtagttgtcattgcttaagagaacaattaataaacattttaaaaaagtatctacttctgtctttatcccccaaagacaagaaattaaagcatttatgactgaaaattgaaaaagaagctggctgggtgtggtggatcaggcctgtaatcccagcactttgggaggccgattacttgaggtcaagagttccagaccagcatggccaacatggtgaaaccctgtctctactaaaaatacaaaaattaaccaggcatggtggtgcatgcctgtaatcccagctacacgggaggctgaggcaggagaatcacttaaacctggcaggcggaggttgcagtgagctgagagtgcaccactgcactccagcctgggtgacagagtgagactccgtcacacacacacacacacacacacacacacacacacttaactagtttattcatattagcttatattcattttctgtgaacccttggttttgaattctattgggatgacttgataggtgaaaccactttatgttgacaacattttcgaatttgagtcatctcaaatgatgactttatagcatattcatttctttgacttttatttctttggaaatacctacaacgcctacacacatgtcattgtttagggccttaccccatgttcacaatattaggttgcttccatttctctttctgaagcagaattgtttttaaacagaaacaggtgcctttgactaacaggttttttaacttgtaaattggaccaaaagagtaatcataaggggcagagagaaaatagtaacaaagaagcctcagttcatcctctttttctcttgtttttgatgctgttgttgttgaggttttgttatgtttgctgttttatcctggttttggtttttatcctgagtcctatgctgttcaatgcatgtctgatatagtatctatacaacatgataaacttgttctgtgttgctaaaaattgactgctttgtttctagtaaacatagtcttttaaaaaatgaccgtatttgtttgtaaagcgtattattcaccttcctctttttataaacatcatgtctactttgataagtctcattttggatgtgagaaatatttgacatatccaagtgtgggtgtgctggtctgtaggcagtctcaggagaactttggagataatcgtgccacacaatcttttaattaatacagattactatcctaggaacaattaggcttgatcagaaggcaatattttgcttttatagataactgcatttgctgttttttgagggcagaatctatcaaaccaaattttagaaaagattataaagtttttcaaggagcatgacaaaagagtggttgacaggtagatgtccattctgaggaaaataaattccaggaaatcttgagcaaagtggcctgttctgaaattcctcctagtgtactggactaggcacaaggagttttcttttctctaagctcccctgacatcattcatttgcatttattattaaatgaggtaattattcgatattcctagcgtatattagaatttattgcatattcatccacttatgtgacagttatttattgagcactctcatgttcactcgcaagggtgcaggtgcagagtagaggaaaagctgtatgtcaccaggttcgggatttgccaggcaaatacaatcaaggagatgaatgtgtatgcaagatgtgatttaactgggtaccaagaaatgcaagctagctaatttaatatgcatgaacaagaggacatgagggaattaagggggggaggcggaaggttgtagagtcaatgggttgtaagaactggtgagttaaataatggttggtgttgaggattagaggaggtgagttggaaagaaaggccatgctggttagagagtggtatgtttgacactgggattacagagagtttgtagttgatggtaatgacaaggactaaggtataaccatggatttgtggctgaagtagggcagaaaacaagatcatcggaggagagtaaagtcggggaattgagggtacagggtaatggaaagatcctttacaggagacttcaagaaagaagtagtgttggggacttgatgtaaatgaccgagagagagagggagagagagagagagagagagagagagagagagagagagtgtgtgtgtgtgtgtgtgtgtgtgtgtgtgtgtgtgtgtgtatgaagaagtattgttggagagagacagagagccagcagtgaaactcaagggagaggatcggaaacgatccaggggtctatagatgactgtagttatgagttagagactgatgccatgagcttcaaagctgatgatgtttcaggaggaggaagtgatcattgtatagaagcaggaataaaaagcaagcaggcagagagctctcaggagacgccttgttctctagggagagccaggtttcttttaaggcaagaatgtgaagggagggttcagagacgaggccaagtatttagaagactttactagtttcttaaatgagggaattgcattcccagagggtacagtggaaggggttcaggaaccagctgaggagtggaaaaaagtggggccagattgggcatgttcacagtgcgatgggaatgggagtgcaggagaaagaaggatattggggttcctgagcctaagcaggaatggagggcataatgagattagtcctggtggtttgtgaaacaggtggtgaggctctgagtgtgggacacaaggatgggttgggtgtcttgccagaagcaagcagacctctggggctcttctcttcaatgcatggtcatttggagatggggggtttggggggtgaggtcttgttacccagagcatgagtagaaggctcctccttcattctgcaaatagagatgtggaagctggggaggtacacctgctggagcatgaccaagatgcatgtaaggatgcaaggatcacttattataacagttccaggatgatgtcaatacttgagatgcaatttagtgtgttacatccataaaaatagtaattaggtttaattggagggggttacattgattcataatcagtagatagaattcaaattccaattcatagtttaaaataagtcattctttccctctccttcctgcccactccttgctgtttccaccaaaatgtgcctcgaaaactgacaatgtcagtcttatctgctgaataattgacgtgttcttttccctttcctttacagtgaagaaagttacaacgtcaatgattattccttaagagatcagctattggtggaatcttgtgacaatgaagagcttaattcttctccagggaagaacagctccacaatgctctattcaagacagagctctgccagtcagtcacctctttactctgacagtccttagtaaccacgcgaatgagaaagtggagatgctactaggagctgagacgcagtaagtatatgtggggaaaagattggaatagctgatagtatctccctgacctgattttctttggtttacagacttcctaaaaacagcagctactattcatgtttttgttgagcacctactgttcgctaagcactatgactgggtaatttttacagatgttgttcttttcattgtaatcttcttacaggagaaggatgttgttattttttccctataagtcctgatagatgcactgtgctttaggtgatgtctttatttttatagagtggtttaaaaatcattttacttttttcattgacaaaaatatgatacactatccttaaggaatatgactcaactggtattttgagtctaggccataagccttcttaggtaatggaattcaggtcgtttctcagtcacctaccttcaaccagagagcagaaagcccaatgatttctgtcaaaagagctacccagtttacggaaatatactgataaatcctctttctaatccagagtttatgcacgaccaaaacaggcgtcctgttggtgcctgcagtttcgccagcagttagtgtgcacttagttctcacattggatgagtggcagtgagggttaactttcaagtccaccttagtgattttttggtccacttaaagatgactgaccaatgtttttgtttagaaactggaaacttcctcttgcaataatcatcatgggcagatattatattgggtcagagagtggaacagtggagggaaaggagaagttccctaattctttgtcctctcagattcctgcctccaactccatgtctgccagggttcctaaatggtgtggttaaaatggatcagcagctgatgaataacaaccctaaaattgtagcaagatcttagagaaagtgatcccaaagaggtatcttcaccttaagactgattttaacagtgttcctagatgattaacgagaatattcaagaaaagttattgaaggacacttgctaaagcgcagtaagcttcgcagcctttatgcaaggtcatcttaacaggcgtaaggaccattgcagcaacgtctccagtaggggagagagattgggctcaacttccaacacagcatgggcaagtgggaattcatagccatagggcaggatggaggtcagtggatggaaacttactgagaggaaatatcagagataagggctattctggctaaactaaccaaacaggattcttgctgaagacaggccagggtaattagacatcataacctctgggatgatggagaataatgaatcttatcagatattgaggatggggtaggggatattcttgccaaattgacttagtagggttctttgctaaaactggattttacgaagaactgtacagatgagcctaggagaaggtacagaaatctaactgaagtttggccaagccaagaatctttgtcaagagacataagaaaaatgtgaaaattacaaggcacccacataaaatgtcaaattatttcatatcttttggcactagaagtagcatttcacaggctagagaaaaaaccaaggacaggttggtgaaagctgtagcatattccaaatgagctggagagttcaccaaggtaatgaaaaaagaaatatatttcataaggctacagctaccatagacagtggttcctctgatggatctgggcaaagtaaattaaaagccttctggaaaagattcaccatcgtagatgtcattaaaaacattcataatttcatgggaggagatcaacatatcaacatgaacaggagttgggaaaagttgattccaactctcatggatgactttgaggggttcaagacttcagcggaggaagcaactgcagatgcaatggaaatagcgagagaactagatttagaaatggagactgaagatgcaactgaattgctgcaatctcataataaaacttgaacaaatgaggagttgcttcttcaggatgagcaaagaaagtgaagttgctgtgagcattgtggaaatgacaacaaaggatttagaatattccgtaaactgaattgataaagcagtggcaaagtttgagacgattgactccaattttgcaagaagttctgcagaggataaaatactatcaaacagcattgcatgctatacagaaatctttcatgaatgaaagagtcaattgatgcagcaaacttcactgtggtcttaagaaacggccacagccacccaaaccttcagcaaccatcaccctagtcagcagccatcaaaaaaaaaagggagcttcatcttcatgtgtttgtttacaaaacaaacaaatgcctttctctgagatcccagagttcttcccctaaaggtgctgaaaagcgctgatggcattccaagcatgcccctctgtgtttgcggctgtggggaggtgagcttgggtgggcgtgtgcttgctgatctgtgaggtgaccagcaagtgacacacccaagaccagggtcaaggggaggcattacttgaactccaaaagtggtttaaacctcttggccagtgaggacaaactagacttcctttgtgtggggaaacttctcctcaaaacagaatttttagtatgcctgtgctttggattttatatgactttaaggatgagaatgactttaacactttggaaatcagtaattttccagtgttccagagaattctcagaaactagagacttccctttccccgtatagttagtaatggtgaaagtgttgctggttttgccttgtgttttccttttctttggtttacaaggattgtttgttctttattcaggccttgccaacatctcaacagagattttcctgactgtctcattcataatttatgtagtctccaccactcatttctgagatgattccaagagagtaggaggtgaactgacatgtccagcttatttcacgccaaggctagatcctttcctgggacattctgtagcatttgttccatccttttgccttttaatcttgccaaagactgaatggttgttcgtttcctcaatcagacatgttctcagaatatttagtcatgtcacttggaaacccataggtctgactcatatttgtagttatttaattaatagcaagagaacattccagaaggggcatgggacagaggtctccttgggtacagagggagtgactctctcattctctttgctctccccacccccaccctcaattacagttgagaagtaaataaatggacatgctttcaagacataaaatagtattggtgttgaaaaaatatatttaacaactaaagacgcactttccttaaaaataaaaaagactattaaaaaacctggcaaattgttacatgccatgtttgcaaatatgcaggttagctttgggctaccgagttttgagcaattagagttttgatatgcatagaatgtgttattttcttccaacatttgtgaaatgcatcaataagtatatattgtttaggttttctttcttttatgtctttttggttaatatggttcattggcaatctagttgaaaaaacaaggtttgcactaccattctagccttaagtaattgaagaacttagagtcaggtatataatttcactacttactctttgacctgaaaaataatgaattttacacctaaatctttactttctttgaaaaactgttgtcactaaaggccacctgaggatatacaacatgtaaaatcagcagtaggaggggtgcagctgtttggcacaaggacaattcaacttcataagacagtgaaattgtggaagaaaaatcaatggctttgattacgtaaagaatgcagaaatgctcaccaaaaggagttggggcaaacagtgagcatctgggatatgccaggcactgagccagctatagaacatgacgaagggacccatgggtgtttctagaggaggacagaattttgagctgaagaaagcatatagggaagtgatcagacatcttggttttcccagaatcagttgttcaagtttgggtccgttgtcctggtgaaattatgaatgatactctttttgactctcaaaaggtcctcgtttatacaatgaaatatatggtgaccctaattatatataattataatattacataaaacaaaatattatcaataacaaattataaatatatacacatatttataattatatacatggtccaactctctcattttcttcccccatgtgaagtgactcacaaaggccatacaggaagtgagttattgccaaagctggaactagaatctggccttcctgacagtctagcagtctttctagtaacaaattttattctttttacggagaagctgccaaccagtaggctgttccacccccactttgctgctcagtttggcttgttctggatttggaaggaaacctccaggaagtcagtcgctattaactgtgagaaactactaaaatatagaattttttaagtccaaagactttattattttttattttattttattaagacagagtttcactctgtcgccggggctggagtgcagtggcacgatctcggctcactgcaacctccccttcacgggttcaagtgattctcctgcctcagcctctcaaagagctgggattacaggtgcttatcaccatgcttggctaatttttttattgttagtagagacggggtttcaccatgttggccaggctggtctcaaaactcctgacctcaagtgatttgcctgcctcagcttccaaaagtgccaggattacaggcgtgagccattgtgcccggcctcaatccgtaggctttaaaaaggaaaaaagattgtggaaacctagatgttaaatttaggatatcatatgggttagaatattttatgataaaatgctaaatagatattgcatccccaaaattattttccatgttaaacttccttttttgttcctttgcctgtgtttttcatacttcctggaatgccctcttcaggcctcctcagatggccagatggctcctcttagggcccatgtcaagcctttcctctgctgaggagcctctcagtactgcacactgcagtctcatcttgagaatgcccagtgctcgctgtgtgtgccactcattagttcacttttcccctcatgttttctgtctcacccaccctccactgtatgactccaaactcccagcctcctgctacatccttcctttcctttacagaacttctcaagagagtggccttcatttctccagattaattcagtggatttttgtcaggcacctacttcccatcaagtgttattctcagtgctgggatgtagcagtgaaccatacggagatcagatctctgctcttaggcttatatccaagtgaagaaccgatccccttgggcttcctgctcttaggaagggtgactttggatggaagggagctttggccagtctgcctgggcaaatggtctgcaatgagctaggatgatgggaaagtatttcttcatgatccagttaaaaataaaggatcatttcaggtagtggtaagtgcagtgaagaccctaaagctggtgatgtgatccggagtgagtgctaattggggggtggtgaggataggtactctaacttaggtggtgcagaaagacctctcttaagaggtgatatttgagccttgagtgaaaaggaggagtcaacccttaggaaaatgcagagtcagaatgtttcagccaaagggaacagcaggtgcaaaacctctaaggaaacgaatttagtgttctcaaacttggcttgaacatggagaatgtggctggagcagaataaaccagggagaggggtggcagtcaatgggcaacaaagtccagtttgtcttcagagctaccccagtgctgtctgtgggccatcagtcctcaagtagttaccagcctggtatgtaggaagcagtttgacatttctgaggcatcaaaacttgtgattattttaacaattaatttatttttactgtatttctaaaaatgcttggtctgcaatggattcaaggggtggagactggttctctaccagagatatctcgagaaacactgatttagaaccacataagccatagcaggaagttccaggaacaacaggggccctggggacagaagtttcagtggggcaaacaataagaaccctaaccctaatcctgttggagtagtcgaggggagtcccgatgttggcttggaccgtgatatgtaggaggagatagaaatgttatattttggagacaaaaacaacaggaccaactgatggattggatgagttgaggtggcagtaagtggaagagaggaatcgatgatatttagatttttggcgtgagctgctggcgtgagctgctagcttgagttgtttcttaatcaaggtaggggtacgtgcagtgagttgttagctagttgagttgtttcttaatcaaccttggcgtgacttcttcctctggcaccctgttgaggcctctccatcagattaacaggcttcctagtttcacacccagcagtccaatcttcctttctttacctctagtatcatttagttttattgaccatccagctctttcatgctaaccctttttttgagattatgtttttctcagcctcttatctatgctcttagtttgcctctcacacctatgaccattcctcttctctgtctcttcagaaatgcagcctgtccaaaaccaaacatcaacactgcccgtggctttccccgacacacacatttctgtaaatggtactattgacactcttttgcgttatccagtctggagacttggtgctgtttttgatgcttctgtgtcagaacagatccatcacctgccagttcttcctgtgtaaaagtctatttcatctttccccatctttccattccactgcctccttcctaggtcaaccacatggcttttgaactaccccaatggcctcctagccattctcctctcccatcaatacagtagttttatcactaatccctaagctcagctctagttttgtcctttccttgctttgtacatagcgagtaggttcccaataaatatttttgggattgacccataattattataactagcttttctctatctgagacaaggtagaagagtaaccaggtgtggagaaaaactgcttcctgtctctatttactgccctttttgttactgctggagcaggtttttcccaaattttacttgtttttcaattttttgctattaaggattcagtcaaatgttttttaggatgtacgtcgaagtcatgtatactgtgttatatctgtttgtccatgacaggccctaagtcatggtatcgtcaatgagacaatactctgtgaaaaatacagaagtctaccctttataaaaggacaaaggaagaatgttttaccactgtcattcttttttccctctgggcctttcaagaggaatgtgggagccagagagccccctttgtctgccttcattaaaatgaagcacagacagctgcagctggcacacacaacaggctgtggcaagtggagtccttggcttcctgcatttgcagtaaaatttagatgtcatttgggtgtagtgtataccgtcatgaaacatctaggacatgttcagtgatgaacacaaactttcctcactcattatatgtcagttataggatatgatgaccttagcccataatcaaatatccttctcaaaatttctccctcacagagctagaagcataatgaatgtggttggtgctgtcaaccatccagacaccaattcctgggcctcctgataaaggggcattgtttgcagggagtctttgagcttttcctgcttctgttaatgatttaattaacaacaggaagtacatggaatggaataaaattgtaaatagtatctctgacatagtcatatacttcatccttttagaaaaatcacaacataaagacagtatacatggaaacattttatttattgtagggtatagcatttttttccttgttaaatctaaattctaagtccagtcataatcttacatttatctagtgcctgtcaaaggatctgatcttaatgtggtcctcatcaccaaccccaataggacaagaggtcttttatcagcaggaaaacatcattgacccgcttcaggttaactgaaggactctggaccagattttttaggtctgagctaatgtaatatgataaacaagaaataattgatttaactatatagcatgtgacaaaaatctaaattttagaactcttagtgggctagggatattattttgcttcagttagattttttaaaatttggcaaattgaactgatatctagttttttaaggcctggtctcagcatttttaatgactttttttcacgctatggggctttctttcatggatcagttttctgaactaatctagttgaattgagtttgtgagggaatgaacagaaacaactatcttcacaatcctattctttacaaaggttcgaaggactttagagaaatcaaaaggaaccacaggtaaatgtgtaggctgtaaaaagaaacacaaaaggtaactggtcaaatgccactttgggagggataaaaggaaggttaaagagcaactaagggctatttttttctattgagaaatcagaaaaccctgttagtgatggagtcctcagccaatgttctgttctgtgcagcctcacctgcagccctgtctctgtgatttcaaagcctacttcctactttctcagtatgtatctatgttttgtagctgatgcctggtattccataagaagtgagactttgctgtatctttgaccttcatgcaattaagttaaacctactgtgcataatgaattatatgagagacaggacaaggtgctaccatagctgataggaaactgtagaaacatcatttcatgccatgcatggagaacttgagggttatgaaaagactacatttatagacatttaagttaaaagagtctcttttcaatttagtcgtctttctctacgtaggtcaaatgttttggtagagtgttccatttcagcacactgcatgctgtattggattttgtgagtgttttctgctctgtgtgttccctcatactgagggcggtaaaaagcaagggactccagtgtatttgctgtgcacctctccaagctagcccagggcctgtgcaaagtgaatgtgggtagaggaaggagtggtaaggcgagtcttcaaagttgatatgccacagatgggattcagtgcagcattgcttactcttgtcactttgtgcaaagggaaaagtctgtgaactggctgtgtggtagattgtgaattcatctcaattgttttatatcgatacgtccctggagaaaatagatgtctgtgagtgagccctagacttcatgtctaaatttaatcgtgggtaagtctatgccctggtttttcctgtccctagaatccatcttataacaacttagttcctgctttagagatgtagtactttctgcttcatagctgggggagctccttagcaggctctttttttttgagacggagttttgctcttgtcgcctaggctggagtgcaatggtgcactcttggctcaccgcaacctccgcctcccaggttgaagcaattctctgcctcagcctcctgagtagctgggattacaggcgtgcaccaccacgcccagctaattttgtatttttagcagagatggggtttctccatgttggtcaggctggtctcgaactcctgacctcaggtgatccctgcctcggcctccaaaagtgctgggattacaagtgtgagccgccccgcccggcctcttggcagactcttgaaagccccaggggaagtcctgtggatttgacagcatctaagaggggggggtgggactcactcaattgaaagtctcaaaaagctgctccttttagtgatagcaacaaggagtgtcttgttctatcctctggagtccctgtgaggggtggccatgtctaagagatgctattagcatccaggcagcatgccacagaagtgaaagatttcatctggacttctggaaactggctgtagggcaaagccactgctgatactggccactcagtgccagagacggtgtctgtgtacaggaagatctgcctcactggctccaagttgctctaaattgctccagaagacagcagtataggctatgtataatttgtttcagtatggcatagagagacacaaatggatcattttagatttctcttggtgagcaacacttctattcatgaggtattttgttttcgattggctttgtactttgcaaattccacttgagcctgtgtaaaaaatagatcttattcccaataaagacatcatagcaaagatacaagtgtttgcctgggaattattttacatgaagttgtgctttgcttatttcttacagaactattgtaaagccctttgtcctgtattagagagagagagagagagagaggttttaaaagcaagacaggagccttggcttctatataaattgtgcatattactacttgacacaccatcttgatcaaggcccagcctcatcttaatctttgaaaatgcctgtctttcaagataccacagtttccacccttcctgccttccatcattattttgtaaacacctgctgcgtaacaccacctctttgatttcagactgcctgggttaggtgcttaacataccagacttgctttgtcctctgaaaaaaatagaaataattttggtaatattttcttttcaagattgttgtaaaaattagattagatgatacttgcaattgtttagtaccatacctgacacataggtgcttcagaatattatttagaacaaggcccaattcctgccattctggagtttatagcctggtaagagaagcagatgagtcagtaaatgattgggctcaatatgtgatgagttatataattcattcattagcagacatatactgagcccctgttacgtgttgggcaatgttgtagagataatgcagtgaaccaaatggataagctgcctgcttttatgaggcttactgttgaccagcaatataatagaattgtgcagaggggtgccctagaaacaggattatcagactgggatggagatggaaggattggtttatgtatcagaggagcccccactggaggaagtgagccttgtgttttcagcattgagtggatatatgttgagcaaaagaagccaaatacaaaagcatacatactaaaggatttcatttgcaaaaagtacaaaagaagcatggtaatagaaattccatggtaatggaaaacaagagcagtcacctttggacagaggttattgattggaaagggtcagaatggaaatgcctggcgcatctgtgtcttggtaagtaaacacagagctgtacacgcttatgattaactcagtttatgttatgtatgttaagaaattttaatggcaataatgagtgggcttatctacgcaaaaacagggaaggaataggaaaggctggggcaagggtgctatgttccaatgcggtaagtcatcctctctgcctgggttggaaggatgcatatggggatgaaggtggggtgacagcgacaagcatctgtagattcaggctgctatgagagaagagtttttttccccaggtgttggtcatgaaggcattttttcttaagaatgtagagtggcacagtagaaactgactttggtttgaattgcttgcctctgaacttctgtctgatcttagcatccttcagatgggcttttgagaggattacatggaatagtggatgttgagtgcagtgtctgacatgtagcatgtgtttaataaatacataagagagttaaaagtatgtgtgtggcggggcagtatttaattaattgtaattttaatacttggtgctcaaaataaaaaaccagggtgactgcattatgtagagaagtgcttgcttatctgaaacttttgatcctttagttgaataattatttttatgtaattatagcttaatattatattaaaagtattggtcatttttcctgtgctcattaaaccattttaagcatttgggaacagtgtaaaagtggccaaagaatttctatttcagtaagactcatatttggcaaaattagttgtatgagggatgagacaactaaatatgtcaagtttctcaagtttacggaaaggtttgagtgtgtgggaagggaagtggggaggaagcagagaaattagtaggatttttaaaaaatgaaacttaactgcttttgaaatgttaaacatcaaattatgggtatgctaaataccttttggagttataatgtgttcgtgtaatcagctccttattaacttttaaactgtcatatgggaagttccttttaatcaataatgagccaagttcattcagactcttttgacaatgatgactagtctcctgcttattttagactttccagcttatcacttttaaactactctcaccctgttttaccatacctctctagagaatctcttgttttctgggagtgcctttgcattggctgcctagaaaacactccattctgtgtttttacaccttgagtctctcagttggatctgccctctgttttaggagcgagcgagcccgctggataactgccctgggacacagcagcgggaagccgcctgcagaccgaacctgtaagttctctcaaggggaagcccacttgggaacatggatgggctctgccccctgctggacgccgggttactaacgagttatattgccacaatacttgcctaagtttcctccagggcttccttctgctttacaccaaaaatgtatgatccttgctttggaagtcagggggtctgaattcaaatccaaggtgcatttctttgttgtgtaaacgtgtcaaatcattgcttagcattgcagagcctatttaaccatctgcaagtcagttacaccattatatacaacatggggttattgtgaagattaagttaaataatctatgttaaaagccctacttgaactgtaaagcccttaaatttttagctattatcagtgggcaacagttgatcatgtttaaaccttctacatactgacagtctggatttaagctgaaaagtatttttaatctaaaagaaaattacctaagaattctttttgaccttctaagaaagtgtgtttcactattctagagaattagaaactggcgcagtgaaggggggtgttgtatgcctattagcttcctaactttgatgctgtggtttcttagattattacagttgcaaggtcaaatccaaagaattagaacaaaacattgttatcctggaacactcaaaaattatagctttaagcttagattaaaagccaaaatgactggtttgaaagttcccggaaatcaagctttgtattaaaaagcaaattaagaagtcacatgtcagcattttgtttgtttgttttgagatggagtctcgctctggtgctatctcagctcactgcaagctccgtctcctgggttcataccattctcctgcctcagcctcccaagtagctgagactacaggcgcccgccaccatgcccagctaattttttgtatttttagtagagacggggtttcaccgtgttagccaggatggtcccaatctcctgacctcgtgatccgcctgcctcggcctcccaaagtgctgggattacaggcgtgagccaccgtgcccggccacatgtcagcatttctgaggaggtctaacatgacttctcagcttttggttggagctcattttatttctaaacttttttttggaaactttcatgtgctgctgttgggatggggagacactctgatgagagccaggagaactgtgtctgttgcagattttgcatggccttggcacatcagcaactctttcatgtctcagtttccctaatgcagagtggctgttttctgttccattgtgtgacatgactaatgactcctgatcaacctgttattgaggggaatcatgcatcataaaaggcctctcaaatctgagcttctaaaattctaaagcttatagccaagcaagggagttgctagaaaagatgttctgctttttattagaagcccaacttgtttctctcaatgctggccctgaattgcagagaaaaataagtaagtgtacattattggattgcacatgttttttctctgctactggaaacttagtatgtcctcttttggcctcagcactgacccaggtggaaatcgttaggtcatttactgctaagcagccagatgaactctccctgcaggtggctgacgtcgtcctcatctatcaacgtgtcagcgatggtgagtgggagcgttcttatgggacactcgtggtccaggatgcagagtgctatagacccgaggagtgtcattttgtcatcattgcccatattccaaatcttgacatgttaatgtttgagatcacatatatgtactgtcttctcatctctaaggctaaaccatgacgttttcttttttccccagtccctcagtgacccagttcttatctctaaatattcgtcctttcaaaaatagcattcttcctgctatcctttacccaaagcatctcctttcccagctcagcccaggttcaaatactctcagccttctcacttcagggcctctgctcacgttctttccctgccatgtcattcattccccctcgaaagctttccctgtcccactttctcttctcaccgtagcacttagcctggggagggatgctgcctctcagctttttcatatccttggagcctggcacactccaaatacttgttgtttggtgtggactctgttctttttcacaggctggtatgagggggaacgactacgagatggagaaagaggctggtttcctatggaatgtgccaaggagataacatgtcaagctacaattgataagaatgtggagagaatgggacgcttgctaggactggagaccaacgtgtagtctctcagatggtcttttgttactgcaagatttgcacgacacttaccgggctggttggttctgggctagttttattgttaattttgtcacagcctatttaattaaaagaacgaaaacacttgcctttaagcttgccaggttgttctgctctctcatgagaagagcttggatacagtgagtttgcacagctcagtttttacctaaccacacacttgcagacctcctgaggtacacagaatagctgagcagttcacttcagggatcaggtcatctctgctcctcctagtttcaccatgttctggcaataaaaaacacatattatatcctggttttctctatccttgcattactaaggtgactgtctctctttatacatccttgtatggttctcccagtattagcaagattgtatatctgtaaagaatgtccagttttgtaaatatttccctgcctttttttttctttttttacatctgattttaatgcttcgttaacttcaaaaggaactggtagagttcagaaggtgagctgttgtttttctaaacctcttcccaggaaggggacattgacacttgaatttttgtcacctttttcctcattagaaggaaagtagaaagccttactttaggatttttaaaaaaaaatccatctcaccccatattgttcttaaataagtatagactaattaacctaagctacctttaacaacgtagaatttagatgggttcatatatgtgagaaaaacctgaatataggacaggggtcctacttttttccccacctctgtcgcccaggctagagtatagtggtgtgatcttggcccactgcaacctctgcttcctaggttcaagtgattctcctgcctcagcctcccaagtagctgggattgtaagagtatgccaccacgcccagctactttttgtatttttagtagagacagggtttcatcatgttggccaggatggtctcttaactcctgccctcaagtgatccaccagagaggagatcctcggcctccccaagtgctgggattataggcatgagccaccgtgcccagcctactttctaattaattaaaaaaaaaaaaaaaaaaaaaaaaaaaccttcccaaatgagctgataaaaaactgacgtgaggctgctttgccttcaataatacctagttttcagctgttccaactcgtttccaaatagaaattagctggaacacactacagtaatctcaaggaagggaaaattaggccttaaaagataccaagaagtcagcatggtacccaattgaaaccttttgaccttagtgggaattcattctatttgcactaaaagccttaacttgctgtattcagagtccctcttaactgtgagtttctatagaactttactttttccactagtgcacagagagagaaaggttatcttaatagtcggtttcatggagatgaaggatgggagattaagaggggggaaatgatttttactggcagctatattccctctctgttctatttgctttaacaaagggataaaacctggcaaagtgtacattattggaggactcaaatctgtatgtgacatgtcccaactactgtccgctaactagttatccaaattgtaaagctacagaagcccagttgaggggtaagtgtgcctggctcacacagcctgcaccctgtcacctcggcaatgagccagtgtggggcactggggacttctaacccttggattgctctttttgacctgtgcataccttctaattgtaaaatatatttcagaccgtgagtaccttgagatctgagcaactgtgttaatgaagtaatagcaatggtccacagtgaaagatgtgttggggtttgcaaaacaagcattccgtcacctctttaataatgtcacagactttttaaaagagaggctatcaagttgtaatataatctgtcatgttttatttaggaaggaaggtaaatttgtgcttgcacggggatcattttgtattatttttgctaatacccagttgaagctaaaaagcaactatttgaatcctgtgaattaatttataagaatgttaaacagctttggaaatacatgcatcttatgaatcatagccttatttagcaagatcaatgttaaagtgttgttatatggcaagtatttaacacattcacagtgtttgtttgatttcaactgtgaattgtcttaagttttttcaaacctagttgtttctatggacacctgctctgaattgtacattgacttcattactaaagaacaaaaatgttcatttttgtcccagtaaattgagactgcttgtacactttcagaaaaatatgtgaatttataaagattttgtagatacttgt

SEQ ID NO: 1605 - DNA, 136473 bp, Homo sapiens; identical to SEQ ID NO: 1603

SEQ ID NO: 1606 - DNA, 365631 bp, Homo sapiens
cgcagccatgagcggcagcagcggcggagccgccgcccccgccgcgtcctccggccccgccgcggcggccagcgcggctggctcgggctgcgggggcggtgccggcgagggggcagaggaggcggccaaggacctggccgacatcgcggccttcttccgatccggtgagtgcaactgcggccggcccgcccagcggcgctgccccaagcgctcggccgacccgccgcggagctgccgagctccggccaccgcgcgctggtgcccgcccgtccgtccgtcggggcccgcaggctctcgcctgggaccactgcttccatgcgccggggctgcccgccccacatccgcgtgtcccgctgcccgcgcagccgggcgcgcggcagcttggcccgaatgccaccacctcgccctccctgcgcccgcccctcgttttagggcagaatcccccggtctgccgctcccggcagccgcggcttcgcgggttggggcgccggctctttgtctctttcgctggaggaccgaggaggcggcggcggagatggcgtgggcggaggctcttaccccggaggccgagcggactgagccggggccggtccgggacgggaaattggtctttgatctgtgcctgtctctggctgatttgtacctggaccctcctcgaccccattagcagccgggtttctttgcttggccctctagcctgtcatctccccggccttggtctacacttctgtgaaacggggcagtcacggcactcactgcccagggagtggggacggtggccgagctgaagctcggaggaccgggaggcgcggtgagccattgtctccggggacgacccgggagggtcagctgggaacgtggccccgggggggcggcgcggggctggggctcgcggggcactgtgtgggtggcgtggaggtggaggcggtgccaggtggccccgagtccaccccggcgcagagggggtggccgcgggagaggcgcgggtggcgaccggtccgcgggaggggcaccgggtttgctgcgcagggggcgtgacagggcgtccccggtaccccagcggcggcgcctcctcccgctccggcccagatcccgcgcgagccgggcccgcgtccccgcgtcccgcgtccccgcgcccagtccggtctgctcgcgcgtcggctgagcagcagcaggaggaggaggaggcggcggcggcggcggcggcctcggggccggcacccagagcgcagtccttagcgggccgggcacggggcagggaggatgcagactccgggttggagagcggaggagggcgggccaggtccgggcctggagaggcgggcgggggtgctggtggcggcctcggggaggacggccgggctggggacaccgacaggccgggggagcggccctgcgctgggggacgcgcgggaggtcggcggttcacgcttttccgtggcctctttgaaaatcacctccccagattcggtgagatcagttccccaatccgggtcacgaggagcaattgcagcgggagggcgatggtgagaggcagaagttagcagtgctggtagatacctggtttagtactgtcttctcttggttgtcttgatctttgctaggcggggttatttttgattcattttagcagattggttgtggctgggagtgacacagccgactgtccagtgttagcttggggttaatctactccccagtgctcactctccttgagaagtgcctgcagaaagcaaaggtttaggaaaacatgagctccttctaaagaaagctacccccccccacctttttttttttggtgcgactggccagatagagcagccccgtcttacctcttaatagcagaactgggacgtattcccttcatgccctgaagctaagtctagctttctctctacctacctgtcacagaataatagattctgtgcagaattcagctcctctctgttagaaaggctcttctgcgttggagatggattttttggtgtttgtgagaccaggcttttttacatctctattatgcatagtacaaaaatcacttctgctgctgctaagagccctccctaaaagacaccgaagatttgctgcctgttggcgtggctctctccaggagttgtcgtctgctcttggctttgcttaggcctgtgctgcccccgccgccagggctcctgttcatgttccgtttgggtcagaaccaggtaatgtctcactggcttgttcctttcttctgccctccaaaatgacaaacttaactttttagttgtttcacttagaatcaggagccagggcagaacttaagtaggtatcagatgcagcatcccattccagcgatagcctggaacgtctttttaaaagtgaaatctcctttgggcagctctgagtccctgacctagatcttggctctagcatctaggccaacgatgtctagcagggggcagagaggggtcattctgttggatgggtgggtgtgggggtggggtttgaacagtcagggctgaccgggcaaggaagctgaggagaatggagcagtcaaatccatcagaaatctggctttcttttctaagactcagaaacatgggaaaataggttctcattgactggggaggacagatcatggtgtgtttttgagcctggtactaaaagtgccaacctgacttagacaaaggctttccattgcttgcctttcctttctcagccctgaaactctgtttgcatggctgcctgattttctttcttttttttaaattcgttcttgttgcccgcattcggctttgtctttgtagccacagattgaaaactaataccagtggttggatgaaagaaagagaagactttaatagaacttttaaacaattaagggaagttcagaaatagagtgaacagtcctgtgatttctccattactggaagtgctcacataaaggtgctgtcacctggcagggtttggagttgggctcaggggacaggactgctgccctggagaggggtccgggagatgaccttggggctgttcccctttccctgtggactctggctttctctgagtcctcagtgcctaatcattgttctccgcttttctttgggtagttcagggctccagagccctggtgcccttctcctctgctgagcgtccacccagggttcacctcacccaaggtctcatttcctttgctgtcattccgttctctgctcaggaccttggcactccctgttcattttgatgatcattttgatcacctatttatagacctggcatgaagcaggcaggccaattagtgttcaagtggattgagttgtaataatgtgagtcaagtcctggtgcttgtgtgttaaagagcagtaagagattttctgcaggtgttagtgaatttcaaacttcacttttctcctttgcacagagctcagcacagtaaaaccaatttcaatgcaagagcaaaaagaaaaaaaaagacaccacaaaaatgagctagccttgttttaattttattttacagatgaggaatcagccttagggaggtttcatgacttgccccccagagtggaacttgggtagagttagagtcagggccctggtccctggtgctctttcctggtcgcttctcatagccaggacgttgcttacattagttctcaaccccactgggaccaatcatttttattgccaatctattttggggctctgttctcgtggcaataaatcattctttcagagctccctatttaaccttgtgagagcgtgtgtgtgtggtggaggtgcttacataaatgcagtatttttaacctgcctggcacgctttaggttggcgttaaatgaatatctggagaataaaggtttgtagttattctgaagcatcacgtcctgtcgtgcttggtttctttcattattaaatcttactcgactcctcctgcagcccctgtctttccagggaacaggtgaagaaaatcaagtctattagggagaagcacacatacttttatatattttgatatgacggtttccttgtggagtattgagagaagcttttcttcatatttataccttgaatgccacttaggtagttggcctggggcgggctgtgctacttctgttggtattgagaagcctggcagctttggtccttgtgagcaccaataatgattgtattacaaagtgggtccttgttaccctcaatatttcaaaaatagaaactgaaggaaatgtaatttgatagtgaatgttggtttctcctttttaggtggcacagtcagttttagaggaaagcaaggagatttctaaaattcctgtaagtgactttcgaggaatcaaagaagtgcagtaaagtcatcactgaaagaagcttttcattgagaccttgtaaaccgacatattgatgtgggatattgtattttttccctttgcaatttaactatttaagattcaaatgaaaatttaaagaagccatttccaccatttaaatgattaaccagatttaaatgaagccggtggtggtgttcaaaatgaagcatgtggtttacatatgtttcctaaatgtaccctaaaaatatgtaatttcagtggccttttttgaccttttaaatgttacgataaagttgagatttgttctgaactgcaggtgaaagatgtgtttgaagctgtcataatctaagtcagctgtattcaatatttactttgtttatttacttgactatcgagaaaataaaattttatctcataaccttggcagaattccagagaaaagtctaattcttaatcaatagccacactttactgcctagtaaactcactgatattgatagggatgagctgtgttttactacaaaaagcagtgataacaccctgcccccattcctcctcaattctataatgaattggcttttatttccttaagtgcattgtcttgacaaaattttaacagcgccactggcaggaaatagtagcgactccctggacagtgaagacttggatttgcgggagaatcccagtgtattctggtggaaagtgcgtgctctgacctcatcctcccatttcttccaagtactcagctgcgtagacttggccaaactgacaagggtgatggtgtggttggcctggtggatggagatgctgtcttttgaatcttctcagcctcattttaattaatgggctgcagggaccaggctgggtccccagctggagcaaggggtaagcgggttcgatgtgcatccacagggttctcttcgtcctattccagttctgctgacgcgctgttcagtgggccactgggagagggaatgaacagggagacttcccagtgacccttgcacttgggaattctggctgctgttactcagcgggagctgttctgggaattcctattgctgtgcctctgaactgaggggaagggagcatagaggagtggtcagaggcttgcggggccctgcatgtgctgctggcttcctgctggacccctggtctcctccccctgtgcccgcagaacaggacttcgctctcactgccaaggtgcccagctccctgctagttcgtaaatctcaaagagagatacctggctagattgtccagtgaggactcccagctttttgatgttactgagccttctgtgcagacagtcttgcttttggggaatcttgctctcatgtttaatggttaacaagtgcataaacactcattttcgcttctcattcactcatggaaacacttaatttgcttactgaatagttgtgttgttaccttaatttcctcttttctgtcccctctccacataaggaagccccttgaaacccaaattactaatcacctgccccccgggaaaggttgtatgtggggaaagagagagcaaaccagagtgaggctacgagcggggggcagagggcattgacctctgagatttctccctgtgccatttgatggcagaggggctgtggaaatgtaaaacctcgttttggtgatgaacatacttgagttttagattactggctcttttcattagccacatgtctactcttgtctgatgggggaggattgtagagtagtctagagctggtgttttggaggcatcttcctatttgggctttgtcatcaatgagtgcattttagcagttacactgacagagaaagctttcatgaaaacttactcaacacaaagactggattctaggtctagggtactttgactttgtggtgtccacgtgagttgatcaggcttgttttctcacagtctgtagccctgctatggacagggatgaattgcaggaggtttttcttggggagggatttcagtgagtggcagcagatttgtcctggccgctctgtggacccctttcctgaaaggagggggagctggtgctgctccattactggcttactgcagggaaggccaaggggccccttgctgtctgtctgttgttgttagcattgaaactgtgtaggtgtgaatagatcacaaactatagtacagccattccattaatgttgagtgagagaagacagtctcaaaatgctgcatgctgtatgagttcctttatatgacactggcaaaaagacagaaccgtagtgacagaaaacagatgggcattgattgccaggagttagggggtgggggagtatggctacaagggggcaggaggcaggtgaaggatggggaactgatttgtattctggttgtggcagttacatgtgttaaaattcacagacctttacacacatgcacacaacacacacacaccgtttaactgtatatgttattttaaaatgtgacattaaaaaaaggccaataataaactgggagaaaaactattacaaatcaaaggattatatatatgtaattagtaaagggctccctcaaatcaattaagacaagacatatctagaaagaaaataggcaaacaattaaaagaagtatgaatggccaaaaaatacatattcagcctcactcataatcgaggaaatgcagatagaaccaatgataccaacaaaagccaaagctcatataagtaattattctctaagtaaacttgaacaaaattgagttaatttggaaagattttatatcgatttgaaagatagtaatacttgtgttcatactttgctatgtaggacctagcttcttataattgcccgggggtgatctagggtaatggtaaagatagatagggggaaataaagattctttcctgggattctgtaatacgtgttaatttggaaatccatctggtgtataagtcaaatctgacttacaataatctttagctatagacagttaccatttttgctgcttcaaaatttcccactcccatgatttgtgctgctgtccagatcgaagatgacaagtggcccatgcaggatgatcttcagcgcctcacagttcctggtgcgaaagaagaagtttagtttcatctggagggcttcgttcctacatgagtaactataggaggtcatttgccctctgttcttaggcattcttgtatataattgacagctacctatttcacggtattgacaattaataaatggatttatgaagtgttagccccacctacttttaagactcataaccataaaactatgcatgaacttgagaaaaacacagttcaaatttacacgtataatcctaaaatatttttaaatggggtttgttggtgcctgttttttcattgtgtgtgtgtgtgtgtttgtgtgtgtgtgtgtgtgtgtgtatgtatgtatgtaggtatatctcttggaaagtcataaaatacccctctttggatttctgtggaataggtggtttcagtgcaagaatgaatgaatatatcggagactaatacttgaaatctattttcaaagaactcgtgtttcctagtatatatgaagtgacatgtataaatgacatgaatgctttcaggcaaaatgtttagattgtgatttgaaaatgatgtgcatatgagaagtcgttaagatgttggccaaaacagtgtgtgtataaattgatctccattgtttattcattttgctttgcttcctcttgcattgacccatccactttttcaagttcacaatgattcttttttgctgctgccattgaaggatgccactgatacctgtgagagggcactctttggcatttgcattctgaaagttttgcattttcttatttgtgtttactttttaagttcatccttgttctgcatgacagatatgccagggcctgcaggaatagcattaaaattctgttgttttttagataactttattagtttaagttttaaatgataaggaccgagagctacaattcctctgttttttattctgaagctgaaccacacaaatattgaaaaacaatgctttgactggagtgttatatatatttccacctaactagcttcacacaataaaatctctaaagtttaaattgcccaatattttgacatctaaataactggaataaatccctcattagtctaatagtaaacaaatagatttctcatttgtaggtggctttttaaaaaatttaagttcatgattatgagaaattcttcccagcgttcactgcccttttcagtaccagagtgatgaaagctggcatgcaagggaacattactagctcgaaaagcaaaacaaaacaaaacaaacccagatcgcatgggggcaggatgtatttcagtttttttgtttgtttgtttgtttgtttgttttgagatggagtctcgctctgtcacccaggctggagtgcaatggcgcaatcttggctcactgcaacctctgcctcccgggttcaagcagttctctgccttagcctcccaagtagctgggattacaggcgcccgccaccatgcccagctaatttttttgtatttctagtagagacggggtttcaccatcttggccaggctggtcttgaactcctgacctcgtgatccacccatcttgggctcccaaagtgctgggattacaggcgtgagccactgcgtccgtatttcacgctttttaagagtcacttcacctccatctaaattttgttgcacttaccctaatatgtcttgggtccaggagcctggagaacgggtgctaatttgatggtttcaggctgtaccttttactcacgtgccaattcagatcagtgcatcctgatgggttgcccataggagagcagctcttcatggcaggggcttcactgtagagtcatttagtgccagaatgttgttagtaggtaaattttgttagttggttggtatacatattacttttccaatatttaattgcagaatttgcaggattcattgttaggcctttctctcatacctcatgggtattgtttattagggccagcctcaactctgctggagtctgaattctcataaggttcagcctgtttgtaagacggaagctgtccactgaaccaaagagctggaagccttcgaaaggcatgcaagattgaggtggaatcacacagattttcggtgataacctgcagagtggacgatggaggctttggaaagtaggatggcagccttgcaacagcctgcccctggccatgcttgccacacccttgctatcctctaaatctttaacagcagctgccagggagcagcaagagaggccaggacccctgtcacgtgggatgagatagcacctttggaattgtgctccataggaaagtagaataagcacatctgcaaagtagtaacctgcttgcaatgtcataggatgagatttaagatactgtgtttatttctttttctcccaaagctgtaagtcccatcctgttctctaagaaaacctggtaaaatcttcctcttcactgttatctctgtattgccaccactggttttaccatccaagggcctgtactttgccaggcactgtgcagagtgttttatatacttttccttggatagaagcagctccccctccttcagcaggtggatgccattcctgggttgtggatgaggatgtctgcttctggtagggcaagcgacctgcttgccccatttgactctgtttgtgagggcctgaattggaatttaagcccagggctggcagattacaaagccccctccatgccccttccctctcatggaaggagagagtaggcatgacccctcctctatacagcatcccacagcctcctggattttcattttaaaatcctgagaattgaatttgtgtatactcgtgtgttaaggatcaaagctataatttacaagtctcacaccaaataaaacttgagtgaaagattccaggctatagcaagtatttttctcatgttggtttgggccctgtaatttagtttctgtgcctttcctcttctcacctaattaatactgatgttaccttttacgtaaataaccctagcagtcccagctttccggtggaggcatgttggctctgttgagttttacaggctcccccggctcacagtctggggagaaatcctgattgaaatcttggccctctgttttcttggctgtctggacttggactcaagtgttggataggaaatctctggctgttaatgtgggggttgggagtacgggaagggcggggagaggctggccagggagggaggtttcccagcccttgctgtgtgtgacacattagaacactaccagggcttcctttctaacttaggaaaggaacggggccggggagtgagaggggcaggagggcaccacggagctgcctttttggggttggttttataaaatggttgtggtcactcctggttttgctatatatagctgtttcgttgtagccactcatttttttgctgtttttcatcaaaatgtgcacgtagatgatatttagttgggggaagcagggtcatttccttcccactgtctcaggcacgtgtcctaggctgttctgtgtgtgggttgcgttctcatcagccatacctcatgtggtcccctcacagtcaatggcatgattttatgggatgcttgctcaggtttatgcccacataaaacttctgagctgttgttttcgagcatcatttccacactgggaatatgctctgtttttctgtgtgactccacgtttactttggagttttaatatttcagtcaggatgattgaaatgctggtctcttgaaggcagacactgtataatcagaaggtagattgtgctctaaacatttaccagtcacttcctcctagtttgccctaggagtttctaaaactttcaagcttttacatttttatgtaattctttccgtttgaagatttctaggattaaaaggattggcctttaagaccctgggttgcttttgacctgctattgtagtatatcttttattttaaactaataaaggtgatacaaagctcaggtccgaattaacttagttgaattgtgattttgctgtgtagtttttggtcatttagttggtccatgtattaattgtggattacatctaaagttatttcggggtgggggtaaacttactttgagaaggcagaactcatcatgctcaaagaagcaagaacagcttcagatccccagttgtaagtatttcaccacttctgctttgtcttcctctgcttctctttctggatatagctaatttacatgttatcttgtttctgaaccatttgagagtaggttacaaatatgatgatgtcccttacctctaaatggttcagtgcatattttctaagagtgaggacatgctcttacatagtgatcataatcaggaaattagttttgatatgatatcatgatctaaatcactaactttaacacctttttaccaattgtctcaggattgtcctttttggcagttaaaaaaattatggtccaggatctcactcaggaccatgttacatttagtttgtcgtatctcttcagtttccttgaatttggaacatctcctcagcctgtctcccttgttaccctgatagttttgacgattacatggtggttattttaaagactacctcccagtttgggttgcctgattctcatgactaaattcaggctgtgcatttttggcagaagggctgcatcctttttggagcatcgtgtctgggaacatgtgatatccactgtcccactgtggtgatgagcactttgatcacttggttcaggtgatgacttgcaggtctctccaccctatttgtccctttgtcattagttagcattttgtggggagataatttgaggctgttcctctcccttctttcatttgctagttgtagcatccattgatgatcttcacctgaatcagttattaatatgatggttgcgaaatgttgattttttttctaactttgtaattccttttgtatttagttgactttgtactataaggaagagctttccttatcttccacttatttatttatataagtatggcctcagaaattcctgttttatgcaatgagctatgatcttttgctgtcacttagtttgatgctgtaattatctaagatttggctagtgggagccccttcatcctggctcttttatcttttgtgacctgtctccatcatttttttggagcactttcttactttctggcacaataaactgttccaggtgcaccttgtgctttccttgccccagggctgggatcagccatttctccaaggagcccttggagaaatggttcattttagtagtgaatggtatttagaaacacgatctaggcactaagcgtgctcattgctacagagttgtccttgcttttagggcctctcagtagacagagctaagaagtgtatgcgtgtatgtgtgtgtatgtatgcatacacatagacattaattacacatatgcaaacgtgattgagatctctttctgcacctcttggtgataaaaaccatatgtttagactcagtgtgtccaattccaatacagtaccacagggtgcattttagtctttcctcttccgtatttgtaattcccttctctgacagtgaaaaacctggctccttttatcctccgtatctttacttattcactcaatcctagaatatgcagaaagtaatttgagaatgctaacccacaccacggtgataaatgaacctccacccccaagtttaaactgttcaaatcagcagttagtggtcagcttctgttcagctcagtgccttgtcagttagtcatccaaacaaaacagatgaagtaatgctctgcagttccccaggggcatgtttaagaaaagagctgccagactccatcaacagcttactttctggtgatgtcggagcacaaaattgaaaaatcaggagtcgccagagaagaaagggagattaatttcatacagtttataaaaaggacacctgttgtgggaaaaacagtttgtcatcttcatctcaatgtacaaattgccaaagagaagaaataaaaaggaaagtgttgagccagtgagaatgggtgtgtagaggaggatgggtcgagcggacctttctcagggatccagtacattctacaaggaggagaagaagctgagttcatgtgttggagtaagctgtgagtcatgacttgaaagactgttgcttactgcccttcattgactaaatatttcttcccagaaaccacctgcagtaaattcaaagcagctatgtttctgcctcagtgcgggatttctgggaactgagtttatgtgcagtcagtcccagaaatcatggaacggtgggtgagatcttaggatttcatttgctgttctgtatttttcttttctctctctctttctctctctctccccctccccgcctccctccctgtgtctccctctctctccctgtctccctctctctccctgtctccctctctctccctgtctccctctctctccctgtctccctctctctccctgtctccctctctctccctgtctccctctctctccctgtctctctctctctccctgtctctctctctctctccctgtctctctctttctctctttctttcgagacagggtcttgttcttgcccaggctggagtgcagtagtatgatctcggctcactgcagcctccatcttctgggctcaagtgatcctgcctcagtctcctaagtagctgagactttgagcatgtgccacgacacccagctaatttttgtatctttttttgtagagatggggtttcgccatgttgcccaggctggtcttgaactcctgggctcaagcgatccacctgcctcagtctcccaaaggcttgagattatacacaggagccactgcacccagcctgttctgtgtttttctacattaaatgatgacacggatattacgtcgctgacttggggagacagtctcagtttcatatattatgttctgtactgcccataaacatcctcatgcttgttagattgtgttctggaaaatttggcctctgtatttctagcaaccctttctatgatgacacattttagcaagaaaaaaaatcataatttgcttattaatattttaatggagaagggcttttgatattagaaaactgggaataggccgggcgctgtggctcacacctgtaatcccagcactttaggagcccgaagcatgcggatcacgaggtcaagagatcgagaccatcctggccaacgtggtgaaaccctgtctctactaaaaatatgaaaattagctgagcgtggtggtgcacgcctgtagtcccagctactggagaggctgaggcagaagaagcgcttgaacccgggaggcagagggtgcagtgaactgagatcacgccactgcactacagcctggcggcagagtgagactccgcctcaaaaaaaaaaaaaatctgggagtaaaaagtcatgactaggggtagtgagaatgactgctaataggtcaaacattctgaggaaagtttttgagctaatggagatgttttggaattagatagtgatgaggctggaaacggtgatttctgcctgtaatcccagcattttgggaggccaaggtgggagaatctcttgagcccagcagtttgagaccagcctgggcaacatagtgagattcagtatctaccaaaaatttaaaattcgctgggcttggtggcgtgcacctgtagtcccagctgttcaagaggctgaggtgggaggattgcttgagcctaggagtttgaggctgtagtgagccatgattgtgctactgcactctagcctgggcaacagagcgatgacacgctgtctcttaaataaataaataaaaataaagaacaaaaagtcatggctaaatgtgtgatacatttcagattttgaaatagcttcagttattgagtgtttactatgtataagccacttaattttcctaccccttacaaagtaggcagtgataacattatacctgaggaaatggaactcagagaggttttttaacttgccccagctcaggtggctatagggacaaggttaccacgcgcacagtgggttctgccgggggtggaatccgcctgtgctggtgtctcctactctgacgtgcgtctcttatggaggaatttgactcagttttttctactcccactccccctctccctttttttggtgttagaaaaagtgaaatcacctctatttgaaggaggggattgtggataagatttgaccaggtttcagttgtgatttgatggcatatttggaaattttgtggaaaaacctgggttaacttttcaggaaatcgcagtcaaaaaaaaaaaaaaagagagagagactttgcttccctgtagattgtttcagtcctggtggtgtcttttgagatagtgaagagcatagctgaaaaagtggaaactgatgatgctttagcttttattgttttttaaacattctgggaaagttgaagggagaggcaactttctgctatgcttctcctgaaagtgatattaacattaaaaatcggtgtcattgtttttctgctagtgtgagctttatattttttttctttttttttttttgagatggagtcttgctctgttgccaggctggagtgcagtggcacgacctcggctcactgcaacctccatctcctgagcgatactcctgcctcagcctcccgaatagctgggattacaggcatgcgccaccacacccagctcatttatttttgcatttttagtagagacagggttttaccatgtttgccaggatggtctccatctcttgacttcctgatctgcccgcctcggcctcccaaagtgctgggattacaggcgtgagccaccgcgtccggccgagctttatattcttgaatattggagtcacctctgctcaccagcatatagaccgagacatagagtatgttgttagactctaaaacagaaacggcattaatttgcataaaatcgcatatgctctgttgcaataattttcattgtgcctgttttagaattgagttgacacttcatacagagtattccaactcaattaaaaaagagacatcgcagaagaatttgtgtggctttgaaatttattttgggcacagtccctgaaagaaatgagcctctaaggacttttgttctttgtggtgttttgaaaccttctcgccagttatatacattaagaacacgtagagcaggttggggttggtctgctgggtagaatgcctgcaaagggaccagaggtctgtcagaacaagagtctcttagtgcagtgcctcccgccggggggtgaccttttcatgatgtttggactgtcatctttgtttcccagtttcaaatgcctagctcagaattatttagtgcttgaagtggttttcatcttcaaaggacgttatggacattatttaatatacatgacactgtgtaatgaatgagctgtttatcccttgagtaacgtcaacatgccaggtgccatacagctggagaagacaaaaataatactctgtccagtgggagctgatagtctaaagaggcaagatgattaggcagattctctcttttggcctcttttaaaaatgtgctggggaataatgtagaaattaaaattataaaagatgatcaactagctcaagtctacctaattgaaattgccctcaaggtggaaatgaaatttgagatgctcttaaaaagacatcatgtgttagctcccatttatcacacatttactggtacacgcctattttacttgtgttacaggtgaggaatttggtgaagaccagtgcagaattattctcagatctccttcccgactcgtccctttctcccactgaagctcctctttttgtttgcatggtctaggatggcactttgtaaccaaggccacatgtgatgcccaaacatacatttattattttttttgagatggagtcttgctctgtcgcccaggctggagtgcagcggtgtgattttgactcactctatcttctgcctcctgggttcaagcgattctcctgccttagtctccttgtaactgggattacaggcatgcgccaccacacccggctaatttttgtatttttgtagagatggggtttcaccatgttggccaggctggtcttgaactcctgacctccagtgatacaccttggcctcccaaagtgctgggattacaggtgtgagctaccatgcctggctcaaacacacatttcttagttgcagatcagtctgtcctttgtagctgggcagacctcctgggaaacttggacttcttgcccctgttggcctgtgtgtcttgtgctcttgtacctgtacctctttgtgtttgctgttccctcttcttcctggtttcccttcctaactcagctcaaacatcctttcctttggaaaactgcacttgaccatcctgtcccagcctcttgaggcccattggtgttggcatgacactttgtgagaactggattctggactggttcctttgggttataattgttccttcactcgtgagtttgagttgctgggacctctgaccccagcgccggcccagagcagtccccaggtagaagtgcagtagatggttgttgtgatttatgcctgtggttccttaactcagattttagcataattacctggaaagttttctttaaaaatacagaatccctagagattctgatttagtggttctagattaggcccctagaaatgtattttgaaaaaactctacttgtagtttgttttgagacagcgtctcaccctgtcacccaggctagagttcagtggtgtgattatggcttactgcagccttcaccttgtgggctcaggcgatccacccaccttagcctcctgagtagctgggattgcaggtgcataccactatgcctggctagttttttgtagaaatggggtcttgccatggaggccaggcaggtctcaacctcctggactccagccatctgcctgtcttggcctcctgaagtgctgggattccaggtgtgaaccgccatgcctggtctctactgggaatttagacgcacagctagggttaggaaccaccgagttatgccaaggcacagtattagttgtgggttatggaatcacggccaatttggagtaaggtgtaagtgcagtttgcagaatcattccattcacatatctggagagagtggagaaaatgaatgcagtccctttatgatgaggatgtgctccatgaaggagaagatcctggctcgtggaggagcttcctgctctgtgaacatactgaaggcacaattggcccttcaaactctcatttgaagtcactgtgttgccatagagatattgtgtagtgttgaaggagattagagaaatcatgtcgtaaattatcagaacagatggcttgtaatttaacactcttctagcccatattctttgtactgaccttgagaacattgaaggtatcagtttttactttgttcttttacctataaaaatggcagagttcatattgagtgagatctaaaatgggtattagatatgccacatacacagtgtggtatgtgaaagcattttaggagtggcttccttaactttgcttgtatattttcccctcagttccctggatatatagaataatgagcctgtcttccttattattttgatagcactggtcagggatcatttttatatcctggcttgatgataatcgtattcctttgcaagtgcagttctgtttgcaagtattatatgatcatgtagattcaggcagcataatcacttccaaggtgtttttatatgtcatcaaccacataaagggtattttctttttttttcttctcttttgagacagtgtctctctctcttgcccaggctggcatgcagtggcacgatcttggctcactgcagcctccacctcccaggttcaagtgattctcctgcctcagcctcctgagtagctgggagtacaggtgtgtaccaccatgcctggctaatttttattttttgtttgtttgtttttttgttttttaaattttactttaagttctgggatacatgtgcagaacgtgcaggtttgttacataggtatacacatgccgtggtggtttgttacacctatcaactcatcgtctaggttttaagccctgcatgcattaggtattagtccttatgccctccctccctttgccccccatccctggacaggccctggtccggtgtgtgatgttcccctccctgtgcccatatcttctcattgttcaactcttacttataagtgagaacatgtggtgtttggttttctgttcctgtgttagtttgccaagaatgatggcttcccacttcatccatgtccctgaaaaggaaatgaactcattcttttttatggctgcatagtattctatggtgtaaattttgtatttttagtagagacggggtttcaccatgttggccaggctggtctcgaaccacctgcctcagcttcttaaagtgctgggattataggtgtgagccaccaggcctggccaactaaagggtattttctaaaaggagacttctttgaaattttttctgtctctctattctagcctgggtctgatgtgtaagtcttaaaagattgtatccttcattaaggacaactattgcctcttgcagggagctgcatcctgattgggattctggcacattcacacatgcacattgttgtagatgaccagagtagatatgtacctaaaacatttcaaattaacaaaatcataatcctgtgagtgtaatttaaaaatctaataaagcttaccttatttttaaagtacttgtagttagacatatattaacacaactatttcatatggttttattctcacatgcttgaagtattcaggaatcttaaataggctcttcatacattttcatgagcctcatttcttatgtgtcatacagtaggaaattaagtaagttttccgatctccagataattcctgagttgctcttgtgtgaatgtgtgttttaactgaatccagacattcatagtagtgagcactttctttgactccttttttactagcctacactgcttatactaatgggggtttctgatgccactcagcagtgggacagagaggtcagttgtgagcctgaccctgttggatatagcaatttttacctcaggatgacacattcacgtgacttaaattctttgacacttctgtgtcaatgctagaaaattttttataaaagtgctaggtaattatatcagaaagcatctgaaaaacagtcttatcagaagggcttagagccattacaggagtgagggaaatagtgtggaaataagctataatttccttgatgagcatgtcatactacaagacaaggttggctcaacctcctggtaactgtcctgccccagaatgggctagctccagcttaaataaattggaatcagattacctgggtattgaattgcatggcttcaggagagggtgtttggttctgtaaagccacatgtcatggtagtgaggtgagactgatggtagtatttgttcaagaatccgattttcattgagggcacaaaggctctgttgtgccacgctcaggatcttgttttcctgagattgcttcaggcagatttaaacaatggcctctcaacgtactggatttaaagagtaagtagttctccatgatcttatttctcattagtagggaaatgtaaacttttacctttggtcaaaattttgctcctgtcacctgaccccctgatgtcattatgattgtcttttccttgcagtattgccttgtcagttactcttgccagagggatttcatcattggagtatctgcatgtctaagtccaattcagctctttacatataggccccatgccctaagtgttgctgtcattttgcctgtttagttactttacaaacactaatggcacgtaaggctcctgggaaccctgggtctggaacaggcacaggccacagaacagatggcccttgccaggtggtccttgggtgcacagtggctgtggagctgctgtctctcaacaaaggaaggaagggcactctcagggaaatcaaatggatcaaagccgtccccttacccgtgttgcccctttaagccttcccagtagctctacttttatttttattttatttcaacttttattttagatacaggggatatacgagcagatttgttatgtgagaatattgcttgatgctaaggtttggaatatggatcccgtcacccaggtagtgagcatagtacctgatgcgtagtttttaaaccgacaccctcaccctctggtagtccacagtgtctagtgttcctgtatttacgtccatgcatccttaatgttagctcccacttataagcgagaacatgcagtatttggttttctgttcctgtgttaattaagattatggcctccagttccatccgtgttcctgcaaaagacatgatttcattcttttttaatcaatgcgtagtattccatggtgtatatgtaccaccttttctttatccagtctaccattggcgggcacgtgggttgacttcatgtctttgctgttgtgaatagtgcagctgtatttttattttattcttcctgttgaccctctgtctgtctttctgaggctctgtgtctctgtggacccttcaaagggactttcctttgtttaggagagtgactcatcctgaggtcattctcaacctttccttgggaagggatgtagcccttcgcagacagagctgcatttgcccagaagtaagcattttcacaaaggcccctggatcccaggtgccctcctgcacagtgaactctaccggtggtgtcattcttagccttgtgggtctgggtttcccagcctccagaggtaggaacgccaaccatcctgggatggtaggtggccgctaggcccagatggactgcatccagacctgctgagtgaatgaatgcctttcttctgtaaatggactccttatcattctgttttagctcctctttttctcatttcttcctttctcctgcatttctcttgtttctcattcttctttgaccacttaagagtgacggtgtcactcatggccattgcccattgctaaactgtgctggaggcagttagagatgagtctgatttgtggggcaggaatttagggggatgctcccggtggagagtctgttggattctgcattagcacctcactacagacttcacctgggggtaagccgtgcctggggggcacccccttcttttctgccccaaggccctgggtctgagcctgtcttcttctgcatgtccccttcctgtctctcagtcgtcccgtcacttagtggggtctcttgacacttaattctcttactgcttgatcccaatcccctttaagcacagttttgtctgatttaaaatttgcattttatggtgatcttaatagatttggcttagcaaataagtgtgatgcttcttaatttcggggtaatttaatccctttttctaaattgtggtatattattccttaaaaattgttttggctcagttgccctggtgtcatgtgatttcttcttgacgttttcttttccgagctgcagttcatgttgaggttaactcctactcatccctctgccccgagtgctcagcacatagtcagtgcttagtaagtgttcaccaaaagcaagaacaagcgcttgctgcatccccaagtccagtggccagtttccctgtctcaggaggctggtgggacgtggtaactattgagccagcaaaactgggccagaggctgggccattttatggtgtaatgtcctctccagtagaaattcatgagaggggaaaaaggagaaagggagacggtagattcttacggatgaggtgtgcgtgtctgtggaatatgggcataggcagcagtggagaagggaggtctcagcaaaagcagctacccctgtttgttgggctgtgttcacttggcaagttgctgtggatctaactgctgttcactgttaataattagtcctcaagcgcccattcttgggcttatgtcttctgcacaattcctcagtctctagattgaccaggctccccgtggaccctaattaatattttctgaccgatcactgggtttgatcagtcaatggagggtgaagaagcatccattatcaggtttcctttgagatttaagatctagttgcctctggtgtttctattatgtgttaatgagttgatttctgtttcctaatgattaggctgtggaacagtaactctggggggaagatggcattggtaagatttgctaagttcttgggtatatttttacaggagtatgttccatgagcccgttaagaatgttccaggtcttgccctgtctccccatttccatacttcacttccatttttaggacttctccccagcgtcaaaactttatttacacgaacctgaaagcaggctgcagggctgtttgaaatcacacacgtcaatatgaggccaacccagtttttcataaataggtcagattgtttctataaagcaggattccaaaaacagtcttgttaaagaaaaagtattttaagaaaagatacccattgtttaaatcttaaccctattgcctagggcttgggataatactagtactagaaaatgctgatttctggggcctgccttggaagaactgagacttgccccagacatcatgaagagaaagcttgcaggccacatgtactaagatccggggataggtgtgagtcagaggctgggcaagggcctctaaggagctcttggtgcccttgaagaggagcatggttctgggtggatgcaccatgaagggctgttactggcagcattcactagtccccctgacccaccaccagtggaacaagtacccttgctttacctaaatactgaacattcatttcttacttagtagagattgacttaaatctcttttttttaaattgtgctttttaatctatatatcagaatcatctgataattgtgtgatactgaggaggtatttaagccatagcaaatcaggaagggaagaagctaagatggggtttacaagatagttcttcacatgtgtctgaaattagtactcttaagaatgttactaatttctggcaggatccctggaaaagtttctagaacaattggaagagaagccagaatagctgtgaaaaatggcggtgttcacaggtgtaaatactcacagcctcacactcaagtgtgtcatcctgaaatcagtgaaatgctctcactgatttcatggaccttatcatccgtgagaactggatatgccacgtgtttaattcatgactgagttttatgtgctgttcacacagcctaatgcaagacattcacttgaagaagtttaccctgaaatcccccaaatagggaggtcccacgtaggtgaactaaataggctctctacaagtacattactcatatttttaaaataggagattcccaagtggatctggctattggccaacagaatgagacttacacagcctgatataaatcggttcatttctccttgtactgtagttgattttcaggaggattgatgtgcaatttattgtttgtctgcagcagaatgacttgtatggctctgggtgctgttttctagtgctgtgtttgtggtgcatgtcttcttcctgtttcttctgattctgagttccgccctttttagctagcattcagttggtctggctttatttgacttctttgacttggtgagtgccatggtttgtgagttatactatcatttgtggtttaaacatttcagtttttgttactatatgtccatctatgtggccatcttctcattttaattaccaatacatgtttcagcttgctttttggaaaaagtgttgagatgcaaatgtgtctttggaagtgtcactgagaaacccaaggtctatctggcattccgctcctggcggcagaccgtagtctttgtccacgggttgggaagagagctgtgaaacagggaggccttgccgactgtcctacctgcaatctggactttgcacatggagcctctacttaggggattagttttttgactactgctgtttgatttttgctttttaattgggttatttgaggtgaatgcatggtttaggtttctcgttctttgtgttggacagaattaaagggaaatttgagacatcctggtctacttatgttcaactccgttatattcttttttaatgggcaataaaactgccttttttttttttttttacttttctcttttttagatggaaggttccccatttttatttttacatcacgttcttcctcatacagttttcttcaacagtaccaagagtcgtatttttaagaaagtgtctctaaattttctttgcttttgtaggactatgtcatttctgatgatcattaattggtatgcctaactctcccctttgacccaggtattactaatattgactgaaagatggaaaatttcaaagatggaaaatttggattactgctgtgtctttaccattgagtcccaggaaataacttgcccagtttcataaattcttagacgttggtttctcttgtgattgtcaagtctttggtgttctttactttattcacctggaccacttgagttgttattcatcgaacacacacgtgtgtgtgacatgaagtataacttgttcacccttactttgtgcagtggtggtaataaaattgttttaaacctcttaattatggtttttcatgttggattcactgtgagttcttaaaaaaaaggatcacccactgatggattcaaatctacctttggaaaattaaagtgataagcacttaatggcattttgggattagcttgagaatatctgtaagttgattgtacttgaaacatgcagttgtgttgtgaccatctgtagagtgatgtggtaattaggcaaagcattttagaaaggctttattactaaaaacaagtggtagctagttttcataggcaaaggagacagtcttttagaaaagtggtgttccaggtgatttaatggaaagccaatgaaattggggagagggagagggagagggaaaaggtgaaagaagttctgaagtcaggctgcttggcaggcaccgagggaattgactgatggagctcatctgtaatcctgggatgcgttttctgtgttttatccaaaccagcgatttttgttataacatgtttggaaagcctttttttcttttttggtaagtttcctactagacatataaaaaagacttataaagttctttgtgagagctttataatatagataatatctagcttttttctttcgtaattaaaaaattcaatggagagattatagtagtttgtatatactgtagttagaaaggtttggttttgtttaaaattgttgtacatttgcttttggtaatctttagttgcttgaaccctccacccttcagtttaacttttatttaaaacaatctttgattcttattcatgcattgaacattggctgagaacctgctatgtgctaaacagtcactaaaagtgaagcttctctctcttttttttttttttttttggagaagtcttgctttgtcgcctagcctggagtgcagtggtgcaatcttggctcactgcaacgtccacctcctgggttcaggtgattctcctgcctcagcctcccgagtagctgggattacaggcgtgctccaccatgcctggctaatttttgtactttagtcgagacggggtttcaccatgttggccagcgtggtctggaactcctgacttcagtgatcctctcgccttcgcttcccaaagtgctgggattacaggagtgaacctctgtgcctggctcgagatgtaatatattctcttgaaagataatattacatctagggaactatctttatcactttatttaactatttacattgaaaatactagaataaaatataagtacatatttgtttttaacttaatatacaatttcagtgttagatgaaatgaagatggaatattaacaatgtataagtaatgaaaaattactgaaacttgactctgttttagcattccaaatcttaaattatattccttgccctaaaataaaatatcatgaagatattttgggtgaacagttggaaattgttacaattctagagtattaaagataccaagaacattcagaggatccagccgaacctgacttgcccaagaaaataagtaaatcatttagtttgtcacttcagtttgcatgaccacaaagaactgtacacgcaatgagttattacattgttatagaagaaacaaaatattttataatagtttgccaaaaatatcatgccattatgagaaaaacctgttgactaagtcggcctttggtcacagtaaataatcactgcttttgaccaaaactgcaggaatgtaaatctacgtttttcagtgtttgaaagactttaaaattgcaccatataaggtaatgctggctaactaaactttataacatttgaatgtagaccataagctgatgagccggaggtcaaaattagatagctgtaaattatttgggctaatgaaggataaaggtagagtttagccaaacactgttcttatgtagtcttatcaccggtggaggtacagatggatatcacccacagaggtgtgggtaggttgcttcagaattaattttttaagaaactgttaagtaatagagtatctgaaactggactgtgtttaaggactacttagttgctgttgctgggtattattcagtcttaagcttcttcctggttataaaattaaaaagcaagaaagagacggcaggaaggagcggggtggggggatggtcggtggttagtagatatgtggacctagagtagccttttcagccagtttgggttgtgaaatactgctgagtgcttatgtggccaagttctgtagttatagaagattatgtatacacactcttttccattttgcaaaagtgagcaaagatatccttgtatgcaaggtgtcataatcccattcctcttatgttttgaaaagaattacatacacctgcagataagttgagtagtgcattgagcatctgaatacccttcccttcaattcactgttaactttttgccaatctgttctctctctttctatcttttatattcattaggacactaataagcactgcagcattactaagctgtgagttacttttgcttgaagtcagtgtcagttaggttttagaaagattgtgcatatttttgttttaatttgtcttgagggcagattttgggcttaaaaatacctctgtaactgaatagccaagcagtacttgcccctgagaagcaggaagtgcagcagatttagtagaaatgcttgaacaaatctagcgtcttggttgaaattgactaaagttccaaaataactaaacagtgtcacagagagtagtgacaggcagactcatctcagaagcagtggctcctgtcttctgagtgacagtcactttcaagtggcagtcagagtgttgaccaggcacacagaataaagccccttctgttgaagaactggcttaatggagtgggacaggttaacaacagttgattaaaccaaaacacaactctaaccaggcagaaacacatttggtcacaataacaggggggatgatatcaaaccggagtgttgtggctatgcagtgaagtgcggaattagaggtggagccttcgtggcatcactgaggtggaaggctttttcaagaccattggattcagttaaacaaatgagttgtagaatggggataagctgagggataagtaatcccatcctttacggaacatattttttggaggtggaactggatacagcaaattacagcatacagaataacataggtgctatcttgaggcaggtgtcatatccttgagcctgctgagggatcagagtggactctggaagagctggcctttgagtggggctgtgaaagatcagcggtggagcgaatagtcactcaagcctgcaacttagggtatagggaggaatggggtggcccacccaccagcccctctgatggcttctaaacatttgcaagcagcaaaatcttttccaaaaatgcttgtttcaggggaagttgatcactaggcatgggtaatatgagaaatgtgacggttggggtggtcagacctcttcctctaggaggtccaggagtataagttactgaacagccatctcagatgctcacattgtatgttcctttttttttttttttttttttttttggcgggagggaggatttatttttttgagacagaaacacaggctggagtgcagtggcgagatctaggctaattacaaccttcacctcccaggttcaagcaattctcctgcctcagcctcccgagtagctgggactgcaggcatgcaccaccatgtccggctaagtttttctattttcagtagagacgggctttcaccatgttggtcaggctcgtctccaactcctgacctcaggtgatccgcccgcctcagcttcccaaagtgctgggattacaggtgtgagtcaccgcgcctggcctggtaatgttcttaagtgttctgtgagccgctaataaaaatcaccttgtcttcatttacagaagcaataagcccactgttttttgttttgttttttgtttttcctaggaggctacaggcaatcaggaataattagataaggattgggggcaccgttcatttcagtaagagcagaatcgaagagctctacgcttaggacagattaagagactgacttcacccacttaggctgataatgtaattttggttttctatgtttgcttattgctaattaaaagcagtaacagtgatagaagagcacagaggtttgctttgttttccacatgtaaattagaagcgtctgtctctgtgactgttactctcctgtagtagtttgtataaatgtagagccacatgctgtctgtatgtcttggctgttctcttgaaatacccagtagtgctgcccaaatggccagcagtgagcaccagcggctgcaagtccatttatgcaaggctgttgtaggaaagtaagacagagaaatatgtctgctgacatgtgaggtcactaaagtatagattctttgtgtactgtttagagagatccacttgatagagctgctgatttatggagaaatgagcgctagttgccttccacccgtgtggctgtaaccttctgttgctgtggttgttaacagtccccatgttgagcaggagcatgcagagtttgccctacgctttcagagcctcacttagttaaggcacttttggttgctggagcaaaaaaggaaatttattttcagaataaagaatcctctgagctaacccgagggaaggtggtataaccccacctcaccccaagaggaactgctgcgagtgggaacaggcaagccccagcaaagctgctccaagtttgtttctgtttcctgtttctccctaggggtcggctttatgcccgcctgcctctctatctacccagtcaacttcctctcaccttcctagttcaagacaggattgatgagcaaccctgaaaagtttcacatttctgatggtcacgtgatgggtcaggccatctggtcagcagtcgtcagggtcgtatacaacacacacaaggctgcgggcctgaacccttgccccaagaagattctgccacagagtttatggccccagttaagaagatgttctttgatcactttttgtgacattccctccataggtagaggtcagatcgccaaataaataatagtatctagagtcagggattttagtctacagtcgagacctatgaattttggtaggaaataaatgaattatatctttattttcgtggatctcaataaaattcagtatttctttcaattgtgaatgtagttctagcagtatctgtgacttttcacctgtggatactgcagatatttttaatcgacattaattattacagatctctcaaaatgttgttcatgctcatcacttcaaaactgtagaagttactagaatgactgctattttcatttaatgtgtggtaaagatgcacatattactttaaaatcttttgatgatcattactattttttttagatataattggttttctggttaagtttctctatgcacttaaaaacagtgttctgagaagagcttcataagtttcaccagattgccactagttagaaatatactactcccccaaaattgctggttggaattgagattacagttttctctttatggctgtcaggatttaaatttttctttttttcttaaagttttgggatacatgtgcagaatgtgcaggtttgttacatagcacatatacatgtgcaggattcaaatgctttctaaaaggcgttttctaattcctttccagttttttccactccttacttagaacttctttgtccctttcaacaattcctacttcctttaatgttttaatatctagtaatagattccattttttgtttgctttttgctgcgtaaattatacattctttggagctaaagattctagattattatagtattgaaagttagagatatgtctagatacaaaactagatctgggaacataaccccagatggggaagcaccatatattttgcaagcttgtgtttctcaatgttagaaatgatgagactcagaataaagcttacttatatctacctgggcattttaaataaaactagttttatttaaaactagtcacattgaaaattacacaaatatttgggaaactcccctgtacaataatgtagcctatttctaacatagaatactatacatgcatttagtgagagctccgcaaaatctgtgcgagtcatgaaaatagacgggatacctagactgctaatgtcctgggttggggagatacaccttatgaaagaaaagttcacaaagtgtcatgttacagtaaaagtatttcctttgcatcaatactgatttgtgaagaatatctgaaggttaatgcatttgagaataccaaatatcaaccataattcttatttaaaaatacattgtatgctaattccttagaaaagccaggcagggtggcatatgtctgtaattccagcactttgggaagctgaggtgggacgatcacttgagtcgaggaggagttcaaggccagcctgggcaacaaagtgagacccaccctgtctctgttaaaaacaaattcagttcattctttctttaaagacagagtcaggctgggcttggtggctcacacctgtaatcccagcactttgggaagctgaggcgggcggatcacgaggtcaggagatcgagatcatcctggctaacacggtgaaaccccgtctctactaaaaataaaaaaattagccggacatggtggcgggcgcctgtagtcccagctactcaggaggccgaggcaggagaatggcgtgaacccgggaggcggagcttacagtgagccgagatcgcgccaccgcaccccagcctgggtgacacagcgagactctgtctcaaaaaaaaaacaacagagtcttgctctgttgcctaggctggaggcacagtcactgctcactgcagcctcgattttctgggctcaggcagtcctcctacctcagcctcccgagtacctgggattgcagccgtgtgccaccacacctgactaatttttgtatttttttgtagcggtggagtttcaccaaccaagttgccttggccggtcttgaactcctacccacttggcctcccaaagtgctgggattagaggcgggagccaccatgcccagcctcagttcattcttttaaagatgattttaaaatttagaaacatgaacttttcaaaagtaacattttttgcttactgttaagtaaatggaaagagccaaaacatttaatttttcttaagtcacaggcacttgaaaatctggttttaacttttctttatggccattaaatattttatgcacatattacagggttgataatattataatagattcattttagaaatgaaacacttgaccattacatttagtttttataagaatattcttaggtaagcacaaacaacctgttttcaaacactgtgtgtccagctttacatactgtaattgggttccatggactctgccctgaggtttgagcgcccagggcactcatgggttgacagtggtgagcatacagttatgccccaggagggcaggtgatttattctggaattcacttgagtgttgaaaacagattattatttatgttatatacgtgagaaaactcttacaagccaccacttttaagttttgcttttagtggcttatatttcacaagtttaaagggcacttttaaattttttttggtaatcaccgggatatgagcagatgttatgaaaatcttcttatggggattttcaaacatagaggtctttttagtgacatgcacttctggcacttgtgtgaatttcatgataattcttggtatctgactgctctgaaacgcaccatcctaggtttgtaccatccttgctggagctcctgttctggaacctgggtgtcttcaaggatagcccaggattcttgtacttttaagcctgctacctgtggtttatgatcagataggaaatttaagaacaacaacaacaaaaaaagctaacagggtagagagagaatattgccgggctgactggcttccatccctcgctgggtcccagagcccaggaccccttggagaggaagaaccactcctcctgtctcctgcccagaggtctcccacttctcatcagtccctgggcttgggtgcctaggagtttcccttctgcctgtcttgagggctgagtatatggactgcaggaaggaggggctgctttgcatcttcatgctaatgcaagactttctctggaattttcacaggcccattattaaacagaaaagcaaaatcggtcctcaccataccgtggcttggctctgtttctaatgcactgcaagtattttatcaacattgtctacttttttgttttacttgattattttatatttattcaccatttaatttaatattacagatactgtttgtcatgtgtttggcttttgtgtttgcttttaacaaatactcttgtattcatggttttccttgtttgtggagtaattcattttgccacttcttttaaccattcttccctaaaaatagtctgctagggcagagattccattcggcctttattactttggatttgccaaacaagcagcagaaacagagttgtacgtgtggtcctacaccacaaggatttttaagagaggtcatttgtaggtgatggttgttgacacaggaatgctgtcaattaaaaaaggggagaaaatgaataatattcaaatttactggcatagagatgtttgcacagattccatgtgagagacgtaggctgttaatcttgtgttctggccgcatgttaggaaccctcttatggtgtggataaaaagccttgtgcctgcctggtattagaaaggtgacaggtgttgctgtcaaatattgatgctttgatatcttcacatttcttgataagctgaccgcgtaattgtctaaacagagatggtgttgagagtgaaagagggtgttaccaataattattctagaacagtaggggtaaactgagactgtgtctgtcaagctaggatgtgtgatgactcgacctactgactgaccatagtttcataattcagtatgtagagggtgagagtcatgtgaagatatttatgactcccactggtcattttttgtggctcacccctaacttggataaaatgatgtttgactcagtccaggatacataaaggcatggacagttggccaaggagagtggtcacaggggtgctgctgagtcagcacctcctgtcagtggtggtctgtttgaaaacagacctacagcacatttgaagaagcctcctccccatagcctggagtggctgaatcgctcattttgtgtgtgagctaagtgtgacttgagccatgaatcaggatttgtcagcccccaggacctggcttgcgtcctacccttctttaccaagagctcagaagggggtctttgtactccccccacccccgcagaagccgggactggagggtggtgagaaagcctttgtcaccgccttcccatttggagtgagggaagagttttggtcatagtcccctgctgctcccggccagcacgtcggtgtcccgtcctgccacccaccccgctttggccccaccccccacctttgtgggtctggtgtctcagaatggagagagaaatcctgtttagcagttaggtaccctgtgacttctttaccatgtgctagactcaaacatacggtgaagttagaggaattgttttgtatttgttcttaattactctgtaatactacattacaattttaaaaccattttaaaataaaaatgtattcttttcacttgttctgccctcagaattcttcagtaatataaatatttaaataaatcaacaaagcttttttttttttttcttaaaatctggattttttttagggtctcactctgttgcccaatttggagcagtggcacaatcacggctcactgcagccttgagctccgctgaagtgatcctcctgcctcagccaggcatgcatcacgaagcccagctcagtttttgattttttttttttcttttggtagcagtgcagtttcactgttttgcccaggctgatctcgaactcctgggctcaagccatcctcccagcgtgctggaattataggcatgagccaccacacccagcctcaatctggaattttacacatattttaagttcatttgatttttgaacatgtattggctaaattaatgattaactgtctgggcatggtggctcaggtgtgtaatcccggcactctgggaggctgaggtgggtggatcacctgaggttgggagtttgagaccagcctggccaacatgaccagtagaaacctcgtctctactaaaaaaatacaaaatcattagctgggcgtggtggcacgcgcctataatcccagccactcgggaggctgaggctggagaatcgcttgaacccaggaggcggaggttgcagtgagctgagatcgcaccactgcactccagcttgggtgacagagcaggactcctgctcaaaaaaaaaaaaaaaaaaaaaaaaaaaagattaactgtaatatagatgtggtaaagcctatgcgttatattccctagttttctggcacaacctcttaaagttacctggatcaaaagctggttacatgctgatattttcagtctgtggcctgaatttccaaaccgatcattagatgttgcctggagcttcctattctcattggattaaaaaagattattttgaaggtaatgggacaaaagaagataactgactttacaactttttataaaactatgctgagacttagtattgtttgaaatgaaagctgttagtattcttaaataaataaggattgtttgccttctaaagaatataacctaaattgttcctttgtaagaatcacatttttaacttaaataaaaaaggcagaccatgttgttagaagtgtctgatctttgcatatgaaaatataggccagacacaatggctcatgcctgtcatcccagcaagttgagaggccgaggtgggaagatcgcttgaggccaggaatttgagactagtctgggcaacatagcaagatcctatctctacaaaaaaataaaaagctgggtgtggtggcacgcagttgcagtcctagctactcaggaggctgaggcaggaggatctcttgagcccaggagtttgaagctgcaatgagctctgatttcatcactgtacttcagcctgggtgacagagtgagtggtcccatgtccccccagtgcccccacaaaaaaaaaaaagaaatataggtaggtaggcagttttaattttcttttgaaatttatgatttgagttggcttattttctgtatatactaaaatatttaattttgtctagggaaatccttcagaaaaaagttaaggtataaagaacatgcaagaaaattgtgttcataaacattcacatttagaattttccttgtttccattatatggattataaaaaaataacaatggaatactacaatgtatttttttttgtttcattcttctattagctgtatttcttaggctcttacctttttgtaggacatacagctaacactgcagacttaaaaaaaaaagacatcttatttaagggatatagaatttctacaaataccgtattattcttggatgccttaaagtgtattagagaaccatgaaaaggaaatgtcctttcagatactggcctgcttgaaattttgttagtacttctctgaagtttttggtgtttgttgaaactaaaattgttgtgggctgcttcacccgagcccagacaaatctgtagaactagttatctgtcaccgtcatctgttgtttcctgcctggggggtccctggcactgtctgttagaacttcacagccattctgtggcctgcccaatctcagaatctgtgatggcctttgtgccagattgcagatggtcgtgggcaggcctgtgagtggatgtggagcgtttctggggggcgtagtctgtgagatggcacgtgggaccactcacacaggacctgtgtctacggttgcccccaggcagctgcactgcagaaatcctttgagggccatttcagtgtcctgaaaacgctggctgccccctgcttgacttagagaccaatgtcaggggtctgtaaaggtggattagaggattgaggccaagttcagagtcttgaatggatggcaggagaaagaagagaaagtctgaagaccacatggtggccacgcccctcccggcctgggctcttttgcatccccacttgccctcactattccttttctggtagtttctacactccgggctgatgtgggtctgaaattctaggtctgacctcatagaactctccagaatattcagtcctctgtttttaatctccttctccccatccccatcctccctgacttgtatttaagaaattaatattttgaatatgaacaccacttcccacatatcattgaatttcatgttattacttttggttcttcctgttcaaatctttgaagggcattttttttttttcttttcatccaacacagtaatgacgtctctgagctgtgtggcctgaagatttgataaacgagacttctctgtgttattcctcaggagcaggctcctctgggaagtgggaaggaccccggctctgctgtgaggctcagggagagagagtgcacgtcctcctatttggtagaaccgcctattactccttgttggttccctcttagctgagaaagcatcttggttccctggatcttaatgttagtctttggctcactctttagagatgcttctaccttgggacaaatttatatctgatagaaattgttgtcagagtgtaggtggaatagcaaagttttagaaatgattgccttatcaaatacaatgcaagtttcttcttgtccatagacatagctaaaaatcttgtggtaatacatacatgattcaatgacagtatcaattctatgccttaattttgttgataattaaagtgttaaaaattagtgagaaatttacatgtaggagcttggtctgtaagaaaatgccattaattattacacttgctgtactttttctctgattaaatctcatgatttgcttttctttctaagacattatctgttggaacattcactagcctttaagaattcccttaatttctcctgacaggtgaagtgctccctaggtatgaatttggagttctgatgatttttaaaaatccttccctgattttccagagatttcctaaggaaaattggaccaaatacagtggagacccccccccctccactttgccgtgcactttgttctagagcaagggtggcagctacaggcatttgcgtgcccctgcctgcaggcctggctgtagcgcatcatcctttgtgctccctttcctctgagctgggccagggccccatccttttccgcaggcctctgggcagcaccaggtagacaacagtgcatctctaggatggggccagctgctccatgagctggggaggtggggtcttcgttagggttcagaaggatgcctgttccttctggcctcctggggctaactccttatcacagctaggtttgttcccggtggcctggacttttacagaagctacaaccttagtgaggctttcccttgctcccctccgttgaaagtctctgaactgcagttctgtgggacgtatgttgtgcccttgggagtcatttttttgtgacttctctccatcagcaagattgtgatgtaagcaggggcttttctctccccttcctttaatagtaagtatgcagtaaacatatgtatgtttacataatgaaaaaatatgtccttggagacttgttgctttaaaagatgcttaaaagggatcagtttgttaaagtactctttcagaataattattgcatcccctaaaaatgtaaacaaataaagtattactttctttgactaaaattgaaaacaataaactcctcccttcccccccaagaaaagccctaaagaaactctgagtaattaaaaagagaaaaaaacagaaaagaatttaacattgctatttaaccatcagagtctcatttttttccccctccataatgggtttggtttcagacttggatcaaaaactggaacaaaactttctgtgctgtttctgcccctcccgtttgctgaggagggaaggcatgcggccgcagttacagcatgctggctgctcctcactgcccatttgggatatctagaggttgtttgttggtgttctgggatcctgagggacactgccaactgttaacctttggcagatagtgactgttttacttcgattttattttcgtggtaaccgttttttaaaaaagattaataaattacccaagaggacatggcagaaggtaaggatgtgtcccagactttaaaaaatacagttcttattttggctctctgatgtgtggctcgagggtttctctaggaggactgttgatggaccttgacctcagagctcctaggccagatgagcagccatgacagagaatgttgtgtgtttggatggttgggtgccatgtctgttaaaaatccaaccggctagtaacgaaacgccttgcagaaatcatcctgtggggatttagaaatgtttttttaaaagagatttgctcctcagcttagcaacagcagttctgttttgagagccgaagggagcactgtgcgctgtttgtgtatccgctcagcaaaatcacagtgggaagctgctgcagtgatgtgtcccaaggctgcaaggccaccttgtcccatggcctctgtacagccatgggatcacagcttcccttctgcaacgtgccctgcactctactaaaggcacttggcaatgttattgagactttgaacatatgtttttagaaaataatactgagcaaactataaagcttcagtggactggaaaagtgtttgcattttctttatattagcctctagtgtaattcaggacttcattgctatggacgagtctaatttcccttgctaattgtttatgttttcatatgaacaccacatattcttagaggaaagagcgcatctcagcatcttttaaatgctcctgatacaaagtcttaatgtaaaacacttgttctagtatgtttctttccagtacatagcctatgtagttagttcttggtgtttcagaaaaaaaatgaagttaggttagtgggtgtgagcgtggacgcctcttgggtccagtgcggttgcggggttggtgccctacagccactgctgtgcttccctcctggcgtctgtactctaatctaatgcacgagggcagtcctactgctcattaatcacgtttagtgttctcactcctaacccaaaatcgggctcctccttggagcagcatacttggtgccaggcttgggtggacgtcaccaatacctccttattcgggtccatctcagtcgtccatgactcatggacagttttaggatttccctaaaacttatgtggactgccacatctcaaaggcattttagttattttcagtgattttcaatcctgaacatctgggcctttccacttcccccataaaattcgccccccttccccgccccccaccaccattctctctctcctttccttcttgtttcttctaaaggctaatagtgggtgttctcacccttgaaaccagaacagtgaaagttctggaggattacagaagcacttggtcctattttctttcacccaaattgaatcctgaaaactcctgatgcagactgaatggtgaatacttaaaaacatgaatagcacagttcttcctgggcctaactggggtgggcaccctttgcatagctgtgatgaaaaacgtgcccagcatagttgttaaacatggcagccacagcacgtctgctggctctgagcaggctcccaggcccagactggccacacacgcactggagctggctggatcccttgccacctgcccctgcctgcacttaggcagagatggctcctggctgaagagcagggagaaactggggcagctcttctcaggccaaatgcctaggaaagggtggggaggggctgaaggatgagtgaaaatgattgggagaagacagagggaaaaaaggctaagttgctaggaacgtggtgggtgagtgacattcagacttggcttgcccctcttacagacgggttgatttctctcatttgtaaagtgaaatggacaaatgtgagtccttggtgactcactggagcttctcagatcttacccagggatagtctagttatgggtggtggacatggggtggggtgaggagtgtggagtttttcatcttccaattggagaagactgttttgcaattttgagtacctccgccagtgaagaactgtgcaaaaggccgattcctagttgtgccctagtaaatgttttcagaatattttcctaggcagctggggaccagagtgttttgaatagcttgttaaacagacttttaagaggtacacccaattagcactactgagtagtatttagatgttgactagattcatgggactatgctggaaaataaattgtaaactcaagtgtgacattttaaaccagcttttggtccttaaaaccactttgcctgagctggagacagccagtttctcccttgtttttctagcctgatcaccaggcttttgagctctaggctggccttcccaactctcaaacatattccttttatagaaataaaagtacctggcctctatgatgcataactgtgagtcatccagtggatattaaagaactccaaaaacatgcttcaagatagtttttccactttgttccagagcacggtctaaatttggactcattggaaatggaagtgaaaggccccgatggaacctttctggttgctgccttctttgagttgctgtggtgggtgggcagggacagacagccttacctgcacagaggcatggggtttcttgcattcatttctgaatgagtcggcctgtcgtttgcacattagtgaccaatttccttctttcttttttttttgaggtgtagtctcactgtgttgcccaggctggagtgcagtggtgcagtcttggctcactgcagcctctgcccccctggttcaagcgattctcttgcctcagcctcctaagtagttgggattataggtgcatgccaccacacctggctgatttttgtatttttagtagagatgaggtttcaccatgttggccaggctggtctcgtactcctgacttaaggtgatccacctgtctcggcctcccaaaatgctgggataaaaggcatgagccaccacgcctggctagtgatcaatttctaatgattgagactcttgggcacaatgccacatgattttgtcatgctagtgtgaaccaatatcctgttcccatggtggataacgttatattaatgtttagtaatatttgtgcaaattagatagggcgtgagggcttggtaataccaagatatgtaaatgtggagaagtcgtgtgatgaagaagttacttgtccaaggcagcctaaagcgatgaaccagaacctgatgctagtattttagggaatgtcggttctggtctctcttacgtgtctaattatagtgtcaactgcaaaaagttgataagtactaaaatgtattatactttttccccactccactgtttcaaaatgtagtatatagcattaacaaggactacagatctaatgcccagccaacagttaatgggagataaggatttttacggaaaagcagaagttgctagatggtttttgttgttttgttttgtgtttttgatggctgggactcttaaggtacagagagaattgccagtctttctgtattaccgagaaattgtaaacatctgtgttgtgggctttatttttattccctgcagtccttaacatgacatctcccccataattgactctcagtcagtacctttgactctgtttttgaaaaccattgtaccgaggagtgggtctaacagccacaggccatcctatttaatctaagtaagttctatttcttctgtttgtagatttttgaactcaagagcaaaagcgaatatttctaacaagatttgacatgtgcatttttaagtagatgccacataaaagtccaattaagtaaaaggtgatatgaatgtttattttatgtgaagtacttttaagtgattattgttatttaggtgttgcgttctgtggagtttcctcattattaaagtaatgtatttgtttacaaaacaatgacaaaatgagacttatgggaggggaggaaggaattattaacataataggagaaagggctttcttatggggataaatgtgttttgtcactgaagtttttatttgttctgtcaccgagccaatctttattgcgtgagaagcagaccctgctgtattaaatgtgctgatgggaaacccggatgtctttgcttttctccttgccagccgaggagttagactagaacaccttcaagatgagctgtaacttttgaatagtgaacacagattttataatatctgctggtgttttatttgtcacatctgccagtttacctaaaattaaaattttgaaaaccattttttgtggaaaggacaaatcatgtacttgttggagttctgggctgaatattttgtgatgtggttttcaagtgatcttagaataattatgatgccagctaactgtccttgagtgccaatgctgccatgtattgttctcattgcctgtattatttaataagtgtaatattttctccattttacagatgaggaaactgaggtacagagagattggttaagtagcccaaagtacagagttagttaagggatggggtggtttgaacctagttcttggcccattctcttaaccacttcgctataactgttgttaactaaatcatatagtagacatgagtataatttaacacaatttgtcttttatatgactgatgaaattagccccgtgggtttattttcaatgccttatacatactaaagttatgcaaagtgtttctatttttgaatgatttttctttccttattttcattgttttcccctgcactgttgctgataaccttacaaataaagattgtaaaagaccaggagaaagataagcatgccaatcataagttttggttctgtacagttttcctctttgacccattgatgcttttcagctttcccactataattcttcattaatttccaggtttgtcccgcgcattgaattccatggtttttagtgtagtttcttgccttttagcctgggaacttttgggtggggagaatatggtgatgtagttcaagtcgaaatactagcatatgaatactttcagaagcccatacacttgtgtgcacattaactatgtttttagcagttgagctttggttcattgtagtgaaaatgtttttccatgagtaattcttaaatgttggtcttgagtttttaccacagatgttacaggtttggccatggctctctcttgaaaaactcatacaaattgccagtttggtataagcgttaaggaatcacattgctttttaattgtatttatttctatttttaatatttgagctttaaaatattgtagtagtattgtaaaaatgtatctatatgttatcctacactaagcctaagctttaatgaggatattggtacctgactgtcctgtacttggagcatctgtccacttttgaatacatgtaacactttgatgctcctgtccccatggtttgatgaagtacttaataccttgaatgctatatttattatcaaattttgaatgaaatcactagcctaaatacaagtgagatgtttttgaaattttcatcacctttgaaacacctagtatttctgtagaattggattgaggagggcggaaagaagggttaatccccccaaatacaaataacagcagttcctttttatcataaagtaaatgtgtggcctgggagaatgtgttggataattctcatcttaggttgtacatatatgaccaaggcactggataaattcacacgtgagtgtcgtttattttcatgcacttagaaacgtatttagtactgtttctgccagtctaagccttaaaaaggtctgtagctcatttgggattgctgagagctgaggagctgctgttctgaatgtcttcgttttaacttttttttttttttcaagatggggtgaggtcttgctgtgttgcccaggctggagtgcagtggcctgatcgtaacttactgcagcctttgcatcctgggctcaacctgtctcagcctccccaggagctggaactataggcgcatcccaccatgcccagctaattttttattttttgtagagatggggtcttgctgtgttgtccaggcaggtctcaaactcctgggctcaagcactcctcccacctggccttcccaaagtgctgggattacaggtgtgagctaccatgcccggcatatcttcagatcattcatatctggcacagacagttgacctttttttagtcaacagagctggtttgcacaggagattgtaagtgggtctatagagatggaaagttacaggttccatctagtagaggctactagtttttgaatagagggagagaaatctattccaaaggaattgcttcctcaatccccactggccactgcttgtgcggtgccaggcaagagggtggactacaggggcaggcagtccagctagcggcacagccattcagtgagtcaggagtctttgtgcaaggaaggctgaggtgatgacagagctaacagcaaactcagacaatctgaaaaagaaaagaaaaaatccagaaaaatcaaccacatatgcagatactgaaaactatttttggtgaacccctttgtgcataagagatcatttacaaaatatgtgtgtgcgagataagtctattcctgtaaagaaatctgagtcagtctgaggagagtgcagaaatctgagtcagtctgaggagagtgcatttggtgccgtggaagcgtcatgcttgtggccgttcctgccctgtttaaatgattcaggctcatgaaatgtctgtataaagaatgctttaagttgtcttctccgactgccccttattcacttaaagacagactcatatgactggggcagtgacttgtagagcttctggtcctttgcaaataccatgctgtcctgtcttaaaagagctgactaaattaaaaaaaaatccacctcaaaaagaagtgaatggctgttatgatcacctcagaagtatctcaggacaaatatacacacacaccccttcatctgacacctgtggcttttaaaaagaaagccagataacggatagccatttaatcagtttgtatccacacaagcacttctccgatttccctcatgcattaggtaatgacactctcccctgagattgatatgtatattataattaataactagcgcagcgtgttctccaaaggggcagctgcaggaggaataccacagcctctgctgtgacccgcagacctcagtgggagggacatgggacatggtggctcgcactgtgttgaccagcagcccctgttcattgcatggctgggtctggttcctacctagtgggtcaaggctgatatattaaagttctgatgttttgtctcaaaaagaccaatatgacctagttggagtacgtatatataaatgtgtatgtgtatgtagcattctatattcacaagcctttaagtgatttttctaggaattaataagaagtaaaggccaggcacagtggctgcacttgtaatcctagtgctttgggaggctgaggcaggaggattgcttggggtcaggagtttaagaccagcctgggtagcatagctagactctatcgctacaaaaaaatgaaaatatttagctggccgtggtggcacatgcctttagtcccagttacgtcactccatacactccagcctgggtgacagagtaagaccctgtttctttaaaaaaaaaaaaaaaaaaaagtggtagtagtagtacatcttctattcctgtttttagaatgggcacagcaaactgtccacttattttcatcattaacatatggaatgtaatttatgatattttcttagagaagattaaaatcataggtaaagtgaatagggaagttaattctgatactgaagttgacagtaatcagaacttagagaagtaagccacagccagtcaggaaaatcgcagactggaaaagataattattagtaaagacttcttgtggttcttaataaattgtcttcctgaacctagtggctctgctccttcaccataaaactctgattttgttgattaacctttttgtattcaataacaactctaaatggctcatttattgtttaatgttttctatttttcttttttataccagacaaattaggagatgttggcatatcaaagatgtgaagaaaaataaaaggaattcagaaagaatcatgtatctaatatccaggagataatgtagttgcattgattgtgttgtaaagaagaatatatctagcattagtaatggcaatggcaataatgatgacaataatacagattgcattgagccatatatacattatctcattccagtataaaagaagtgcccccagcaacttcttggacgccaaggaggtttccaaattatttattttacaaactcttactttattcccttttttttccttcttctttttttttttcccccaagaacagagtcttgctctgtcgcccagggtgggatgcagaggtgtaatcttggcccactgcaacttctacctcctgggcttaagtgatcctcccacctcagcctcctgagtagctgggactacaggtgtatgtccacctgtagtggatgcacgcccaggtaattctttaaattttttgtagagacaaggtctcactatattgcccaggttggtctcgagtccctgggctcaagtgatcctcccgcttcggcctctcaccatatttttaagaatgagagggaatgctattaataatatcagtattctgggataacaggtgcctataaggcagttgataaaaagaatataatgggaccctacttactccctaaacaaatgtctttgaacatttacaggtcaagaatacaagagaggaaggtctgcttaataagtggagtacattaactcactgacttactctgggttgctattgtattaaaattctgtatagacattacgtagcctcagagttgaatttggactgcccttaaaataaaaaattcttaaatctttagtgtggtgtctgttaatttttatgatgatttacaagttggaaatgattactttgcaagtcatagtttactttgaagttaataagagtgattacagtaaaggaaaaatgccatatatggcattgttcttaacagcttatgaaatttggaaaacgatattttagaaagctttctcttgttggctggaatgaagtggagaccctgctgggaagaaactcagatatgttgataattactgtaattatgagagttcagatttggaagattgtctgaaaatctgtgttgccatgcagtttctggtagtaacagttttgaattaatatttattgtgtgatgcagttattaaaatatgtgtagtagagtaatactgaagcaatatatcgtgacacaaaaggatattcactataaataagtaaatcaggcaattaaaaagcagtattattatttgtattcattttttgttttaggaaaaacgtacctgtgggcacacatatacagataaaatactgcaaggatattttactaaatttaaatgcttatttgaggattagtggaatttaattttatctccttgtaactaataaattgaccatattttctgtttagttttactttaaaaatatgaaaacataaacattaacctgtttccttttattgaagtgctggtgtgtattctaaagctggctagttttttatgttcaaaatagtgttttcaagtaatggaatcattccgtcatctcattcttagggtcaaaaacaaggggtaagtcactatatatcctctagaaaatgttttgtaaccagttaggcagccatgtggttggcaaatgttcaaacagttcatgtccatttttgttttttaggtctctgcaaagtcagctgtcagagagtatctcattgaacacttcctttgattatttccagatacatttatgtgactaatttacgcgaaactggagaataagacctcacatacattcttatagcctccaaaaatattacacatgatggcaatgatgatgaggatgctgaccttactgtagataacagtgaccgtttactgtgtgttcgtgtgcctggtacagactctgccctgaagtccttacctgctcctttcactagactcagtagtctgtcttatcttcccggtagtttttcagtattctcagcaaggaagctcatcccatcagcagttgtcgtggcctgtccaaaccctccatgcagtgagtcttcttcaggttcggggacatagacatagcttctgtccactcaaatgttgaatatccctgcattgtcaaattgtacccattactcggtacctgtctacctatagaagttcctttaaaaaaagagctgtctttttactacttcctggcatgtagttttatacattgatcggattcatattattttgtcttacaacttgatgtctaaatatgtaagcaggtgggagtagattgttttcttttgtatttctgctctctttttctctgtaaagtttttaaatggaaataaagtacataaggctcgtattatgtgatctcttgttggcagtataaaaggttttataataattgttttctttctttattgttatacaggtgctccattaggtgaagaggtggagaagggtgaaggatttgaggacttgatttgtttttaagttaaatgttaggttgctggatatctctagatatctagctagtaacttagcttttgaaattcagtgaaatccatgtttcaagggtgggatgttattccaggaattctgctgaaataaacagtatacagaggcatatctctgaatatttagtcattgccagtggcaaagttggtaatgctgctttgtggtatgtttaatagaggaatagtgtatagcctttgtagataatgatttaagtctgtatttatttttacagaaaggtaaccacatacacacatatatgcatacgtcttttaattttgaaacaatttcagacttaaaaatggttacaaaaattacacaaagatttctatataccttttacccagatatcttacatgttaatattttgccgtttgttataccacttatacccttctttctgtatttgcacatgtatcacctagataaactttttttttctgaaacatttataattaaggcagacataatacttcttttacctttaaatatttcagtgtatttttttttttaaaccaaggacattctcttctggaagtaaaatgatgaaaattgggaataccacattcattcaatgctgttatctaatttacagactttattcagatcttgccaggtgcccattaatgttctctatttcgtgcagtatccattccaggagcacacgttgcatttaattgcagccctctttagtcttttttagtctggaagagctattcagtctgtcaatcaggaccttcacagttttgaagaatacaatctagttaattctagcaagtttgctgaacgacccttgatttggatttgtgtggtatttccttgtgatgtgggtgggaatactactgaagggtggtattgtgctctctgtgcattttgtcaggcaaggtgttgatatgcctgtcctatgggtgatgacataaactttggtcacatagttaagatggtgtccgccaactccattgtcaaattgataacttttttctttgtaatgaagtgtcttgagattctctgtgaaagtatgtaaatatcttattcctcatcacacttttacccattaattttgtactcattcatgatttttgcctgaaccagttgctagtgtggtgttcgtcaaatggtaatttttaaattcttccgcttattccacttttgtagtttaagtcctactgtaaggaagagctttcccttctcattgacttaattgttcagaacaggctcatgggtccttatttgattctgctgattgtgatctgttattatcatgattgactggattgctccgattgttccaggctggccagcggggacagttcaggctgtgcctggtcctgtctttttccaagcccttgcttattttttttgtctgttctctttcagtgtgggggtggggagaggcgcagttgtggattgttttactagattttatccagctttttctccatatctgtatttgtataaattttaaaaactgagcattatttaaatgtttatgatggttgcctttgggttgtgggattactggttattctaatttgtttttctggaaaaaaatcagccatctagcacatgtattatttatatcaaggaagaaaggctttttaaaaacattgcaaagatttgttgtgaggctaggcatggtggctcatgtctgtaattccagaactttgggaggctgagacggggtggatcacctgagatcaggagtgtgagaccggcctggccaacatggtgaaaaccccctctctactaaaaatacaaaaattagctgggcgtggtggcgtgctcctgtaatcccagctactcgggaggctgaggcaggagaatcgcttgaatccaggaggtggagattgcagtgagctgagatcacaccactgcactccagcctgggcaacagagccagactccgtctcaaaaaaaaaaaaaaaaaaaggatttgctgtgagtggtggaaatcacgtacctctaagactgactgagactatcttgtgttttgcacctgtcatttgagagcattcatgttttccagcacacatcatatgtgaaatggagcactgtcactaaatactgatcccatgacttgaaatcattattctaccttcagaagctgggaagtcattacattataacctgtgctctccccgtttcttaagacagatgaggcacctggtgcctgcgaagttaggttacttgcccaaagtcacagagttaattgagcagatagatgttctggctctgagtccagtgttcttagaaaattcttaataatgttttgtttgttaactgccttctaatgaccagatactgaatgaagttttaaagatcctttagcttaaatttgcatatgccattcgatgagtcatgttccaaaattttatatccgaaaattatcaaaggccatttggccatgctggatgattaacaacttcaggtgagtctaaattgatttcttggtagaccatagctgtggagtgctgtgattactgcctggtgttcaatgcgtaattacactgttattctatacttgtaaaaaacatcgttggattggaagaatggaggcctgataaatttgtgctgtttaaacttgtgaactttctctggaatcaagacatgcctgccagaagaaaaaaatctacttgggcacgactaagtgctatctgtagattgccaaggaagctttccccgcccctgtgacttgctgtgagtcccctgggctgtcctcccctctgagcaccagatactgatttgttgtgcctgctgtggtggtaattacataaagtgtgtatcgaggtgcttcctgtctgtcttatccccagctccgtcctcagccccagtcgcagagcctttctcacagcaggagtgcaggaaaaatgagaatgctctttaccctgtccaggctatcttgtggagatgggtcttctcttgatctgtatccctctcttttcttgtcttcttcttatttttaaatactctgatttttaaagcagtcatatcattagtcagggcttttggttgcaagcagtcagaactgtctctagccaattataagcatctcatatggcaacagtagtagttatttgccaagaactatgaagggtctgagcttctttactctatttgcaagctaggttaacctgccttagtttgctagcaaaagacatgagactcctgggtcagacagaggactttattattcacagtggtaacagtagtcatgatatcagcatttgttttttgcaccagttcttcaagccctgattctcacagagcgacttgcagaaggccagttgtgcacacacagtgggttgcattgcaggaaaggaaccctgaatataaggtacccgaatctcttatactggactgcaagcatgcctgctttttgttcttaagggagatgctgtctctgtcttccaagtctgtaagcatacctgccctttgctctggaggaagacactattctctaagtctattcactataaaaatatccttgtaatgatagtccagaacaaagatagtcattgcctctgcttaaatcatgtacagaattgcaagagacccacggagaattatctaccaacaatatgcatcatagaaatttagaaaacagaagaaaagtcactacagtcctaccactcttactgttaaggtttttgaaatatatagagttttagccataaatataaatgatttcatatagcatgtattttataaaaattggtttatactgtacattctatcttgtgatgtgatgtttttcacctgccactgtatcatgcccatttccctctctctgctgtctgtattcttcttgatgtggtgaagcatctttgcccaatcttctgttcccttgtgccctgctctctgcctaacatttaattgtactaagtatacaatcagagttttagaggttgaagagcagagatttcagatcatctggtccaaccttttcatttaacatgtgtgttaactttctcatttaacataattacatttcactgagaccttctggaaccaacaagaaaaccttaatatggaactgcaatgatgggaatttggggcattgaaagaagttgggttggcaacattgcttgggtgatttccttgctaacattgtactgtaaggtgtgagggcctttgcattagactctgactgggctctgtaaacctgagcctcattcttagaacctcttgagccccttgatgttgcccagtcaagtccatagtgactgtaggggctgaacttcaagggccacttttgcttatagccatcacctgagagcacctccagaatcaaaatggccttgggaagtacttgccccagagagagttttaaaaattattctgtcaatctgactcaattccttgtagatagttcatttccaggcatgtattttcttggagtttgttaaaaacaatggaaaaatcttatcttaaaagtacctcttgggccgggtgcggtggctcacgtctataatcccagcactttggaaggctgaggtgggcaaatcacctgaggtcaggagtgtaagaccagtctgaccaacgtggtgaaaccctgtctctacaaaaatacaaaaattaaccaggcatgatggcaggtgcctgtaatcccagctacttgggaggctgagatgggagaattgtttgaacctgctgcattccagcctgggcaacagagtgggactcaaaaaaaaaaaaaaaaaaaaaaaacctccctaaaaatgcaactcaaagtgttaagtattcatatttctagattccattaaaggcagttgtgaggtatttatattaatggaatttgccttgcttaaaaaaattcaggaccatgaggttttggattattaatgcagaactgctaaataattttttgaatggtagctttctttcaaaagccacaaagctgtgttatcttgctttcaagaaaatattctttgttgaatgacttaagcttattagttcttggaaaattttaaggatgtgctgccttcaaacagtaaaacaagttccagctttttgtactaagaagaaactgttgtcactaaggatcagctctgctcctggtatcagtgggcttatggagaggatggcagagaagcttcttgggcctgtggcattctgcatcctaatgaccatctcctttttctgttccctgcccctctcctctttctttccccctccccttttatcctaaagtaggggatttataggatgatggcatttactaccaaagctttgctggccttgaagcaagcctaatttccaggtggcatcttgagatttgtcttgtcctgggtctgaccattgccagaccatggtttcttcagttggaagtaaggctgtacctattccaagacagggagttggggaggagaggtcagggccaggtctgttagaatgagccgagacagacttaaaagagagaacatagacagcattctctatgtggagtgttcaaggccaacggttatgattaggaggcctggctgaagtagcgtcagctggttttctagtgactatactagggttgtgagatcttagtgtcctggcaactagacagtggttcatacttgggcttctgccctgcaagagagtgagagaaccagccaggacagcagtgtcctctgggtgccaggcattatgtactaggggcttggcttactgtgccattcagccaggtggccgtgccctgcccctcccctccctgccatccattatatgcctccatccttctcagggcccttcccttccccgtgaatccccagcctgaggtcgtgcttaagtgccacctgctcaagagagaaggcttcctgcccgcgcccatgatgtaagtccccccagatgctttccaccatcctgtcctttgtctgtaattgcgcttgtcgcttgaacagaatcctaattgtgctgattacatgtttaattttggtctcccctgtaagacaggcatgctttttggaggcagggactgaatgtcattcacatctgtgctcctagggtctaatacatgatggtgcattgtaagtattcagtatataacttgttgaataaatggatcgggtttagcattttcccccattggacctggattgacctggaaattggtggactgaacctgcaagtagagattaaaggacctaacaactgtagagtggctggtgaaggtagatataagtgcagtaagggagggagtcattgatgttgttttggttcgtagtgcagaataaagctacttatggaaatatacgactcctactcttagtttctgctttgatgtggttactgctgttgtttagcgtaagcatataaacaaatcactggcttagtgggttaatttttcttctcttttgttaaacagctgagtttttgctgttttcaaagttagccaaaaattccattttcatgtttaaatgatttagaaaaatcatttttctttaaaaaataacagtacataaaaagaaaacattctcggctgggcgcggtggctcacgcctgtaacccagcactttgggaggctgagacaggcagttcacctgaggtcaggagtttgagaccagcctgaccaacatggagaaactccgtctctactaaaaacacaaaaattttagccgggcgttgtgccacgttcctgtaatcccagctactcgggaggctgaggcaggagaatcgcttgaacccgggaggcagaggttgcagtgagccgagatcgtgtcattgcactccagcctgggcaacaagagcgaaactccatctcaaaaaataaaaaataaataaaaaataaaacgttctcatctattttttagagtaatttaagaagattctgcttcttgttttaccttatatataaagtacgacatgagttaaaatcacaccttggttatagcagctttttaaaaaaaattaaaacacacttttaagtaggaattccaacactagttaattacagataaatacatagcatttttagtgaaatgctttgctaaggtcatatcctgtggttttaagagcatttggcagcatcgattgttaactttgaggattacgtgtagttattctgataacagaaactttcctggtgggtaggaggcaagctgtgttctaagatgatcctgtatctggatcaaaggagagattgtaaaaattacttcacttagtcagatttacttggaaatattaatgaatttgttctgctcatttgttaactctgaataaattgttcatctttttaaaactaagttgtctgtgagtcacaggcctacatttatataaaagcaaaaatacagaaatgattaaaaatctgggccccaagaaataggtggacctgaatggcagtcatgtttacttggctttgacagtttcaagaaaaaagttgaaaattgcgtgttctcactcataggtgggaattgaacaatgagaacacatggacacagaaaggggaacatcacacaccggggcctgttgtggggtggggggaggggggagggatagcattaggagatatacctaatgtaaatgacgaattaatgggcgcagcacaccaacatggcacatgtatacatatgtaacaaacctgcacgttgtgcacatgtaccctaaaacttaaggtataatttaaaaaaaaaaaagaaaaaaggtgaaaagttctgttatgaacttgtgaaaacagcatatagcatatagataacccagcattgctaggcagttctaaggacccgtaccaggcttgtccaacccatggaccaacacaaattcataaactttcttaaaacattttgaatatttttgtgattttttttttttttttttttttttttttttttttttgctcatcagctatcgttagtattggtgtattttatgtgtggcccaagacaattcctcttcttccagtgtggccccagggaagccaaaagattggacactcctgacctactatgagcaagttgaagtgattttgaatactgtagctcatgttgtgattaccagtatctccatttgatatgctttgactgtgtccaaacccaaatctcatctttaattgtagctctcataattcccacatgttgtgagagggacttggtggaagataattgaatcttcagggtggtttaccccatactgttctcgtggttgtgaataagtgtcatgagatctgatgattttataaggagtttccccttttgcttggctctcattatctcgtctgccgccaagacgtctgtgactgaccctttcctgtactctgtacaatggggcctcactcttccggcagtgagacatgcctttcaccttctgccataactgtgaggcctctccagctacgtggagctgtgagtccattaaacctctttttctttataaattacccagtctcgtgtatgtctttatcagccatgtgaaaaggcctaatacaccattctggtcatttataatttttatttatgcttttatttataatttttaagatccactcagtcaacctacagtcatgagaaatgataagctattatcgtttgagccatgataagttttgtggtggttcgttttgtagtaattagatacctgatacctcaggttatagtcgtaactttttaaaaaatggagtaaacaagtttgattattctgtttgtgtatattgggcactgaatagttatttcccaaactgtaatctgttcttaaaaaataatggcttactgcattaaggatttttccaaagaatgtcctataataggcaatttgaagagagagattccagaaggcgttgagtcctggcagtgttcctgtggaataagtctgcagcatcccaaggtgattgctttttggtatcttaaaagtaaaacagcttcattccttgtgtccagaaacatttccccgcaaggactacaaaagccttacaaaacatcatcatcattctcacagtatttttagaatcaagtaggaaggtaattttctttttttacagaccatgtttcctggtcagatatttctggttttgtacttaataatgaaataagcatattaagacagagatcttatgttcacctgtgagttttatggaaatgacctttttatattgttagaataaaaagtaacaaattctaagaaacagtcttttaaaaaatgtatgtagtaattgtccggtgtggcgttcagtgccctcaagcatgggaatggagcccttgacgggcatctgtgactgaccctttcctgtactctgtacaagggggcctcgctcccctggcagtcacctgccccttgctaggtgctgaagctgtacaaagcctagtccttttctcagcagaccagggaaaggggtgggggtgggctgatggcttattagagaaacacagcaggaatagcgtgtaaaattgaagaaggaaagtgagcccttgttaattgtgcactcaaacctggtagctttttcctttttttctcttatcgttacgttgcacctcagaagatgcctggtacttttaagtaaagcaacaaatgtaggaagaattgaactgctcttttcaggatcctgatggatgtctcaaatgtttctagaccttgataaaagtacttgagcctgtcaatagcctagacgttttaaaagctgcttatgctttttatttcttgggaaatgcttgttttgagttgtgtgtcttgttttaagccaaacaagtgtcatctgtggttgtgctgctagtacatttctgcttgacctcacaataaaatactgattttgaaagcaccagcctgtctttttaccgcagaggtaatttgagagaggagtggagggtgcccggggaaggagttctgcactgccagcctcatggatgccagagagaaaggggagttcttttccttggtcgatggtcacagaggaggaagagtgtgaacttactccttttttgttctgcaggttgtcttggtctgtctttatgatcgtgggcagcttagggacaagcaaggtcctggcacccatggttgagtgagtggaccacatactaacattgtatggtcagtgttggtctctaggtcttacgggaatgtgtacttaagtatggtggaacaatagctaattaagtagagatttcaagaaacaaaggatttgaggaagatattgcccaaaataagactattgtatattatcctatgaagtcctgaaccctgtctctcattaaaatgctattcagattttggggaacagacatgaagtaaaagatacagtgtaacatggagagttaacctaaggatataggagcttagagcagtgaccctgacctgggcaagtgccttcccctctttgactctgtttcctcactgtaaaatgcagataacagtagtactcattcactgggctgttcggatgattcagtgatttaatatttgtaaagagcctagaacagggcctgccaccatgtatacactttagtaataatattagtcaggggtgtttctagccgtgtagaagtctgggatgcgtggtgtcaccccttcttcagggttcctcttccaagctctttttcctgctctctgtttccaccgtggctgcagtagagacagaggccaacatttgtggtgcaaagggaagtgcccacggattcaggagggcacaggattttattgtcttaaatcattaactattgcccgaaaaatccacagaacatcgttgtgtaactgcagctgcaggaagtgtctgctttctggcctcagcgccagggaggtggagttacttagcacatccaccgcatgcttcctgggctgtttcttttgtggattgcaaattctttggaaaatagaacatgtgatctagagaaaagaagaaaataagaacaaaggataaaataattgtccccgtaatgtagcagctaacagtttcattcagaagtacctgaaacagtgaacagtagttcctcagcatttgaagtaatgttacaagtcaatacactgttcattacgttagattcaaaatgaaggtctatcttgtatctgaagttccttggccagggagaggataaaaacccctggaaaaaataggaattatgcagctgtagttacaattaaatttaattcatgaaaactacatatcatacttcataataacattaatttttattatctggctactgtgttattaacacaaaatataagaattattagtgtttcagaagatgccagttggtttcttactaatgaaaacattatacgcatacaaatacttttatacaaatgtttttcaatttatttatttatttagagacagagtctcatgctgtcacccgggctggagtgcagtggcacgctctctgctcactacaacttctgcctcctatgtttaagcgattctcgtgcctcagcctcccgaatagctggaattacaggcccgtgccaccacacccggctaatttttgtattttagtagagaaggggtttcaccatgttggccaggctggtctcaaacttctgacctctcaggtgatctgcctgcctcagtctcctaaagcgttgggattacaggtatgagccactgtgcccggccaaatatttttcattttaaaatgtactttttatttatttttatttttgagatggtttctcactctgtcacccagactggagtgcagtggcgcaatctcagctcactgcaacctcttcctcccggcacaagtgatccttccacctcagcctcctgtgtatctgggaccatggcatcgcaccaccatacatggctaattttttgtatttgtggtagagatgggtctcactgtgttgccctggctggtcttgaactactggtctcaagcagtccacttgcctaggcctcccaaaatgttgggattataggcatgagccactgcacctggtctaaaatgtacttttttagaaaaagaaacgtctttttaaaaaactaagcatactgcttaattcctctagattcttgctcttgtcttgaggactttgcatcctctgaactcaacttgtggtcagattctccggatgtttcttatcctcgaaagtttaactcaacctctttctcccagtaagcctctgaggtcccagcagcctctttctcaggtcccgctgcccttctgttctggcatgtgcctaacctgacagttgctgccttgctcctgaaatttgtcattccatttcgatggtgcctgtgtgttacctgtgtatgactgaagtacatattcgttatctgcgtgagacagtacagattggtgtatagtattttacagccacttcattatatgctatttccgtgtactggcaaaaaagagaataaaacttcctaggatataagtacctactgctgttttggtgcatgtccagttaggcttttctctttttatttgtttgtgtacctgtaactccatataagcatatataatcatgttacatatgtttaaaaggcgtcattttgcaatgcagttttatcactagttttttctctgtcaagggatgtataaaaatggatcacaaatctaaatttaaaactataaaacttaggagagaatctttgtgatcttggattaaacaaagatttgttagataagatacagaaagtatgaacaacataagaaaaaagtctatagtttaaacttttttatattcagttttgcttttcaaaatatacctttaaggaaatggtctgggtaaggtggctcacacctgtaatcccagcactttgagaggctgaggtgggaggttggcttgaggctaggagttcaggaccagcctgggcaacatagcaagatggtctctacacacacacacacacacacacacacacagccaggtagcatagcaagactgtctctcacacacacacacacacacacacacacacacacacacacacacagagccaggtagcatagcaagactgtctacacacacacacacacacacacacacacacacacacacacacgcagccaggtagcatagcaagactgtctctctacacacacacacacacacacacacacacacagccaggtagcatagcaagactgtctctctacacacacacacacacacacacacacacacacacggagccaggtgtggtggcatgcacctgtagtcctagctgcttggtaggctcaagtgggaggattgcttcagcccagcagttcaaggttacagtgagctgtgatcgtgccactgtactcaactccaccctgggcaatagagcaagaccttgtctcagagagagagagagagagagtgaaaatacaagccacagaccaagacaaaatatttgtaaatcatatatccaataaaggatttttaatccagaatatatgcagaacttttataacacaataaaaagaacaaaaccaaattaaaaattgagcacaagatttaaatagacactcaacaaagaagggcaaataaacacatcagaagatgttcaatatcattagtcactaggaaaatacaaatttaaatcacaatgaaataccactactcacttagaacagctataataaaaaagattgacattgccaagtgttgatgagggtgtggagaaaccaaaaccctcataaattgggaatataaggttgtacagtcagtttggaaaacagtttgcagtttcttaaaagtttaaacataggcttatcatttgaaccagcagtttcactcctgtgtatctccttctaaataaatgaaaacatgtctgcacaaagacttttctacgaatgtacagccgtattactcataatagccaaaaatgaaatgatctaaatgtccaccaactggaatggataaacaggatgtggtatatcatcatcatatccagacggttaaatactcctcagcaataaggaacaaatttctgacacatgccacaacctgagtgaacctcactgactgcatgctaagtgaaagaagccagacacaaaatacgacatattgcatgatgccatttctatgaaatttccagaaaaagccaaattaggcaaaaaagcatttcagtggttgccttggggtatgggccggtgagaggattgactgcaaagagtcacaaggaaacatttcagagcgaagaaagtgttaaaccaaactaaagcctgaagatgtctctgtgctttgagtccttatgtaagcaactgtaatctaacttagtatgtaaactaacagaaagtctaactgaagagtatacttttgtaacaaatagctgactctcagccaatcacagcagctgggcttcagttagtcacaagtggacagttcatcagaccttgttcaaataaggcaaaggctgagctttaaccagttgagctgtttctgtacctcacttctattttctgttcataagtgttacctacctgaagtggaactctgaaccctctgctggttctaagggttgcctcattttcgaatcatcctattctcagttaaactctgttataaagtttgtttgtaaaactggattgtgatgttgtaaaactggattgtgatgctggttgtgcaattataaatttattacagtccgtgtaaaatgggtgaatatttttaaaatagtgcaccagaatttattcgacaggtcgcagtttgccattttctgtttcatctagtcctaagaggtagattacattcctgttttccagaagaggaaactgagggctagtgccgataacttacaggtctcagagccagtaggtcccattctcatgttatgaccatagagccctatctgctaaaatgagtaaattttatggtatgtaaattataccttaaaatacctcatgacgttgtaaagaccatattgtgaacatcctttatgtcaggaactatatttgccatcatttcttaaaattcatattggaacgttttagacatacatagaagtagaaagaatgggtgatgccacccgtgagctcttcggaagtcaccatctgtggcctgtcacgtgtcatgtctctactccctcaattactttgaggcaagtcccagttactaatatattctttctcctgtaaatagtttagtgtaatgtcattatttttaaaatgattgcttactcttccatgcttgtatcgtactgggttaaaccagtggttgatagtgggtcacttgagttgactcttctgtatggccttgggggtgctgccacagacaccctgttagctggatctctcgagcagcggttgttagttgagctccgtggtctagaggaactctgtgttgtttgaggttgtgcagcacactttttttctttcattaaatgctttaaaatgtactctaagaaagaaaaaacattcaacaaaattgacagtattggccctcaaggcagtatttttaaattgtcaggagattttttatcagactcagatcttctggtgagaggaatttaggagggcttctgcacagagggacagaggcagtggcagagcattgcagccccccagaatggggtccccagggtgttggctgctccccctctccctgtgtgctgagctccctgtgtgcgggcctagcatccagcttgcagcgtggaccaagtggggtcctggtgccgtgggagccctgattgctggaggagcccagctggggccacaactagggcagcgagtgcagggtatggcgccccaggtggggtcagggggagtcagatggaggagcggtcggcccctttggttgagttttgaaggaatacaagtagatggtagatgaacggggaagttctgtgtagaaggttggaagtgtgaaatggcatgaaattaaaccactggttacttttgaggacagcttccttgttgacagatgtagaaacagagtctagggaagctttggcttgtctgaggccaccaaggtaattgtccagcgaccccagccaagagtaggggtgtccagctttccccaggctccgcaccctctgctgtgatccccatggggacctatttgcagccagccattttgtggcctgcgtttagcttcttgctgtccaggtgccctttaacttatgggagcatctgtcagagcccatttagaggtctctcttttccagatctgtggagcagttgagaggaggttattttgcagcatttgtttcttctaaatctcctttcaaaccacttttgaaagtgtttttttgttgttgttgttgttgtcgtggttttatgattgttttggggaaaaaccatgaaagaaaaaggaaataaatttttatttcaacatgaatcatagatatcacccttatttttccatcagttattgtagcggtatgtttttaaagtgcagcttactctattcagccttattgtccagtagttctacgtacagttaaaattaaaatttgaattcagcagaaatgaagtggatgtcagaggatgacacatattcaaaaagtccatccgtccttatcttgtcctaccctccactcccttcctcctttcacccttctcctctctgtcctctttctcccttcccttctttccatcttccccactcctgcccttgtaagtttgccatgagcccctagataacttaggtctatttccttgacatttttggaaattgctgaggtttactggagaccacttgaagccgtgccaactgcaaataataatcataataaaagtcacattatttttagaccttttgactttaccttcttctgactttccaattagaacagtaagttatagttagatcaacgattcatatatttaacaactgccaaaatcatttcctcaaaaagaggagaatcagagagttgggtttctagtatctcagaaagaatcatcatctcaaagatttgatgtaaaaagcttagctgttaacatataataatttgggctggcaaaatgcctaatatgaatgagtaatttagacctgtttataagcaaacctggcataaagctcatatttttaaatggcttgctaactttaaatggactgacataagcagtcattactataaatttgcccctgctgtgaattaacctataataaaacatacaataatttaaaatatgaaacaataaaatattttgccatgtgtgcttgaaggtatatattaaaacaagaatctaccagttgaagtgtatatatagagctttcctgagcacactcagttgttttttttttttttttttgtaaatttaagatctgttctttagaaattaataagaacagtctttttgtcacatatgttttctcttggctagatctgcatacagagagcaacagtttgttcttaagaaacagaatgtggcaatctttttagtattctgatcaaatagtactatgaagagaaaattatcaatgaaataaaaagtataaagagaaatatagtagattaaagtaaattagtggggacagatgccatggctcacatctgtaatcccatcaactttgagaggccaaagtagaaggatcacttgagccctggagttcaagaccagcctaggcaacacagtggtgagaccccatctctccaaaaaaaaaaaccaaaaaaacaaaaacaaacaaacaaaaaaaccaggcatggtggcatgcacctgtggtcccagctacttgggaggctgaggttggaggatcacttgagcttgggagtttgaggctacagttaactatgatcctgtcactgcactgcagcctgggcgacagagtgagacattgtcttaaaaagaaaaaaaaaggcaaattaatggtttaatggttaaaatgtgttatttatagtttgtagagtactcaggaaggatagaattataaacaggtggcatggacagcttccatccctataaggaccaacaggcgggtttctgaggaccagaaaaatttccagctcgcccaagtatgttgatttggtgcctgggctggtggctccctctgatgtcacaccccagtgcagctccccagggctcctctggaaccttcggggaactccagccaacttctgtgaaccttgtttccaccccaactctccctccagactcacatacctgctcaaacgtgcagatgctgctttcattgaacctcagatgtctcaggcatgtagggtgttttaaatttcagacacctaaaataaagtgtctgaagtttaaatgttaacctgtgccagtaaaaatagcagaagtgcctgaggaaggcctgtggtgggtgggtaagaattgttggcattattgaagaaaaaggaaagagctatgtccccccaatccccaaaatggagaacaaagcaaattaccctatcctgaccagtgtacatcaggtctactgattgattatagccaggaagttagggtttggcactttattgcttaattttttaatttacacattgaatttgctttgcatcaacttttgagaaagtggttctcatgacttatatttgtatagtactcatacttgttcatttattttctagcaatcaggagaccaaatagggtagcctgtactttcttcatgtttgcctgatgaaaacactgtacggttagttaagactcatggccggatctgatttgtaatttcttgtttctgaccaagaagagttcagttgctgttgaacaacacggacaaagtacactaggggaattcagagcaggtgtgaggttcttcctgctcctagaggtttgtgtgctctttacaaacaaccttgcaaacactgaggttgggagggaaacaagtctgctttgcacttagagcgcagaaggatttctttggttggaatgaaggagaaggaaagtacaatttttttcctgcttctcctccctcctcttttcttttcactcttcttcccctcttctctctcaaaagttatttctaaattatcaggttaatatatgtaaactaatattggtatatataaatgacactatactatattaatacataaatatataaaattatttataatatatgcactatatatatatattaacttgataattaactctagctgctagcagaggcgagcaggctactttcacatgcctgactcaccagttagatactaagctgatgcacaagttagctgtgcttgtttctaacccatttatgccaaggacacctttactatcaacatgtaatttaattaaatattttctgagtattttcagatatgagtgggaaaagtatttctataaaggctaaattgatttgggatgacttgttaaagatggtatgtttaaaataagctgtcacattaagcacaggagagaactgtaaagtcagggaaaattttgtaaacatctatgagcattctgaccttagtttctttcagagtgtgtctgtattctaactccagtttaataaggatgaatgccagaattggagtattagggtttattcaagtaagacaatgaagagcttctgtccagggattcatccttcattcacaaaaagaccatggtactggcccagggcaggagactgacagtgagggacggggctgttcaagtggcactcagcaatgtgcctgtattgagcgggaggatgaaagaaaaccatatttaatgtgtgctttctaatgactctctgctttaactgacttagttaaaaattatcttacctgactacaagtgatccccttgagaaagagagcttcatgcagtcaggcaagccgcagtcagggctgtcactgcttgagtttactgtcatgtgctcctgctggaaatcaatcagattccttattctttaaattacacacaggtggaaacctagagaagggctgggttgactggccatcttgaaggctgaaattggtggcatcagttgctctctgctaccctgacagatccataagccgtggtgttcatggttagagacagagcccttcaggccccaaggaagggtatgccatgggtcacctagggagggctgctggagaattcctctcttcacaggcagagaaccgaggctgtttgtccaagactcacagatgtttgaccacacactgaaaaactcagactccagtattgagaactcagtaggtgtttccttaccacctgttttctgaaaggatgcagggtcatctcagtttggaaatacaggttagtctgacaaacacacagttttttgcaaaggttaggggaaaaaaatctgttatttaaaatctaccggatgttattagcatctaccgtagctcaccacaaagtttgaaagaacatagcagaatgggtgcagacctattatgatacaaatcagaaatcaatttcattgttacttcagtttacctaattattttttaatggatgaatgaaaccgagtgttatatttcactttgatgatacaggacctcattgatttgtctgtgacatcagtcagtgtacgtgtgtagacaagtgtgtgttctatttatttctgacaaaggtgaaataaacaccttaggtaatgaaacatcctaccttaagtcatttgaactcattgatttcaaatcagtagttatgatgttattttttccttttacagtttaaaaaaattgtgttgaatgaagtgcctttaaaaacttgacttggaggaagaaagtaaaatgatgagaaatttattttgtatgaaaagtaaatcttttctgtatttggtgtttaccatgtgtaatttaaaaaggaggctagactgtctagttcaataataagaatggagaaatgaatttagaccaaaaaaagcagcctagatttcctctacttctgtactgataaagatgatttggagcttatcttcttcacaactgttttaggtgaaagaaaaagaaaaccataacaaacctaactaaaagcatgcatcgttttttatatgatgctaattaagagatggttgaattgtggcagttgcttctactacatttctttcacaaacgttcttttgtagtgactttgttattcgtgtctgccaatgcacactgttagtgtttattggtgtataatgacaaaccttgattgtgatctggaaacctatcacagttttattatgattttacatcttattagtgaatatgctagtgataaaaacttgatttttttccttcagctttctttattcagaccaaccttcttttatatatggccttgagaacttctgcaaactttggtttttcatccataaaatggctttagactaaatgattccttaagtttctttagttccaagatttgatgattccacaaagtttgagatcttttagcgccaagatctaatgattccacgaaatgtgagatcttttagctccaagatccagtgattccatgaagtgtgagatcttgcttgtatgtacaaatctatttgcaatttctccaatggcgtgggttaagttctactactccaaagtgcctaaaaatcgagaaaccataaaactagtttttgttcttctaaatagacaactgaattttgacaatagaagctagttttgagagtcggtgacttatttatgttgatttggttattttaaaaattttctttagcgattaagaactcgtgttctggaatcaaatttgaattccatcccctccacttaatcaagccgtttgatcttagccatgctgcttgccttctctgtgcgttagtttccttgtctgtaaattagaggtaatcatggtatctacttcttagcgttcttgtgaggattcagtgagataatccatgcaaagcttggctcacagcaagagcttaacaagggttgactcctcagattgtgatggggactcatccttttcatgatagtagcaagcctgcacagacgtctttccttccataagttcaagagttctttgagtctgcccatagcactagctttttgatctggaaatgctgcagattctgttttctcttaggtagtttatgaatgggtttggctgtattagagttgaatttgtctcagagccagccatagaattcacacttgtccaacaattgttgttagttttgcctgcccatttatgtatacacctatttgaaaaaagatgtggtgtttcaaacaacaaggtggtttttctcttcttgtttgtatttgcttcaccttcttggattgttggagttggtgttgcatgtccaatcattccaaaagagctgaatggtcattgagttgattgtgtcttagaaataacttgtggtctgttctcataatactgacatcaaggtgtcgtatttcagtgcataccataaacatctgtacagtggattggagtcctacctcttggtttttaaagactctgtgtatcgtattattgccaatgtcattccatttggcatgtgccaggatggtagcagtattataaaagcatgtttatagtttaacatgattcagtgattccagggaaactgcctccaagggtcctgaacctggtcagtacagttgtttttactgttttccatgactggcctatttgccttggtgcatcaaatccttgtaatagcttcatatggtagatagccagaccaaggtctcatcgttaggaaggggagctgacattggaatctagcagcctggccagagccaggctcttaactgctatgccacctcttagaaatctcctacagggcaaggaggcgtgctgggaacagcccagcttaagacggcagggccaagtggtctggtatgtgagcagaggcccagatcatgcattcctcctccagcacgatgccccatgcgtcaccgagttctctgatcaccggtcttttacatacttcattcctcccattgtttactaaaggatgtttgttactaagcatacctggagccaggaatgaacaaaacaacagaacctacagtgtcctgagagccactgtacagaatgtggtcattatacgcaggccattcaggttgactctctgaggtgtcctaactctgtcctgttaaaccattaccaggagagttcacagaaaggaaatgctatccctacacctgcagcttctttctgggcccctttcttgccctcagtcctggcactagtccccaggagagtgagagttgttgcattgaaatgaccataaagcttttcttctccctcgtgctgtcccccacgaacccaggtatgaagtatacagaaggtggggaattaggattctggggctttcccatgccagccacgacagctgcagcctgctcagtcacaggcacactcagttattaaaattagatttctgatttataggaagattgtcttgatcaatgatgacaagggcatacctgactaaattaatgagaaaatggctagggtaagtcctgggcagctatgtgaatgtgagtatcattctagaagtgtgtgtggcacttgctgcagccctgtgtggctgtcctggcactttgttcccggtgtcagggcctctggtgtgtgattgtcgcagcacgtgtggggcagtgtgtgtgggcattcccagcctgacacatggcttgcataaagattgcataaggttataggaaagtgtctctgtcttttacaccgtattgccagtactaatcagtccaaagtttgagaaaatagtaaaagaataacatacatggttgaaatcaagcatttaaaaacattcagtaactttttgaaagaagactctgcttttctgattaaataaataaaagtcttattaatgatttttagtataactatagttcatgtgtgtgttggggggagagtctcgtttaccttcccaaaacaggttggattttaaaatgcaacttttgcaaagtaagtaagtttcagcacaagggcatgttttcatctctgcactttgtcatctgtgtcagtaagcagttaagtggcacagacctgcctggaccccctttggcaggttgttaggatgaattagtgaagtcgtcggtttaaagagcttagggtggtgcctggacagagtgagtgtctaatgattgctaaagtaattttcttagttttactatggaatcataataacccacatagaagactgatattaagagcacagaagaaatagtcccaatgtttatgtcatttaatttgaaaaatttcttaacttttccaacaattagcatctaaggacctgagctgagtctctaagagtcaactctgctgtgaaattgatgttgaaatacaaacaaaacaaaaaaacctcaaaacccaacaacataataagagtagtttgtaactgaaaagaaagtctcaggcaagtcttaaggagcaggtgggccctgggcgaggctgcgcagtggggctggagcaggggcccctccccacagagctgtggcttctgtggttcctgtgcacctcacaagaagcccagtggggcaggtgagggtcgcacagcctgtgcagccagggctatacccggctgctgtgggggttccgcggccactgccctcctgcattagatggggcaccaattcctggttgaaacatggcagatgacaatttccaaaggctgtgaactttccaatagcagtaaactcctctgaagaggactgggatgtggaagtgggatccctgtgccgctggcagtgccggcagcaacccttctccggctcttactgagctagggaagctgttgctctgcgccttcttgtttagtttacaagatttaggacaagtgcctcggtttctgatgctgtcagagacttggtcaaggtgaaatctggtagctcagtttatagaactatgacaaggctagtgtggtggtgtgacattggtgaatgtttgtgagatggaaaagtactactagactttagcagagccagtggcataagaaacttaagtttaaggccaagtgctttgtgtgtgtatgtgaagtggagagggaggaggatgatttgctttctttttctataattttttttttttgtttactctgcaaaagcctgaccagatcattgttttccttaccccccgcccacagtggagtaggagaactccatttagatccttgccctgtacttctgcctctgcaaaccttgctttccttgttgaaaatactcagagagtctttgtgtcctatttcagtgctgaaaaaagatctgctgctttctaaagtgtgcctgtcttaccaacccgtgtgggaatgctgcccgcgtgtttggatggctctatcaaagccttaggctgtttctggccggagtcataggggacccttcaggtttgtggattcccagttttagtacagtgtctttaccaccaatcccgtattaataggacagtactgcgggtggcaacctgggccgggtcttctgctgtgatgaggaatcacctgcattagtgtcacctggaatacctgtgaaaacgcagaatcctcagcaccagctgaggcatcagaatctttgggatagggttcagggttcacttttactccaggatctttacctgaggactaacattaaagaaccatttctggaggaggtaaaatagatcagtatttttcaagcagcatgtggcgtccagcagttttttttttttaaactaaaagatgccctaaaatagtacagaaatatcagagttcattgcacatatcaagagtgattttgtgagtctctaaagtcagtatatataacacaagtgttcatgtacaggcatttttttttttttttgcactttgttctattgtacagatactgcggggtttttttttcttcttcctcttcttcttctttttttttttttttaaaaacaaattgaaggtttctggcaaccctgtgttgagtaagtgtatccatgacatttttccaacagcatgtccttgctttgtatctctgtatcaaattttggtaattctcacagtatttcaaacattttcattgttacatgttatggtgatctctggtcagtgatctttgatgtttttagcgtaattgttttgcagcagtatggaccacacctgtatatggtggcaaacttaatcagtaagtgtgtgtgttctgactgctccattgaccagctgttaccccgcctctctccctctcctcaggcctcctatttttgagacacaacgatattgaaattaggccagttaataaatccaactatggcctctaagtgttcaagtgaaagtaacgtttgcacatctctcatgttaaatcaaaagctagaaatgattaaacctagtgaagaaggcatgttgaaagctgagacaggccaaaagctaggcctcttgtgccaaacagccaagttgtgaatgtgaaggaaattaaaagtgctactccagtgaacacacaaatgataagaaatcaaaacagcctattgctgacatgcagaaagttttagtggtctggatagaagatctagccagccacagcattccctttagacaaagcctaatccagaacaaggcctcagcaaattctgatagaggtgaggaagctgcagaagaaaagttggaagctagcagaggttaaatcctgagattgaaggaaggaagccatctccataacaaaagtgcaggatgaagcagcaactgctgatgtggaagctgcagcaagttctccagaagaccttcctaagatcagattttcagtgtaggcaaaacagccttctattggaagaagatgccatctaggactttcacagctagagaggagaaatcaacatctggttttaaaacttcagaggacaggcgactttcttgttgggggctaatgcagctggggactttgttgaagccaatgctcattgaccattctgaaattgctagataccttaagaattatgctgaatctactctgcctatgttctgtacatggaacaacaaagcctggatgatagcccatctgttgacagcatggtttactgttttaagccctctcttgagacctattgctcaggaaaaaagatttttttttcccaaaatactgatgctcattgacaatacacctagtcacccaagagctcttgtgtagatgtataagaagattaatgttggtttcatgccggctaacacaacatccgtactgcagcccatggatcaaaaactaattttgacttccaagtcttatcatttacaaaatacattttgtaaggctgtagctgccatagatagtgattcctctggtagatctggacacagtacactggaaaccttctggaaaggtcaccattctagatgtcatgaggaacatttgtgattcatgggaggaggtcaaaatagcataaacaggagttctgaagaaggtgattccagtctcgtggatgacttcgaagggttcagcacttcagtggaagaagtaactacaaatatggtggaaacggcaagagaactagagctacaagtggagcctgaagatgggactgaattactgcagtctcgtgattaaactcctcagggatgaagcgttgcttctcatgaatgagcaaagaaagtggttttttgagatggaatctacacttggtgaagatgctgtgaacttggttgaagtgacaacaaaggatttccaatgtgccacaaacttagttgataaagcagcagcaggggttgagaagcttgactctaatttcgaaagaagttctgctgtggataaaatgctgtcaaacagcatcacatgctacagagaagtttttcatcacaggaagagtcgatagatgcagctgcatcactgtcttattttaagaaattgccgcagccaccccagccttcaagcagccaccaccctgagcagtcagcagccatccacatcgcggcaagaccctccaccagcaaaaagattacgactctctgaaggctcagatgatgttagcactttttcttttcttttttttttttttagcaataaagtatttttaaattaaggtgtgttcatttttaaagacaaatactaccacacatttaataaactacagtataggataaatgtaccatgtaacgtatagtgtaaacataatttttatatgcactaggaaaccaagaaagttgtgtgactcgctttattgcagttgtctggaaccaaacccacaagcatattgagttgtattgtaaaaggtatttcttaatgtgggttaaggtcacaaaagtttgaaacccagtaggttagatgatgtcttagttccctttcatcgcaacctcattttgtattgttttgaatccttagctcagacccccagccagtaaatcatctgctctgagacaaacactaagaataaaagaagctgggaagcttttaacctgacctaagcattgtcttggaaacagtaaaatgcagccccttccagacctcttttctcagtatctttggggcggggctttggaacctgcattttgagtaactgttccacaggattctgatgcaggtgtttatgggaccaccttttaagaaatacatgtgaagttttaaaccttgtaacaattctctgaggggcacctcctctccctcccacttttccctgtttccaggtaagaatcctgaagccccagttgatcagacttggtgacttctaacatcgcagagatgttaaggcgcgggcttggtagggcagcacgaggctgccgttcctcttgcccttcctacttggagagaatcagatggcgtgcagtgtggacatgtaagttcctgattgagggcgtctcccggatcaaaaataaataggattgttgaaaatgatagtgttggaatcctgggcatgaagccttttgtctctgggatagcctttgagacctcctccttccatgagtgcagctgacacagaggcaggtaagaggacaggtagccgtgtctgctgcttatgagttgtcccagctctgccccagctttggaatcttgggcagtggcagagagttatgtgacagcgtctatccctgagagttcttccagattttaaattctatgattctatcttttggaaaaatagtatttcctgtttcttaccttgacagagatactgaatgggtcgacaaaaatgtatgcacgtcttttgagttcccccagaaaaacgatgtaaacagaatcattcgttggcaccctgcagttcagttcagattttgtgtgggacacagcagatctcagcgtgcactttgagagctcctccaggagcaggctctccttccccataggaggctggtgtaagttgcatcacagccatgtcctctgtgtcctattcaccaaggcaagcattgggaacagggcggtggagcaactagcctaggtgaccctgcttggcttcaagttaatcttattacgtaaagaaacagagaaggatttactttcaaaaccccttctgatggtgtgtaggtgggaagccacatccagtgagatttgcgagaacaagaggaaatggccaagtttccgggaagcagggctgcggtgtgcagctgtgcattctgtggccctaaacaggcactttgtttttcatttgaaggtcatcatctccctttggcacatgtgcttcctctctttgtaaatgtgtaatattttaggctcaaattcctatcgaattttagtcttaatctaagtcggattatagaggtacatattgtcttactgttacattttactgatattcagtgtttgatatccccaaagtcttgacttggattcacaagtgattacatttgttatgcttgtcttgatatccaggaagtacatagttagagacagaacccacatttggcctgaaaatagtattaataaaagtaaatgtttttcaagcagagattgcagccatagtttttgatatatgctaccaaatcatgttttattttgagaattttatgtttaattttatttaatgttacagtgtttatccatttttcatttcttgattcttttaatggaagaacacattattattatattattattattttgtttgttttcagaaagtatgtgaagcgaggaccctacctcatctgcaggttaatcttatacatactgtttaagtagaaattcctgcatttgtcttttaaaaataatttttaataattttaattaaattctaaaatagtttacaatataagttataagctgttttcaaatttaggttactcttggagtaaggaagaactcttagctgagaagatgtagttaagtctgaggttctcggtgagcacagaattaagtgaagaaagaatatactaaaagattcactgaaggtgacatagtctgtaatattagcaccatcttagacacttactttgtatatattttaaagcatggagactagcttgggaaggctggatggttgtttgctttcatgaatgagttacgagggatagtcctaagttgcttgcaggcatccaaaacaaatgttagtaaataaagctttacagaagaggcaaagtggaaggactcagtggctaaaatatagttcagttgccagaaatgattgtcgttagttgtttttggaggacttaaccctaatggatctaggcatggaagttgaattatagacatgagagaataacgaagaactgagaaacaggacataccaccaatttttaaatgaaagggcaaaaagtaggataccagaatgcataggttaagatatgtgacattatgttaaatacgcaataggtgtttttagtatcacatgtaaaaattaaaggctgtttggtctttgaatacttcacctccctgagccttcgttccttgttcctgagaatgaaaggggtcgcactacctcatgtctgatgtagaactcctgagcagtttctgttattttgggaagcctgatggagatggtgtgctccttgtgacaggaccctacagccctagagcatagccttccctcaagtttatctgaatcgtagagaatcagtgtagagttattggctgtaacacgctgatcagaaacattaattgtctgttttatggattggggtgaggtgagaggtgcagacaggagggaggagatttggtatacttctgagaaaaaaagtaaaaagcaggtggagttaaatctgtggaacccgaaaataatctaggtgcttatgttatttttgcctaacaaattaccacaaacatagcagcttgaaacactcatttcttactccaccgtttctgtaggtcaggtgtctgggtagttggattctctgttcagggtctcacaaggccattgggactgcatttccatctgaagcttggggtcctgttcaggtccattcagggtgttggcagaatccacttcactgtggttgtaggactgaggtcccagggttcttgctggctgttggcaggggtcactctttcctggaggccactctcaggtccttgccacacggcctgctgcaccctatggcagtttgctcttctgaggccagaaggtcatctctctgacactgcacctgcttttaaaggcttcccttgatgagtcaggcccaccagggaagtctcccttttgatgaacacagagtcagctcattagtaacctaatcacaggcatgctatcccatcatattcactgctcccacccccccccccacctccaagcccaaaaggatgatacaaggggcataacaacgggggtgggcagatgtcctagggctatctaagaattctgcctgccactgtgttagatacttgcaggttgaactaatgaatgaaagcaagggaggaaggaaagaaagggaaataaattaaaagtcagctttgagttccgccgtggcagggctgatgcttcctgctcctttccttcctgcttcctgtgcatttgactgagtgagggtgggaggttggagggaccataagtgacttcagggaggcacctggttaatgccggagctcacacaggagaggcaaggaggtgggctgagcatacacagtgcagatgagatgggctcctcctgatgggtgggtcttcatgggaccagcatggaagattccagtcctcccacttaggttatttgatgatgatgatgatgttgatgttcccaactgcctgtctgattggtgtcaccaggttagaaggagggaacttcaagtccttttttctgtagaaccccacagccttgcaagccctgctagcgcagctgtgtttttagaagaccttgtggaggttgaaaaccagggtgttgccagtttcatgcagctttctggttgtgaacaagacttaccctgagagtggagtggagcgtggacgacaaacagaataattttacttacggagcctcaagttttagtaaaccaggaatctgaacattctttttgaaactaagggtagctagatagaagggtttttataaaagtagttttcttttgcacaatattgttttattccaaattatgcatttataagaggctgtaagacatggaatttctaataatcacaacgttatagtttaacattgtccctgaagcttggtgaagcattacgtcttcacttatgtgactaacctgtttagtcaattgccttgctaacccagcaccctgaaaggctccaccctgaagtggaggtgctgggtagagtgtttccatatcttcccagggttcggagacgtggagggcacaagtggccgatggccgggaagtcagaagaaggggaggaaagtggtttctgcagctctcctcctccctggtttctgcagctctcctccctggcttttgcattgccctgtgcttaaagtaggagtccaggagggaggaacacaatctgaagacaagcgtcctccaaacagggaaaaacatcataggaaagcttttcataaactcacaactgctgggacatggagagttgaggcacatgagacagctttggggaaaacatgcggaaataggaaacgctgtgttatcttaacaactcagtttgtcagccaggtttgtcttgttccgcacccgcagtccttgaggtatttcaagcatttggtcattctacccttgatggccttcaggaagtgcacagatgccagccgttgtatcacaaatgctaagggacctcactccaaggccaccacttggaaggttaaaatgaggatattttctatcagtcatagcaggaagagaaagtggaaaaactcgacgtttgtgataaaggacagggacctccttttgtgcgtgggaaattgaatccttgggtagcttgttggttacagtgtaactctagacttctgatggaccacctcatttgtggttgtcatactgacgatcagttttactaagtggcatactccagttttttatttaatgcagtctgctggggagtactttcttagttatctattgtgttctcagaactttgttcctctaagatttgtaggacatggcaaataaaagataccaccctttgaggaatttggttaggaaggaagacgtgagtttaggagacacatgtagagccccagagtgtttttcactaagtacaagtaggcagattatgttgtattagatatgatgcaattgcatcgggagggtttaagtaatctgatacggactcttaactcttaggttgtttactaatttagatataaaatttagggaaacaactttagcattgttctttagtctcaatggaaaggttatggtataagaatgttagcttttcagtgtaatgaaaaagtctcttatgagtaaaattagaatctagttttgctaatatcatacttgttgtatatttgatattcacagtgaggacagctcatcattaatgcttagccaagtattccattaatagatgcctatgagcatttgtatctgagcttttggggggattcagagggagggtgtgggggcctgtgtggagaggaggccagggagctgggcctgttcagggtttctcatgtccgatttcctagtagaggaaactgtacctccatctccaataaaggaaaaaagaaaaacaggtttgtttttattactgcctggttaggcttgggggaaatgatatttgtgtattttaatgcagtgttccacacctggagctccaattctgatgtgttttatggggcacagaatggacagaaatcaattcctggtacctgtgacaaagaaaaaaccatccagaattggagactgttccctgccgggggaacagccgcaaacatgtgagcctgtggttgacaaaagtacgtcatgcatttcagagtgcgtattaggaatcagaggacaaatggcttgagaatgtcacacagaaagtgcatagcataactgcagcagcacatgactgaatttcctgggcgcaaaagctgttgaggactgaaagtcactcagtagcccatctcgtgttttggatgcaattctttgaacttttagagtagcagattccatcagggaggccacatgtggatttaagcagataatttgtataggcacaaatcatatcattttgactaagttttttggaatgaaattgatatctgctttatcaccacttgtacttattggactattttggctttttagaaccttacttgttagaaaaaaaggctttctgttattaaggttgtttgaataggctgaagcaggagaatcgcttgaacccgagaggcggaggttgcagtgagccgagatcatgccactgcactccagcctgggtgacagagtgagactccatctcaaaaaaaaagaaaagaaaaaagaatataccaaattataattcatagagtcaagccatcctgatctcaggctgtgataaacaaaattaggcagagaattttaggtatgtgttcataaaatgaaagagactaaaatttaggagtatttattgaagctcagactatcctgcttatctcaaacatccctcatagtatttacatttgtaatattgattatgatatatatagatttatttaaaattaaaaataggtttaagatacaactaaaacacaccagggtatgtctgatctagaacaggagttgtctgttcataccctgatctagaacagggtatgtctgatctagaacaggctattaactttctgtaaatagccggataaatactttagtctctatctcagctactgagctctgcagttgtagtgggatggtggccacctagtagcatggacacagtacacataagatggcatggctgccttccagtgaaacttcatttacaaatgctgacagaggagagttggcctgcaggccctcctttgccacctgcagtactgttgtaaggcctggaggagaggggatcttttttctgtactactagtcagtgaaactgttaaacatgagcagtctctagaatctgtcctaggagtttaatttagagttggtgttatgtaatttgaccatttggaatagcccaggtaataatgccttttttgataggtttccctgtaccattaggaagacaacgttcaaggctgggtccaggtggttcttctctttggtgatagcagtgttgactctgttggaccaagctcccctatttatgatacattgtgtaacgctcattgtagtgtcctgaagtgtgattaacacatgctgaaaacacgaaaatagcgctttaactcacaaagaagaaatgaaaggaaatatcatttataaatacttatttaaatgtaggaatgcttaggtatgactgctaaaacagtggtaccgaaatgcaggtctgctatgagaatgtcatctctaaaccactcaacagctgccttctttgagtcagtcttgctgtgaaaaaagaaagaggtgcaaactccttctctaagcaccaggagatcctaatgaaggacttgtgaccagtctgcagatcacactttgaactccagaagttgtaacgtttgccagcgcttgcacgtagaatccccctgcacgggaggtccttagaggggtcctattggcaactcatatattatgagccactttgccactggtgacatgattttctgaagaggtggacagtttttggtacacttccaaactgaagtagagatttcctccacttatgtgatagttcctctcctgaaaaatattgtgtataaaacctgtgcccaaaaatgggtgaaatggagttgggtctatgctcaggatttttacttactggagaatgtctggaaattggaaagtcaggcaagatgtttgtgtgtgtgtgtgtgtgtgtgtgtgtgtgtgtgttgggtgatgaggggaggctgtcacacacaatgtctgtcccccatcattgtgacaactgcagatacccccacagatttccaaatataaaatgaaacaaaggagcatgcaggtgaggatctggggagagtggttacatgtggggatcatactttcctgtgctctcatagtgcagaggaaccgcagagggatgataaaagcagctgaactctctcctgtgcttcctcagaatttctgacttgttttccatgaatgtcttctcatatacatatatattcatttcttcctttttgcccccctcccctaatacggccccattttatttggtcatttctcctttgtatcattctctagggtaaattttctcatcttgctgtttcaagatattggtgagtcttaatcgttttgtaaggtgtgttgaaaataatttataccaattgtaattaaagcactggaaatgtgtagtgtactgtttctaatatcacttacttgcttattgattgttttttgagctggaaagtgatggagttatggcccctgcacatcttacttctgcgaatggggctactgttagtacctttcacataggggtgttggaggattaaatttgcaagttagtgcctgctgattacttgccaatgcctagttcttgtgtttagttctttaaatggtagacattacaaagacaggaaaaagaattcttgtctttgtttgctcttttaacaatccaaaggtttaggaatttactttgctctaacaaccctctcgatcctcttgtgaccccgttatactcagtgttgctgaaaaagtccattttaaaataatggcacctaccacatccatttttccgtctttaggccagaccctctgatggttggtggattttagtattaaagcttgtgttgaaagtggagggggtgttactactgttgtgtctgaaacaagagttaaggttatattttatgaagcagttttggctttttcaacagatgttggccactcacttttatggatttcacattgagtagtaatgagtcataatcactacttaattttcccaaaccagagggaatatacattttattattggaccctccaggctgtcaatgaagagagaaaacctttctttggaatcaagttgaaaacctgttgttaacacctctctctgggccttctttgctctccttagcacgttcattgctaggggctgccacttccatcttctctgccttggaagcatagagtcgtttctcagcctcattctcacctttatgagttcatttaataatgtgattagaacatataaagtatgcaagaataaaatgtgtcatgatgaccttaaaacttttattattcaaagttatagaaagttacgtattttattgtagactcataataggtgaacctttctgatcttggggatttcttgtatttccttggagagtcttacataggcataagccagtgactgattttttttttttttttgattgttttctcatactatcataggccatttgaggggaataaaacaaatactcgttgggaatctatatgtagaagatcattcaggcaaagattctggtcttaaaggtgttaaagtctactggagaacataaggacttaattataacagcagccacagcctccaccagcccctgtgataaaagcatactatgttatctcacttaatctttatgacagcccatggagggtaggtctcattatcttcatttttaatgctggagactgaagatgagagacctgtggttgcctaaggtcatatagctggtaggggcagagtttgtgtttttgccactgttcttgatagcatatttctgccatatgggggcttctcccggttccgtgagtgaggcatgccctcctgccatagcctccgttccttctgccttcaatgaatacaccttccataccactccccccaacccctcccattaaattctaatcatcatttaagtttcatctttggtggtcttaggtgtcactgttgcagacaggcatttttctggcccctgcaccagcttacagcacccccactccttgacctctataacgctcagctttatacttggttacgtttatggtgtttgttgctctgtttgtctggtgtcctggactctaagctccgcaagggcaggaattgtctggcatcattgctgcacatgacacctggtggatgtacatatttattaaatgaataaatgaatggatgttcatacttttgtccaccatgttttatgctaaatacacacagagtagataatgagagaggctctaatagcgaggtgtgtatcctttgagctatggatgacaaacttaaaaaattgcccattaagttagaaaagaattgagtatatctttttaatatatgtgtttacttaatgtacacgcatattgtaaaaatacatgatattggcattttaaaaaggatgaaaatatttaaaacaaggagtttctaatatgtttttctgtatgttagaggaccagctggtatccaggacccactaaacttggagctgggggtgccagggcaggccctgtgggaatacatgtaactaaacaagctccatggccacagtggaaccagactgcagttgatcaaagcatggttgagggtgggaagtgctgggctcatgcgagggtgtgtgagtgattgtgcatcaacatgaaggatcactgggggagtggtggggtgtaaggttcattggaagtctgggactcagctatgattgaggtcagatacctagttcaggggataagaccatatcatcttgaaatgatgggctgctgaagggtcttaaagaatcatgggtacagtggctcacggttttaatcccagcacttcgggaagccaaggcaagtggatcacttgagcccaggagttcgagaccagcctaggcaacatggcgagacctcgtctcttaaaaaaaaaaaaaaaaaaaaaaaattagcccggtgtggtggtgtgtgtctgtagtcccagctacttgggaggctgaagtgggaggactgcttgagcctgggaggcagaggttgcagtgagctaatatggcaccactgcattccagcctgggtgacagaatgagactctctgtcaaaagaaaaaaaaaggaatcatgtaactgtcctcccttctcctttagtaaatatttttccttcctttcttccttctcttattattatcttattaatacataccaaaacatgtatctcttattatttcacagtggcacactgaatctaaagtgatcctcctgcctcagcctcctacaggcatgggattccgggcatgcaccaccacgcctggctaattaaaaatatttttttgtagatatgagatctccctatgttgcccaggctattttttgttttgttttggttttgtgttttttgtttgtgtgttttgttttttgtttgttttgagtctcactttgtcacccagattagagtggagtagcacaattagagctcactgcagacttgaaatcctgggttcaagtgattctttcacctcagcctcctgagtagctgggattgcaggtgcataccaccacaaccagctaattaaaatttttgtatgtgtgtgtggagacagggtgtcactgtttcccaggctagtctcaaactcctggcctcaagtgatcctctcactcaggcctcccaaggtgctgagataggcatgagccaccatgtctggccttggttaagcttttttatcctataccagagacgtctaaaatatttacttcttgtcattattattgccaatgaggttcctgtacaaagacgatgttgactactttaggcccatagggagatagtggtagtttcagaggtagaatgaatggcagaggataaaaaagtacagttcagtggtgatagttggacaagctgggcagtggataggggtgccgggcagtagagaccttagaagcttgtggcaagaccagtgagttgaggaaatgctcctgcttttgctaatctgtgggtggggtggtagctgccctggcatttttaacattccctgttgttgagagatgggctaataatgctagtcagaagtctgatgtttgccggaggtagccccgtgagcaggttttgcaatctcagtagatacctgtgtgagggaaggtttacaccacaattgagttgggggaaatgttctgtgatctgtacttacagaagcaatattaaaaaattcatatttggtgtagtaaaggaataaaatagtgaaaattgtttctgttcctacatatacaagtaaagggaagccttgtaatgctttaatgattgcggattgtgatgcaaaatgtattagcctatttcacagaagcaaatatgtcaattaattaagagaaatgcctaaattgccacgtcagatcatttcacagaggtgtggaacatttaaaaagtactttatttgcaaaaagttctgaaatgacttattttaaaattttcatctaatctacaaaactagattattttcaaggaatgtctttagtccggaatgttaagaaaaaattgttttaagttaaaatgtattattttttcttttaaaatgttattttatttaaaaagtatataacaggtgttctactttgccctaaattatagtccagtaatttggaaattttgatctaaatattaacagaagctttaagaacatttgttctctttgaggaaaccctgacttagggaattaagagaaaaaatgccatctgtagaaaacaaaccaaagtaaaaacttgttaccctacccatcctggcataacttactcaaaatataagggaaacctaggaagtgtattttgctatttatgaaatatttcttttcagatttttttaatacttcagaagtatattctaagcattataatagtcaacttcattaatacaaactaatgtaaattccagaaataaagttaatgagatccaaacaaaaatttaggctctgggttgagtacagtaaatagcatgaagtcagaagacctgggtttgatgattgcttcctggctgtattttctctagtaagtcttctagtttcatgtttgacactggagtctctggtttctaaagtgtagacaataaatatgtctgtcatacaggatgggtttaggcatgaagtgagttaataaggcttgggaaaatagtttgaaaactgcaaaggtctatataaaatgtttgttgttacagttacaactactagcttttaatggtagaattttggttgttctgctaggtctgcggtggttgaattggacacagaatggaactacgctagacagatgagatctagggtgcccttacacccattcgaatccacaagcatgcatttgggaaacagttcatgggaaagttgtcacaagtttatggataggggatataggctttttgtggtttcactgataaaactgtacattttaatttttaattaaaaaaaattttttttattagagttggggtctcactgtgttgaccaggctggtctcgaactcctggcctcaagcaatctccttccattttggcctcccaaagtgcctggattacaggtgtgagccaccatgccccagccctataaaactgtacattttcgatgatacataaaacttataattgtagattcaagcaactcacatagttggttaaatagatcacctacttaacaaataatttgtggtagaaaccaagcttgtgttactgcactgttgatttctcagagtgaaagtccaaacgacctggaattgtggtttggcctgtgaggatgcagtaaaataaagcctccccaccccacccccagaacatcagaggtccccagaaaggaaaaatatgattaacggtattttcttcaaatgtgttaaaaattttagtgttttcattttttctatacagtgataaaaacattttatgaaaaaattgtcctgattattaaatcttaaatgttcctttttcagggcttagtcttacagtaaactacttgccatactgaaggtaatgaatacttaaataactatctttcttctcagtacaccaaacgtaactcttgggttcagaaatgatttacttaggatatatgcacttatttttctagaggagtacttcaccaaggtattaaacattgttaccattttagttactattgtatataccaaaactttgtgtggttttaggagagaagaagtaatcataccttatctacccaaaatggtttctccctcattcaatatatatgttttaaataaccaattactcttttgtgtggaatgtcttagtataataacatttccaaataacctgttttgtgtagcagctttattgaagtataattcatatagcatacaatttccccatttaagatatacagttctgtggcttttagtatattcacctacagagttgtgcagccatcatcgccagaaagaaaccccacagcccttacccttcacccctccagcctccccattccttccagtcccaagcaactaccaggtgactttctgtctcagtggctttgcctatgaaacaacctgtttttataacctgagagaggtatccacagggaagcttctcagcctctcctgttacactctgtgataacctggtgcacctttgtaagccgctgagagaggaatgggacctgcctgcttgtcagcattagagagttattctcccctttaaaggaagcaggagttattttgctttggtagtacaggttgagtatcacttatccaaaatgcttgggaccagaggggttgtgaatttccggtttttcttttagattttctttcagattttgaaatatgtgcaaatactccctgttgagtatcccagatctgaacatcagaaatctgaaatgcttcagtgaatattttctcttaagtgtcctgtcggcactcaaaatatttcagactttggagcattttagattttggacttttggatttgggacattcaacatgtaacttggtgttaatgcgattgtcagtacagtgatgaagaaatacaggggacagtgatattgtggggctgttgtgagtgtcgtgtgatggggcccgtaagaaatggcttgcatgttgccttgaacaccagagaatccggattcgtgaaggcaggatgacttggcatgtgtgtctgcttgctttggtggcacgctggagatgtttgggcacatgtgtcgtgcgcacacctgctgcggacagcagttgttgggtggaaatcaacagttgtagccttgacacagatggaagtgaatgtgaatacaattgaatatgaggcataaaaccctctacattgatcagcatggtgtttaaaatgccttaacgcccaggctcagccactttctctacctctaagtagatcttttgattgatagattcttagttcgccaataatattgatcaggctttgatagctaggttttgaaaagagaaacggttaccagctgagcccaaaactgcttgcttggttttaatttggaggttgctactatttgaggtagaattcatgactcatcaaattttcttctttcctctaacatttagcattattactctttgttggacaaatttaccttaagaatgttattctgagcagcttgtagtcactgcccatatcctgcctgttatccaccagaacatgtaggaattttcctttttactttttgtgaatttaagtgattataatatttagatgaagttagagatagtgaactttatacatgagaaagtaaagtttatgtcagttctctcgaaacagtgtacgtgtagttgattttagtaggaataaaagttagaaaaatgcacagagattttgttcttggagggatagggtcctggaggtgaactgactactgcatgctgggagggacttcctgcagctaagtgaagagaagcattccattgttttctttgatgctgatttgaatgtggtcattaatttgctcattattttaaaacatttatactgtcagtgctagggttttttccctcctgcatggtatggtgttaagtaaactcgaagccaagtatctgctgtcccatctttgtgccagagcattcgcagcctccagggctccaccagcccatgtgggccctcctgggtccctgtgggccccgtgcaccacctgtcatggattcctgccgctggtgcatgggacacccgaggagataaggggtatgaatctttcttctttatgttccatgcacatttaatagcagacgatattaaagagaattcagtgttaatgtaacttttcatatttcatctttttttctttaaataattcataaagtgctactttaagttaaaatcttacaatgtaggatcctattggatggttctttttaaagagaaaagtttggaaaggccctggtggggggtgcaactaaaatgttttccacttggtcttaaagagtgttgtgcagagctaagatgaacctgatttacatcccacatctttgccacctggctggctgccttgttaactgtgcaggttaattaatccttgcaaatctccattttctcatggaaaataagtataaaaacaggtacttcgtaggattaagggagatgccagcttgtatcactgcagtgaatggtgacgccgatgaggcttgtgctgttggacttatttttccatacacgatggtaagaggtgacgtataacctaagattgttggctctaggcttgagatgtgcccagggtgttttttatatgtagtcaacagagttcagaatattgaaaaattcaaatattaaaataccaggaataatttcagaatatataagtggtattctgacctgttatgctaaaatacttctttttgataggaagtctaaaaattatttctatcctagttagcagtaaggactcaacctcccctcccccccattcttagttcttatgtaagcgttcttgaaaatgtagttattcttccttctatacttagttgaaatgtatagaataagaattaaatgcagtgaatcaaatctgcagtgccagctttcttgtttccttggtgtctctactaacagaaatacgcaagcacagcaacatgggagaaatagcgttcatctccccaccctcacaaacccctagaggtgtcgtgcacgtaatgacttgtattcactgggcactccactgggtactgattccctgtttgatcctcgctgacctcatcagatgctgctgccccactttacaggtagggattctgaggcatggagtgttaacagcctgcccaaggtcacctagttgcagaactgaattctgatcagcttgagccaactctaaaaacccacattctttccactattgtctgcgttctcgttgcatggagggataatataggaacatgaatgactatgagatttagaacagaggcgcaaaattcacttcagcaatgaagaatgggtagggaactgtgtaggatctgaaaggagaacatttgtttttgatcactaggaaaggcttcatgaagtttgagatgcctttaacgaaggatgcttttcacgggagggaactgccatgggaggaggaggagtattttcttgatttaaaagtattcgtatataatttagaagttgtttcagggtaccctggttttctcatgtagatcatcccccaggtttccctgtctcttcagcggttctttcctaaattagcttttgcctgactttccttcctttgcaacctcagtttctgattttatgtctagtctgtgactaataagttttcaaatagtaataaaaagagttaaagggactcatacaggtttgtggaatgaggcttgagaaactaagtgaagcctgaagtttatttccttttatgaacacagtgtgcttacattggtttattttaacataaactatttctaaaaatggagtcagttattatctactaaatgcaatttggtagggagatttctttcaaatcatgagcttctcagtggggataaaggaagaaaagggggttctcagtggtgaaaagattgggaaggaccaatattcttatgtctgtgaaaatcactgtaaaatttgagctaagctgttaccctgaagctgttttcccgttcttttacatcacagcagattttcattcttctcctctttcccttgtggtgaacagttgcatttaagcattatcagcattaaaaacatatttgggatgaaatctaagccaagcatctgttaaccagtcagccactttccaaaaccctttcagctgcagggagtgggtatgattccatggggtgtgagtctgacatcagaagacttgctgccttctccagagagatggcatccttttgtagattttcagacaagacggactacttacatttcactgaaggtgaaaagttctaaacaagacctcaattgtcaatattacattttgcaaatctactaattggtttatatttgaaaggatatgaaatttgggtgttcccccccaccccttttttaactattgagatggtattcattaaaactgttggcaaaacctgttttggaattaatatggtaaaagattgaagttttacattattttcttttgaatcgtgaaataagtttttaagagaagttcttgggtccctagaatgagtcattaaaatactggtgaggttttttagggaaatagcattgtatgtcaatacgttgaaagaaacaaaaatgctactttgattctcttttttatttatcagtgttagaattaaggcttttaaaatcctactgactttgtttttggtgaagacttgctaaaacaatttgagttttcttcaaagaaggatgttttccaaataccttttttcccatatgaactacaagtatagacattttggggggccttcctcatatatattcaaatttatagttattgtgttctatgagtatcatgaatctgcctgatgatttcataataggaaattgaatgacactgatttggggaaatgaggtagaaattatgggttaggcagaagcttctgtaatctgttagtaattgtttggtaagatcatacaatttgtacatagtaaagcaagctagtgaattaagcttttcgttatcagatgctatgggagtggtctgagaagggagtaatagagtaagctgttggtttctgcttaagactaaaacatgtgctttaaaaatgttcttaaaaccctttatttaattgaaacttgattcctactataggctaaattttatattgttgtggatatagaggcattgtcagctctaaaactctgattttaggatgcttcatattttatattatttaaaatagcacaattttcaagaaggcaaaacagtagcaattcaaacatggatttgttcactttgggttcttgtttcttctgtcttcccccagacactctataattggatttgcttctaggtttacatgttaggatataccagttagattagcagtacagcctgtcggtgccaaagatgtgggacaaattatattccattgcaagcttagaacatttttttttgtagcagttcaatacacttgagtgctatgatttttgaagttaaaagtaaattgtattattccaacgacactgtaaatattaattacactgatcatagtcactaatggtgtttgccatgtgccgggcactggtcaaaactcttgcctgtatcaactctcatccttactacagtgctagtagatgtgcatattattttacagatgtggagacagagatatggaaaagttaaataacttatccaaggccacatacctgccaagtggcagagacaggcctggaatccaagcagggaggccttgcttctgtgctcttagcctctggactactgcagtctacttcatgttttccgttgactaacagaaagctcttttctccatttctttactgtggcctcagatatgaatgtatgtattatatgtatataataaagacatgctaaatcatcttaacctacaaatctgagtgcagaataaagatcatttctgtgaaacacaaaagataccaatcttatacaaatcagggctcttgtcaattcttatgattaaaatattattaaaattgatagacttttttctttggggatcctcacaagaagaaaatagtgttgcctaccaggcataaaggagttctggttttgtatccatactggttcacaaatgactatcaggaggaaaagatggtaacatgctccccactgcccccttttgagacaaggtctcactgtgtcacccaggctggagtacggtggcaggatcatgggtcatcgtagcctccgcctgctgtgctcaagcagtcctcccacctcagcctcccgagtagctgggactgcaggcgtgccaccatgcctgcctaatcttttaaaacattttttttacagagatgaggtctcactgtgttgttcaggctattcgggctttttgatctattatttgattgctccaagtcagccagcccttatattcccactctactctgcattgttggaggataaaccagaaatgggaaacacaggccctgccttctctaaatccctctctactccggaaggtaaattgcaggtgagctttgggataccttgctcgggcagagggaacagacacatgcagtggttggcggcccagccagggggtctcttctctcacagccacatctgcaaagacagcagggcttggttggagactttatcaggcccctcagtgtgaagagctcaggaggagctcagtcttgtgttgaagccagtgaagaattccgggcactcccattactgctatggctctttcctgctgcttctgtgtcccctctccggctcctgggattttgggtgtgtccatgtcctggtccctgcctctgctgttactcccccctccctctccattcgtgtgtaccctgccttttctctcaatgttttgctcgcaacttagacatgaaatgttttttttttttaagttagatttaaatttgattaaagattatattccttaatgcaagtaaaattccacccctcctcccaattcagttgtttctagcttagagtccttggctgatctttatgtctatggtacttaaattaagtttccatgtatctgttataatggtaacttttattatgagagtctcttcaaataattagaaaatgatttttggaaaggtgtatgtcaaatagaggtcataatgacaaaacataatatcttataatgaatgtaatattctggactaaaaaaaaattattccataggagggtataagccaaactagtttttccccagcatttgttttcctcatacatttataaggaaaacatatgggatagaaataattaggtgcattaaaagaccatattgactttctgtgttagcattttttctttaattgtgtacatttttcatgagtttttgtctagtatgatccatttttggtataggcatgccaatagcctagagcttttaattcatcaaagagagggtatttctagaaaaatagcaaaggcctcataggagcctaccacttgctgttcagcaaactagctagtacaataacagcgccatatgcagggccatgcctggcagaagggctcctcttagggaggagtgactcaggtcctgcagccaggacctgcttggctgtgcagctcagccgctgctgaccaaggggaggcaatttagcattttacacttcgggtgcgttgcttaaaataaggaaagtaaaacatcatggaacgttttgaggtctttgggtagcacactttaacatagggattgatcttttaggttcatgaaggtagatcttaataacttaaaattataatctgtttttcacaaagatatttacaatgttgtattatattttgcatttgaagttgccagtttcgggaatgcactttgaagttgtaatttcctgtttaatttatgatatttaatatagaaatgcataggatttctgaatgatggtttggcattgtctgctgtaaatggggcaaatatcatggaagaggctatctttgaagctatagagaatgtagaaatcagatgctttcttttgagactattaaagatactgggttttcatagtagtatgtagaatacttaaaagcaccttatggccagtttttccaaattggttatttacattctagaatatgatttttctgtagaattgttatctgtatggctgggctctcaggccagccctagaaattgtcttgtcctataatgttgctgaactgcagtactaagaatgtcagagaaaataagcattaatcattaaaataaatttgaaattctgctgagcttatgggaccatgtttgactcctcaccgtagcccacagcggcaagaagcagcacctgggaactccacgttccactccttgccgtcagcctggattgcagcgggtccttggtgtattcaggtggcatctgtgaggattgggtcaggctcatacagggaggctgcagttgctggagcagggagcacagggtaaatgaggtttggggtctgtgagaggcataggcagagggggtgggctgcaagggcagctaggggaggtatagccccaggaaaagagagtctgagacaggcccagggggatgcagctccgagttaagtacttgaacatcgggagctatgcatcccacagttctctacagcaaacagtaaaatattactgacagacttgggaaaagccagcgagtcttttgagtcaatgaaaagatagcatttgctgtgatcagcttctctaatattgttcctctgtaagggtttcactgttctcaactttgaacatccactcgccgttctgtggtatatccatttgtccctagtatttaaattaggttattgtaaaagctcctttgcacctgttgaaaatgctggcacagtttctccattagtaaaccctagaaatctgagctctctttcactgaagtttcttatttcaactggaacattcttcttgaatgtgtgtgataggatcagtgtacggttttcaaatggttcagtctttctgcaaccacaaagtttcttattcaggggagtgcttgcagttctcttcattcccctcctccacttgtagatgaagaaaagaaaggcttatattatttttgaggcagctgctaacaaaaaacttggtttcttgagagctgtgcttgtcattgcttaaagatagtgtatgtcagaccaagctggtgacagttctgcgctactgaattggagatgcctcggcgtggagagtcttgtctgcagatcagtggcctttgcaatagacacactcttcttgaccgtttttgcaccgagtggactgattgtaaggctgtctccacctgtgcacacagaggtccctgagaagaacacggggcaaatgaagggcaggcgtagatattctggcccgtgccacagatccagaatagctggtgaccctggtgtgctgccaccatttccggccaggaatttggccttcctaaagcacagtttgccaggtgatgtccgttccaggtaaatgacacaggcaatggaattagaagcctattagggtgttgaatatttttgatgtctattccatttaggacaagattgaagcctcctaggttagagtgtacattcaacattgcttattattctgggagtaactcccggttaacgatataaggggaaaaacactcattatccattcccttgatttacttaaatccctgataaattttacttcccctctcaccttaaaccatttcttctatctgataaacagctacagtttcgttgtatcctttgaaacaatttaaatcagaaggtgaaagttcaaaataatgccttttaaagatagaaaataaaacataattataagatcaacagtattaaatttctgctacttcatttttcttaaatttaaaacttgatttactagctgttaaactagggggaactctggggtttaacatcattgagggctgggaggtacatgtgtttgtggaacttcgttaatattttaaaataccaagtccatgaataaagtcacataacctctttactggaacttggaaagcgcagccaggaataggcttcactttccctgtctgtctctgctcttggtcgcttctcaggcagaccctgtggctgtcacttctcttttggatattggaacagtcagtgctgtaggcattaagagcccaagccagtctcaaccggaatgtcactctttcacccactggaagccctcttcttcccagctgaggcctgccccctttctgtgggccagcctcagggaaggggctgtatttcttctgtttccctctccagtcacccctcgcctcctgttccctgtggcttctccatctgggggctagggacaaggaagaaggaaaagggtaacactcttttgactcagccattccctgccattctgttgtgctctgcttctgtctctgcacctgtctctcggattcttcggagacaccccccacaccacctcctggaatgttccttggcatggtggtgcccactcctggccaccttcacaactccccttcagagtgcaccctggaggtgctcccctctccaccctgctcactgagtccctttgccttgcaggcagtcctcctggcctcgctccttggtgtttctctgtccacaccagcaatgtgtgtcctcccaaactacaggtagcaggccaccgctgtctgtccaccccccacctcccccttccccacagctcagcccgctgagcaagggctggcacctgcattgtgcaggcctggtggcccctcagtgagcctcgtgtgctttcttcacgttggtgttagcctgtgtggtcccttccctctgctgccctcggctggagcctgggccaagtcaagacatggaaatgtcctgtcactgtcacaactgggtattggatgctgtaatccattgttgtgatgtgtggatgtaaacttcagaattaggggaagattagcctgaactatgaaacatgttaatatgcatttcagttatttccaaatgtagaaatatacttttaaatgagggtttcagctttaaatgaagtcttactaattcgtatatcctattatggtaagatataaaagtcttttaaggaatatgttcttttagattaactcaagacttgaagtgatgttgaagaaactcttgatcatttgaaccctgtttgggaaactttactgaattttatggtagattccttgtaggacacatacatatttgattggtatatgtcatataagattttgcattatattgcacttaaaataggtgttaattttgttttaggatgttatagtctgtgctaagaagagcatgctattttgacaataaagttgataagttggaatacatgggcttagatatataaattaaatatagagagggaagcagaagaaatatagaccactaggcagggcacggtggctcacagctgtaatcccagcactttgagaggccgagacaggcagatcacgaggtcaggagttcaagaccagcctggccaatatggtgaaaccccatctctactaaacatacaaaaattagctgggcacagtggcttgtgcctgtagtcccagctacttgggaggctgaggcagaagaatggcttgaacctgggaggtggaggttgcagtgagccgagattgcgccactgcactccaccctgggcaacagagcgagactccgtctcaaaaaaaaaaaaaaaagaaaatatagaccactgccccttctttgcagctggggttattagcttatgactgtgggatgtttcaatgggtcttgtacctcatggtatattaggaaatcatagagttagaacttggtaatgcaccaagttaaaataatcaaaattagattttgaaggaatcattctttaatgttattaccttcccacttaaaaaattacaaatggaatgtcaaaccttaggcattaggtaactgaaatcttatagcatacccttctgttcagacacttgctcttgcgaagtgtgttgaatgcattttagtaacatccactgccaatttaaagtgacattgagtagattaggaaagtaaaataaagtgatttgatccattcgttacttgaatggttaattttatgttgactgtgtggattaaatacacccggggccccaggcagtgtccctgcacctgctgccgtaggtgagggggacaaggcctgcctggaacagaaggcagctcagggcctgggagtcagtttcctgaggggagccccttgcaagcgccgtccacacagggcccccaagtgctgcccacctatcttgttcatcctccctcgctgtcaggaactgctaccctgggctgtgctttggaacaggtcatcagagctgacattggtggacactgttggtgtgtgctacagtggtgctcagtgctttacagacttctcctgtaatcctcagagcaagcccaccaataagaaattctgatccccatattatgggcaatggctccaaagctctaaggagtgtattaacttggacgtggtacttctggggtttgattccaagcctggctgacttcctgacggtggtgatctctctcaccagactgagagccctcaaaaaagatttgctgagcttctgtccaggtgaggtgctatgctcaacacaggggtccaggtgagctagatgtacatagttcctgcctgaggtgcccataggctgagaatagacgggcagtcttggcagtgctaaccttggctggaggcagactgacttgtcggtttttcagaggtagatgcatggcttctcctatgaaggaaaacagtggaaatgtacaagagaaatagaaatggagtcttgttggtaaaacagatttggaaaggttgaaaatgatttctgatttagttgatttctgagttccagagccatcctgaaattctgtggtgcgggagattgttggtaggaagctgatgagagcccgcccatggttaggcttgcccatttgttactacccatcactccaggcaaatgccagtttacagagtgagtggagtgggggagggagggaggcaccatcattacttcagcttgaaagatagctgaactttctggactttcgaggggggaattgccaatggagaatgggttcatgtggttcaggcttcatttgttcctttatgtgagtttaatttgcatgtgttgaggttaagcagctggtccgaccccttggcataaacaccttgttggatggtgagatggagagcagctataaagggcaggcatgtttacttgcaggacacattttgtgagcaggtttcttggtgataacgtcattctgagctgatgcctgccttgctggtttaatagaattatgtaaaaatgagcagaacagcattctggacccagtgacagccctgcatgaggattggtttaaaaacctgcatcctcaagctgcctgacacccagagcagcttcatttgatggtgggagagaacatggagacaaagtataaatcacccaccctcagaatggaaagctgtgatctggaatgagaatgcatgttctgctgattttcataccaagttcataaaaagaccaattttccccctttccactttagcaattatcctgttaaacagtgtgctcgaaaaggcacagggaaatgacaaataagaatttgttagagaagtccaggctgcttgattgtctcatcttttggagcatgttttatttttgacacaaaggagaaataagggcaatttacaccgacagaaactgcagccctctgtagcgcagccctgtgaggtgctttagccagtgagcagttgctcctcccacagttcatctttgcacaaaggagatgatgtaatccctttagctgccggccacgtggccagcatgccgtcactgtcttgacgatacctctgagccacctctgcgctgccagcagtttatcggctcagagcgactgtgcgtttgtaattaaattgcgttttccttgcatgcctgctccccctggccagggctgtccctcacctgggtaggcctgttaatgagggtagtgtgtggctggctttacagctgaactgcagtgggagcttttatgcagaaaaatgaccagagtagcctcttgtacagcgctatggagcctctccgtatgcccacaaattagcactaggggaggagatgctctgttgccattagtaaccgcttgcctatttattaggggagtaaaaagctcaaagcttgggcttttccctcccttgccctgctttcccatgagttctgagagcacccgagcctgtacactcgagagggatggagaggctgtactgtgttcagctgtgtgtacatagaagcacatccttttcaaggaaaactgaatcctcctatggtgctgttttttggttgtgcctttctccgtggtcaccattgcatcctgtttgattgagggcagtttgatttaatagctgccatgaattgtgcccagatttgctcaggtgaattaaacactttacacgcattttctcactgaattctccagcagccttttgaaatacatggcttaacagaggaggaagctgcggccaggagaggtgaaatgatttgctcaggcccttccatgtcagaaaagggaacacacagaagacagaggagggggcgaggggaaccctttgaatttgatccccattatttttttctttaaagaaaacatgagatttggggtagggggtgtgagccctcagccactgaggcttgatgaggccaggacagctttctgctcttggtcctggctttcttggggttggtattatggtgatcaggtgctactacatgtcagatacaagaagttacaaggtttccttgatttcatagttgatgattttaaaagtgaaactgtcttgattgtattagtagaacctcttaggaacacaatggaatggcccaggcttctggccctatgcctctagggactctcagttaaactgtgtccctactgattttgatcagcactcacgggcagcacgtaacctgacagagcctaactcctgtataattaaaaatcatggcacccaaatccgagattcttaaactaccatggtctttggagaatttggagatggagtgaactggagatggcaaggaacacttgttggtgctgccgtcttggcgctgggcctgtgcatctgttcctccctctccacagccacctgcagccttggggcaccagaggctgggcagcctctttgaaaaggcccctctttctccctctggacagcataggctcctcactgactgggtgcagggggagaagaggtggggcgtcttttcgtttattgagccttcacccttgctcacctcgaagctaccctgggaggtgggaacaattggggccttgaattcacctgcagagggaaggtgtgaggatgggggtggcctaagtaacagatgaagcaggtgtcaacagaagccatgggatcaggaacagattatttgagaaagactgcatctgttttctctctacaacctgagaggaggctgaggtagaggtgactggatgtgactacatttgaccaacttttgaaatgacagcagagccttaccagatggttttgaaagaggcaacttaaaaaaaaaaaaaaaagcccttcccaagctgtggtacctccttaaccagatgctgtaaaatatgacattgaaacaatcagtttggctttgtttatacttgtttacagaaggaaaaggttactttcttactgtaaactcactcctggcaattttgtgccttgttcaagattttgtctcattaaaaattaagcatcttttatgtaagactctttgcagagacttcagtatgtcaaggcctttgctttacgtgccatgtctgttgatagatccagttgcttttccttcctgataattctacatcgattccttgctcactctctatccagctgtggcctcaccgagcacctggccaccatactagacttcctgcctgcaggcttgccaccttcttggtgattttcagggtagctgctcaaccacgtttactgttaggtgcccactgagaggcagcccttgtaactggcctgccacaggatgtcagagtggcaggaatgccccagcaggttgaactcacattctacaacaggtcttacctggatccccgagggacttcatctgtgtcctttttaaatggtacctgtgctttctgttgctgcttctcataaaaagaacaaaagattgcaggagagcccaggaaacaattaaaaccatccctgagacatctcctttcaaactgacctttctagatccgaattactccctttaaatggggttacttgtatataaaccaggaatacagatttttatttttaaaccagagggcatcatccctctgaggcagcctggccccgagccttctgcagctcactccaggagagagggacgaggttgtgcagccttcctgcctccctaggtgccattcattgagggagaggttgaggggagtggaagcaggcaaaccatgggggagctgaccccagggcacacccagcaagactggcttgtatacttggggctcctggactgcagtaccgccatgcacactgctatcatttcgcctcactggggcagcctggccccaaaattacaattagccattcatttaaccagggaaataccttctgtgtcagcacagtttttagccactgatgcaagtgactctgatcatatcactgttactccagcagtagtcaagacaaactctgctcaagaaaaggaaatgctgatttcaaagaggacaggagtgctgcacttgccacatgcaccacggtcttctgggtatgggaagaaaatagaaaaatcttttaagaaatacttatttatggcttatttttaaatgcctatttaggggtatgtgtcactgcatacatactttactagtacagaatagtacgtgtgtaatttaggattgaaggtatgtagtgaaattctttagtgataggattttatttatgtatttatttttgagacatctctcgccctgtcacccaggttggagtgcagtggcatgatcttggtgcgctgcaccctctgcctcctgggctcaagtgatcctcctgcctcagcctgagtagctgggaccacaggtcccggctgatttctttttttttgtggagacagggtttcgccatgctgcccaggctggtcttgaactcctgagctcaggtgatctgcccgccttggcctctcagagtgctgggattgattacgggcatgaactcccgcacctggccagtgctgggattcttgatcaaaagtgtttgaagactatgcccttaaagcggcaattctcaaagtgtggtcccagggaccccttgggttccctaagacctttgtagggaatctctgagttaaaactattttcacaacagggaaataaagtcttagctatttctcactctcattctctccaaagtgtatgctgaagtcttccagaggctacctgacatgtgacatcacaacagattaaagacagaaacataagtgagagttaagatgagttctcttaaaccacacattaaaggaagtctcaaaagtgtgaaacagcgctggccttctttctgatttttttttttggaaaaagtattttatgttaatatgtaatgaatttattattttgaagatattatttcaaaaattctctcagatttaatttctaatatggtaaatacccatatatctgagatatctagatattaggtggacagaatagtaaagtaagtaataaatagaacccacgtaatgcagaagctccttggagtcctcaatagttctccccccctccccccgcctgagacggagtcttgctttgtcacccaggctggagtgcgatggcatgatatcggctcactgcagcctccgcctcccaggttcaagcaattcccctgcctcaacctcccaagtagctgggattacaggcgcccggctaatttttgtatttttagtagagacggggtttcaccatgttggccaggttggtctcaaactccaggatcctcagtagtttttaagaggtataaaggagtcttgggcttcaaaccctcagaaactgcttgctgcatggaggaccatgatcgccttgtctggttagtgcattccagcaatgtgccatgtgaggcgcctggaaaggaaggatacaggaagtggggagccctgtggatggccaggccatctttctaccgttggtcttggctctgttctcccgcgagaaaggcaggaaggtttttggtctccaccctcctcctcctgtttcttctccaaccacaccagtagcataagtgggttattgtatatgaaataggctttggtgggctcctctcggaccctcatagcaacctgtagcattatttctacgggaaaatatattttttaaattgagaaacagcagtcttcttaacaaagttttggaacccagaccacttggaggttggagactgagtttatgggcaggtctccccagcagttcctttttggcacttacttgtagggaatcttaaatgggaggaactattagaggaattcagttgagacataaatagaaagggaaacaatggggtatcctgttcttttagtctcacacttttaaagcaaaatatgaaaatctagtttattgttttattggttcagagagtttagaatccaaaattgatttcagattaatctcttgtccactaatatgcctgtttctgtattcttcaactcatttggtaaaaggtagcagcaaatggttgcatccttaaatacatagactggtctgacggacaatacaagctttaaagaggatgtggaatacaaccctttgggaaaacagtttgatattaattcataaacttgggaaagtgcgtaaacggtaagccagccatttaaccctgacatatctctaggcgtagagatccactggccttgggttctcgggtagtggatggggctgttcatggcagcattatttgtaatagcaaaaatgagagacaaaacaaatgttcacttacaagattgccaaaataagttcaagttgtagtcatcaaatggaacactatgcaacagtgaaattgtattaaataaaactcagcacgcacatcaatgtagatgagtcatgcaaactggaggcaagtcacgggagaacgcaagtacagttccagcgtccctcctctgaaatgctgggcaccagaagtgttttggatttcagatatttttggattttggaatatttgcatatacaaaatgagacatctcgaggatgagactcaagaccaaacacagaattcatttgtgttttgtatataccttatacacataacctgaaggtaattttatacaatattttaaataattttgtacataaagttttgatgtgctttgattgagacctgtcacattaggtcaggtgtggaattttccacttgtggtagagtcatgttggtgttcaaagactttaggaatttggagcatttctgattttctgattagaggtgttcagcctgtagcatgattgcatttatataaagctcaaaaataagcaacacagcaatatattgtatactaataggttaggtttgtaaatggcaaaactgtaaagaaaaataaggactgaatgacatactagtctgttcttttgttgctataaagaaatattggagactgtgtaatttataaggaaaagaggtttattttggctcattgttctgcaggctgtgtaggaagcactgtgccaggatctgcttttggtgagggcctcaggaagcttccacttgtggctgaaggtgaagggggaactagtgtctcacatggtgaaagagaagagagagaagtgggaggtgctactctctttgaaacaaccaggtttcacatgaaccaagtgagaactcacaaagacagcaccaagacattcatgagggatccacccccatgactcaaacacctcccaccacgccccacctccagcatgggaggtcacatttcaacacgagatttggagggaacaaaacatccaaactatatcaaatggttatgcagaaagtccgcatagtggttacgtctagagccagggaggtgtgtgcaatcagggaggggcatggggaaggcttctaggggagtgtcagtgttctggttcttaaaccggatagtggtttcaaacatatgtaataaatatacacaccttcttacaggtcacatcaattctcttccaagtctggggactattttgctgagactttcattttagtagctgaaagaattagaaggattgattaaaaagcctttttgttttaccataaagtgagtaattgaatatttaaaaccaccaggccccttagaagttatttactataatggcaactgcccgtcctcctcctgtttggaggttttgaaggtgttacagtgttttggtcgcagagttgactgatgatatcgtactgtgagctttcacaaaaccatctggcctggcttttgcaagaataaagaaggaaaacttagtgtggcttttcattactttaaacaaatgagttcagcctttagcatagtgggccaagggtgtggcaccaagggcagtgtgtgtacaaaggctggcatctttgtctgtgtgtccagtcactgttccctgtggtgtttgcctctgtgccaaagtagagtgggaagatcctgtttatttttgattatctgttaaaatgagagatgtttgcctattgaaaagggagcccaaaggtggaagccgaagatgggaggagaatgaggtctgtctgtgcctctggcgacctcctgctgtccagtcgcggctttccgccctcttgccctctggacaccagacaggctcctgcaggcacctccaccagatccaggggccactagcaagggtgaggccgcagctgcaaagcgttgtgatagcattcactctcacctgtcccacctccatcctttaagggagacacggaattcttagcacaagtaacaagatgcagaaagatagacaggttaatcgaagcttttgttgtcaccatttgggagagaggtagttagtagtctcttccaggaaaaaaaaaaaattttgctcacgtggtttttttggctcatgtgtttccatttctggttgtattctggctggcccttttcacagccaggagcaaggctgagcaggaccctgagagtgctcaggtgcttgtggggtggggaagggggacagacggggcgtgggaaagatcttcccgagtggcttgactttcccattgccttatagttccttaaattatttatagtccacctgggagaagttatggagaaattatttatagtcaggttaatttactatgattgtgtggatttttaaaaatatgtctatttgttagtggctttttaacaataattacatgtctcagtctgttcttttagttttaagtaaagatgtctgtcttaacagaatacaataattttaggtaaatgggcaaaaattcccaaaattcagttatttaaagcacttaccaaacttgtacagctaagtttcagatattaatactttaatactgttacaactgctactgttagcatttgttagtgagttctgtgagctgtgattctcaggctgtccatttcacagacgaggaagcgaagctttggagagactaggtaactgcccacagtcaccccccctgggaggtggcaagcccaggctcctaactagacacctaagtaactgttgacacaaaatttcgttttgagttgtggcaccattgtggtttgcagccgatgtacttaacacttgtaatgctagtgaagtgcagctttgcctgtccccacagcgagcgtgctcctgaatcctctccacacctcatccccatgtgtgtagctcccttttaaggtggctgcttgtaaccctgtgtcatttcctctgctggatcccagctcctggggcagcaggcaccctgaggtctccctgcagggtactggaatgatgctgtaggtgcagagagttggccggtgagggagtgccacacaccttatttaaatgtccttactgcactgccgtttttattactatactaagtttaatttggaaaacgatgttccctgtgctttttagtagataagatactgagatgtcctgtcaggagtgtagcaattaggagactggaaaaaggaaaacagattccccagcctacaagacgttcagctttgcagagtcttttaggatcttaccccactcagattgggcactgcagggcaggtgtctaaagatatgaaactgcggaagagcttcgtctgcctctcaccttctacctccccagtatttattgagggccgcccagtagcaagcaggaggaggccctgtggccccagtaccagcccagttgcctctagccatcccagcctcctgctccacagcagtggcccagggggataatgagtgagatggtcacacagttggagctgcttctgtgggaactttttgtgatcactggattagctgtgccgtgtcatttcaagacagtggaagcagatgagggctgcagtcctgctgggtggtgggctgcagggcactgatgcgcagtcctctgagcctgtgctgccttcgagttcctaagtaccaacctcccctgaggtaatccaagggaggagacgccaccaggccacaagtgagctggtcgtttcctcaagctcacttgcgtctccaagcagtgatttccttctgaggcttccctctgccgggtcctggagggtcctcacgcctccagcggtcactttcggttttagtgtgtgtgtttgcatcgttctgttgatcagtgaatgtgtttgaatatgtatacagatgccaagagagaggtgagtccatcacagcaaatctgtttctgtgtcaaaatttgttttcccatcagtatatttaaattatttggcttaataaacacatttttaaccagaatgaaaaaaaaccaaaaacccaccactcaccttttgtctgtatgcagaaggtaatttgaggggaaaggggtaggaggagaagaattgaaatgaatttctcttttctctttgttttctgcgttagcagatgcattacttttctcaaccctctttgtaatttcttaaatttctcattagcaattcagtaggagggtaaataataggggcctatctaccagaattctttttctgcttgagaaaagagggtgtagggcaggacagcagcacctgagtcaatatgagcaaaagccagtggttgccagcatcagtataatcctgagacagttggacaggtatggcctctgggttaacatacttgttgagcagtcaaatctttttacaacaaatagaaggatctggaagaaaacttccaaattaactgtagattgcatgctgaattcagcctaaaaacaagttacaaagtgccaggttttttgttttttttttgagttgtcataatagtaacaggattgctcttacgggggttcttagactgctacaaggctgtctggcctctgcaggtcaataaacatctaaagagcaggacttggctggcctctgatcggatgaatcctcagagcatcagatgtattgcaaattacattcagagaagaaggaacaaagctgtcaaagcaaagtagattaactgaagtaacttaggcaaggcagtttatatgtgagctataatatgggtttctaatattagaacatcacagtattaatctttgaacatgttacttacgttattattcactaatgggctttgtgtttctaatctccacagcaagcgtttccaaccctttcagaatggtctggaacaccttttttatgttaaggacttatttttagtgtcagcgatagatacagcatttcaatgaaaagtaacacttttaaatggatttgtctaattaataataacagtatctatatctctttacacataacagtgtgttttggaagacatatttgtcagctcttactgtttacacagttaaggctacggttagtgtaatgtgtgttttattttgttttagagtataagcttcttaaaatcaggaacatgccatttaggggaaaaatctctggggtttaagagagtaccatgcataaatatgtattttatgaatgccaagcgattaaacacaattctaagctttatcaagggactgactggcagaaagttttgccaaattctttgatgttattaaagatttatttttgtactgagtttcatgttagaatcaaatccatgcttactgaagtggaaataacttttcaaaccttcagttaaaaattctgatgtttgtttgtggcatttactttatattctatattaataggagtaaatgaattaatgggatttttgcagtgggcatggacctaaagtatcttaacgttgtggagtacattagggaaactttggtattttaaatgtgtaatttagtaactctgaatactgtattttaaattcaacataattacaggtcactcagattaattgatagcttgttcagacactcagctttggtgtatgttttccccagggctggaaaatgaatcaacacagaatactggagtagaggggattggtaggcatttgttggtgagcaaggcccctggatgaggattgcggcttcagtgactagtacctgcacctaccccctccttaaacccttttttgtttatctgtggaggaaacattcattcagaatcagaacctttgagttttagggccggcaggaggtaaggctggggtagaggctactcatgtggagataagctagaataagccaaattttaaacccaaatcgtggttcagtgctgggaattcagttcctttttcttctggaaatgtatagactgtctggaacgctttggcttggcctacctgttgtatagtgtttgttgtgtacccttcgtactcacagtgagtcccaggcaggatttcgtgggtaaagtagtacagatgttctgaggagttacagtttgtgctgggaggcctcacagaggcttaacttgtgttcagttaatgtggcagcaaatggagtcacgtgagccctcagtaggctgcctccagccagccttatgaggctgagggacctgagacagcagtgtgggctaacattcagaagaacaaaggcggatgctcagctttgaggtgtgtagagttgacttggcttgctgcttccatcatgcttggtctgtttacaaaatctcataatgaaaacatttcagtgtcacgttaaattcttgggggaaaagcccactgactgcagagaagcagagctgtgaggctctgtgtttcctgcttagacaccacttccctgaaggcttgcgtttcctttggttgtggaggtgctggaacgacaagcctcccagttcacttcttccaaagcagagtctcctctttccatcagagaagattggtttgtttctttggtttgggcagataacttctaaattacgttgtaaaaacttaaggtaaaaacccttttctcctttaaaatatagattgattatatgtaaatgtgattttatgtactaatcagtcaccaaatatactagacagagaatgaatggagtcactttagcttttcaaaggagtttttatagccagttgcatgcgttggagctgtcgctattgctctgtgcctagatggatactctgcccagaactgcgaattgtagagtaccacgtgtttgctatcttgaggtttaactagctgggtgttaagttcatgctctgcgccatggcagtctgctcagtgagactgccatgcagtgggactcagcatagcccctttcctttaggagcccagctgctaataggaacaccgagaagtcttttgatatttcccctgcagtgcgataaggatttggggtgttgtgggagtgcatcttggcggtgtctagttgagcagtggggactccagactgggggcaggtgaagaagaggtgtgtgttgggggcggggaggggaaggcatgtgtatggaggtacagtggtgagggggaggtgtggcttccctgcaggtaattgcagttcctggagtgagcctggggagatggtaatgatgaaccaatgaggttgtggaggcagcatacatcagatcatgagggactgtagttgcgggcaccaagaaaccattgaagaattttaggggagtaaaatgatgagatatttgtttgagaaacatgctagggagagtggcagaatgcattcgagggaattaagaacatctattaggagatcgctggaatagcacatgagggcaatgctggcagagacaggggtgcttcatgggactgtggagtccctacaactccttgtttcatggaggtaggggatgggagagaggatggagggcagggagaagcctggttcctggtttggccacgaggtcgatggtttatgaggcaggtactgttctgggacctacactgtggggagcaggtttgtgggcatgagcatgaggcagggttggatgttcaggggggcatggctatcctataggcatgtgggtgcctcttcttcatggcacttctttgttccagtgatggacagtttcctacctatcagtcaaaacccactataatagcccaccccacccctgctttcttctcttccatgaatgttttgtgtttttgtttgtctacatctattgatgctgcttgctctggctggagtgctctctgttttccagtgtgcccggttttggactacttcttccacacttcgcacagatcttttatttgataggacatcttctcctattctcatcgctctggccctgatttttccataccaaatatctgtaccacagaactgacaactcatatgtgttgctttctttcccaaacaggctaaggtcaacaaaggctctagattacactttgtatatgagcacccccaactccatgcagagctagtccatgtgcactgagagaggttttcagataattagtttatatcacttctctgtggttgagagcccctctggccccagttccttatgtagtaatcaaaaagacaatagaggaaaaggagtagaattatagctttattttctgaagccttttacagaatatgattttcttttgcattaaaacacatgggataattgagttttttctttttctttgtctgaagaagagtaagagtgttaaaattcgtgagcagattgatacaatgattgaatagggtttcttttagcactcaaccttcttgatctgatgtgtatcaaaccacttgatatgatgatcaaattgtagtagttttgtccctctggttcatttgatacacactaaatttctaaatgactttcctgagacactccggtaaagcaagtctttggggcaggacagcatcacagaaccctatatgtgcatgtatgtgtgtgtgtatgggtaaggggatgtatatatgtagataagggtggggtaactccagttccagaatacagcctcagaggcatccctgacaggctttacagggacatgcacagacaggtagacgaatgtgttctttattctggcattaggcaaacaggatcagttttctctgtgcatagctctgtgcttgtccctggggatccaaacatgaacggcacacctgggcacatggtttcttttttgacttatgagactgtaagaaatagagtccctttataatactactacttcttgactatcaaaatattcccttccattggtctgtgatgcttttaaattaacttccattgcacaattaatacataattaaaacatcaaaccttaagagttctacagattgcttcatttacattaaaaatatatatatttgtttaaacttttttttgttgtggtctttttgattattttggttttcttttgtattttatattaaaaaatagaactattttaagttgaaatttctttaactcccttgaattaataaaaaataaactactttctttctttgaggtatgctgttataggctgttgcttctaaaattatgtgaaggggtaaattagccagtccaacagttataaccataaaggttataggtaaaaattgtaatgctgtattatgaaacccgtccatattcttgtgtggtcttgtctgtgaacatgtccataagtcttaattcattttatatgcattttataagtgtggattttgatatatttatgttaaaaaaataatataagcattgtattatgttttgattttttttttttacatattagaaaaagtgagggttataaccttgtgtcttccccccaccctttaacatgttcattaggggatctaggcttgttaaaatgcctccttcctatgcatcacttctagatgcgtgcacagctaaaacccttgatagcacaaacatcgggcagccacgtgcggccgctccctgtgctgagagtataatcctgcgggctccgcagagaagtggccggcccggagagggtgacgtcacctccctctgcgcgtgcgcttgcggagcgagggcggtgcctgccaaactgatgcagatttatcactcttctctttgtgtgcaggcgtgcgcgcgcgaagtttcccccaaagtaactaatgagtaaaattcggtaattaccactaagacccagtacttataggaagctccagtttactatttaaccttctttttctggttgtttaaaaatactggctgatttattaacatttttgttactgctgcaacctgtgttttgttaagtatgtaggattcttttttttttttttttcccaatctcttcccgcagattattttcccatttagtaaacactaactcggaatagctgacaggcaaatgaaacccctgagaatgggtgaggagcacagcttgtcttgtgggcttggctgcttttaaaggaggagacgcagccagtttagaatcgcatcagttcattttgttcaacagctcaaatggtcaaggaataactgtgtttcttctaacagtttttactggaaaactcatttgactagtttaatttgaagattaggtaaaatttcagattactagtatctgccagtgtcctgggagaaatacaggattaaaaaaataataaaacctatgttttacttaaaaaattttaaaatttgattcatttgattcatctttctgccagttatgtaaaaataccatttttaacataatatgctatataaaagcttttgctcattgtgaaaatatttctagggtgctttttattataaataaatcggagaggggcttgttgttcctggactatttgttattgttgtcttaaatttaatgccacagaagtgaccaagtgagcgagcattctggtcatcagtgactagcttagaaaggtatttgtctcagtgcagcatctctttgcagggtttcaggatgacagatgagtaattgatttggtcagtggggtattagatagttgaagttccagactgttgattcagtggaaagatatttcactgttgaatgataacttgcagaatattccttgttagggcagagagattaattttccatcttatgaatataaatcatactatgattgaaggctaaactacctaacatttcacaaaacaaaaatagaaagtactaaggaattttggggttcttgggtaggggttcagggtcaagatgctgtggaaatatatttatttgttggttgagttcattgattgattgattcattcattcatccatccatctttcttttccttttctttttttttggagacagagtctcgctctgccgtccaggtaagcagtggcatgatctcggctcactgcacccttcgcctcctgggtccaagtgattcttctttctcagcctcccgagtagctgggactacaggtgtgcaccactgctcctggctaatattttttcgtattttagtagagatggggtttcaccattctgcccaggctggcctcaaactcctgagttcaggcaatctgcctgcctcggcctcccccttcatccatctttctacccagccaacccacatctgatgaatgccctttgcctggccctatcttaggtatctaggatacagcagggagcaaaacagacatgtcctctggcaaattggctgatctagagaaaaagaggcaactattcatttgatgaacagtataatgtttattattaaggaatagaagtgatttgggggtgcagatttaacatttatgctcacactgacatgctgtcgaaccaaacagtaatttaaaaggtggtaacagaattaattttggcaagtagtatgctgaaacttgtagttattttaaaatgagtatgttaaaatctctaaacattccaatttgttttagggaaaggcagttttttgtgtgttggcttgaaaccagaaagaaaatcatcaagcaccacctatatatatttatatttagttaacaactataaaatctgattttttaacctaagcctgttttcctcagtagcattcaacaaatattagtgtaaacattctgaacatagtcattgtagacttggttcagaagcatatttgttgcctgcctttaaggactcccctgggaaacatcttctgcacctagagataagcctcgactgactccattcttgctgtttcactgtttcctgaagctagcttttcattagagtccataatggttgctgtatttcagatagtagcaaaatatgcctcaaactgtgacggaatccagtctgtcttttctgcgcagttaatatgggctctatataacttaaaaattatataattcaaaaagtgggtacaactaaatgtcccccaatttgggccatttaccctctggttatctcctctcaagttgctcttctttgtctaggctttctgttaatcctaattttaccaaatttctctttgtggcacccccttccacctatttaagtagcattgacaaacccccctggtggcactgagaagtagaaatgttgctgacgcctggtctttggtacaaagataaggtctgggatcctatcagggcctctgtgcggtggtatttgctgttcctgaacctctctgtgatggtgagaagtatgtgcttccagggggcggccaccgagggcagcctgtatttgctgctgttcagtaagtttgagaaccacagttagatcctttaatgcatgaatgaagaaagtattaggagttgagtcttatctgctgtgtaatctagaatctgtggaatagcagagaagccacttatttttaattttttagaacgtttttatagttccacactgttttcctaaatagctcttcagggcatggaacacagcctgcctttttgatctgaggaactttcatggttgggttcttcctgctttttattgaaagttacatatgatatatttaatctggttttagtatttatacatgcttcctgagttctttgcttattggttttttttttaaatggaaatgagatctaaaataatacctaagtgaccagtcaccacaataatgacaaactcaagtttctttgtgtggttagttttatatttttgccctttttatattttctgtttttgaagtattaattgatggtttaaataaaagtaactctttttcagtgacaatctacaaaaatatagttaaactggttagaatttatattctggtctatgcgtgggcatgtacctacatcgcaataaaagtgaagcaccttttcacataagtttctcattaattcatgtacttttcttcctctagaaagactgagtcttccttaatttggggggaaactgagggaccaataggttaacataactacagctctgagaaatgaaaggtcacatgagagggagtccatgactcatagtgggacataggaaattgagacatttattgagttctgttttctgcaccctactttcaaatcaatatgctattcctcctgtgagatggcctggaatatgacagccctcacttccatcttccactccattgtgggtatcagtaaataggtgtgattcagaaagttagcagtaattgtcaaaaatgctttggaatgatgactcaggtcacacagctctctattgggatatcagcattgggatcaggacattcttcttggtgatggctgtgtgactcacaagtggggctctgtctctctagtgtcggagccagggctgcagttggtggtgacatttctctgtctgagggctttgctgtgtcctggccatgacgtgtgggtgtggacgtgggaatggtaggaagcatgcgttttctcatctgagcaacagaagggggaatcctcccttcaaacagatagggatctacagctgtcgcttactccttcctagtatttgtctatcatgtgatctgtcccctcctcatttgcctgggtcccatagcacttcgtgctgcctatgaacatttcataatctgccttgttttataggtgtttgtcagcttgtctctttgagggtcgctggggagccttagtcctctttgccttgcagttgccccagtgccatctgtgtccacggcagccacggcagatgaagtcagtctttgtagacacattcagtgagttacggtgactggcagtgaattgctgactagattgcatccattcaagagttttgaaggaacctgaggatgaaattgcagaactcttggctcagatgttttgccttttataaatagccactgttttcaaagcttggtgggttgccagcacaaagcatggtgcattggaaaggaaaatggcctggtgctgtggaggccccagctcggtcaaatctacccataactggctgaatagttccacgcagccttcctaggacctcatggtcctcagccggatgtgtttgctgtgaagtctgtggtaattgtcagtgtcatagttaaatctcattaaactgggttcattatacacgtggacgtattctatggacaggagcgatttacattaagaaatcagatcacaccgctgatttattcattctttgtttctatgaatgataatgttgtagagactgaattctgctatattcctcccgaagatgttgattttgttgctgcttgtttgcctgctttagcaggcatgtaatttggcctgacccacactacacattctctgtgtttgcagtgggcagcaactcaaattttgatgtagatctttaatccttagcagggctgcttggaattcacctggtttttgttttgaaagctccacattgcttagatggggccctgccctcaggctaacagccctaatgatgggttgtgtacccagggtcatttccttttccaggtgtctctcccagcttttgtcattctctagtgcctggagagagtcgttttttataaatgttccctgtagcagggcttgcccgggagttgctgctcaggacaccaaaagtgaaatgttcactccttgacttcagtactttccttgccttctaattccaagtctacatcttgctgtggttgtattaccatgctagcatttgcgatgcttttcttgtactattttggcaaaaacaaacacaaatgggggtggggaagtggtgttttgttttttcctagagattgttctgctaacagtgttagttactagttttggtaggcatccctgaacctagatgacctctgttagagatcgccgagagaaatatccagttattatgatgagtatggacattttggaccccaaattcccacgtaggcattcaccctggtgagctgggctagatatttttgggctgcaagaattccttttgcttagatggattttggcctaaattgcctattgcatgctccttttctacaatattcccactgggccttctaagatattgggagcaggggcagagttggtttttagtgagaagagggaccttggccacctctgaagctggagtggcactgggccgtatgaccacattagccattgacattcctccagggggcatgacccagaaagcctggaaggagaaagccaggccccagctatttataatcccctctctccgccttgccactgtgtatttttaaccagaccctgaagtctgatggaatgaggcattgagctccccctagaggttttaggatgtcacaagcagcaatttttataaagcagtgttgctgttttctttgtaccagcaaagatttatgtacattaatctacataaaaattaagatttggtaaataatctggactgatttcatatcctgtctccttttgggaccaagttgttattgctagaaatgactcagagcgagccttttggggacatgagcctctgggtctgtgtgcaaatcattaaacattaaaatagaagacagttttgtgatcacagacatggaatttaaatgttgtgctatgatcatgtttcttaagttgatttaatggatgtggataaagctgctgtgttggcattggatagaatggttaaggaattaactgtcactctggcaacccagtaattttattttctccttctgtatttcagggtttcgaaaaaacgatgaaatgaaagctatggatgttttaccaattttgaaggaaaaagttgcatacctttcaggtaaagtttaactttcaactctgctctatccaactgctctgacacaatttcagagtctgacgtaataaatgaactcacctgccacaacatataaaaacattggcatttctatgaattttgaatggctttattcttgtagcactgtttctgagaaattagtgcccaaagcattttcttccagttaggaggcacatgataagttagttagtgttggtgatgaaaatacatttgtttctgccattcaacaaaaattcagctgttctgccccaatcagttaagtaaaaaaactgattttaaaaatccgatcatttcaacaaagatggtgggaatgtgatggtatgtagatgggtcctgaatttctcacttttgtttctcgtactctgtacctgcctctgttgccttgtcttttgggaggcaaggatgcctgcttctccttgagatctgctcctttgtggctctctggtcatggagtaactaggacccatgtcatggacgatgaagccctggtgattttaccagctgagtctgtttccctgtagacccagtctttgaggccctggcccgcccgcagacagactctgggccagtcccttgggcttgggggcacctaactgccctctcttctgcacatagtcagcgttaggccgttttggactgtcttcttggggcctccctcccacataaacagaacagcccttgggtattataccttttggaccccagttcacttgttaccaaacaaagatttgcaagatttttctgctctatcaggaagtacatctgtagattgtcgtcacatgcttttagatgaatttcccttgagaatttttatctttcttaaataggcattctgtgctgatctgtgtatcctcttgaacacatatcatttttaatatataacactgctagctgcttttataagtttttctgtcctttggacatgtgatactgctatatatttaagatgcagcttcctatggtgtttttgctaatcttgttttgcttcatgttcagtaatatttcttggcccctgttaatatggtttgattttgtgggagtaaatctaattcattatgtatttggaaggttcacagaagagtgtaaggagttcatgaaaagaaggtgctttaaattgttggaaatacatggtgaaaaacaaatactggcttacaatacactgagttttaaaagtagcatttatttgctcttctctaatcatttactgacaaactgcattgtaaggactcatgccagctttgcgaacccctgattttgtagtttacaaacagagtaattgaaagactctacttataaaaattagaggtatctgtaaggaaggcttaaagctgagttcatgtgtttatcagttttttatttttaaagtctgggtctgtgataacagcacctgctcccccaacccctcttgtgtttctgaacgttttgttccattttcttctttcattagtacgtggagatggacatgtgaagaaaggtggaaggttaagattggtgggttttatttgtattcatgcttttattaggcagttaatacagaatatattatcggctgacatttttatatagtttacagtcaacactaaaactgtttaccttttaatcaaagaaacaaaatcggcagtctttcagagtttgtcttaaatgtttaataaatacttaaattctgcagggttacataaagttggatatctttggtggggtgggaagttttgctttaccacagattagtaggaactgtttaagatattagcgatggtagagcttccagcagtcttagcaaaatgacgttagtaggtgtcacctcacttttacagtattcctaatttatgaccagaactggcaaagctgattagcatgagctcattgctctttgttttaggcttatcgttatctcctttaggagggaaaaaaaccataaaattaagtagaaattgactacttgtgttgtattacattttttgaaaattacaaagaatgagtaaactttacaaaataaaatttatctctaactcatttttttgtttcttttttattgaaatctaattcacatactctaaaatccacctttttaaaacgtgtgattcagtggattttagtgtatcaccaggttgtgcaactgttaccactaattccagaaccttttcatcacctcccaggaaccccatatccacccccaagcccccagcactggcaatcactaatttactttctgctctgaccccattttaaaaaatattagggaatattatgatacctttgtaaaagctgtccatgtgaatggcttttaatagttaaatctaaataaaatggcaggagctttgtaaaagtaggccaaaagatgagtgattttaaaagatacttattaggtcaagatctctaaaaacccagtgataaaccccgtgataatttcttgaacttgaatatttccgatccttagcgcctaggtcttctaaaaagtaatgctgattgcacttaagtaagatagaatgtactacttccttcatttaggatgaactcagtgaggttaaatgtcttactgactttgtgtttgaagtcagaggacggtgctgtggtttgatggatcacctccaaaattcagatgttgccagtgtgatgctattaagaggtgggacctttaagaggcaattaggccatgagggctcctcccttgtgtgggattaaggcccttataaagaggctttacccttgcccttcagccatatgaggacgcagcattcctcttctgcccatggaggatgcagccctcacaagactaccaaacctcgtaaaaatgccctgtagtttatatttaatggagtttgcgcctaatggcatcttacatataatgtcaactattagtgtggttcctatgccactagggtttgagccttagaaaatctcacacgacaaccaccagaattaagaacgcattcttttttaactgtttattatggaacattttaacatcaaaaggaaagaaaatagtatagtgaatttgtacgaattcgttgcccacttcagcaacttgtttcatctatatttccacttagtcttccgttcactctggataattttgaagtaaattccagatattattttatttataaatatttagtatttatctcttaaatgtaaatgttataaaaaaccgctgcaataccaatgacagacctaaaaattgaaggtaattatttcatatccccccaaaaaacccgataggtattcaaatttttatgcttgtctcatatgcattgctgctggttgagatgtctggtaaggctcttttaacctgtaggttgtgtgttacctcctgatgttttaggaagcgaggaatccaggtgtcttcctgtggattttcctatagtgtagattttgctggttgtatcactgggtggtttaacatgtttcacttcccccatatttcttgcagactaggagttaggtcttgaggcttgattagaccaagctttgatctggcagggaaggtggcaaaaatacttaatgggtgtgattgtttagtttcatagggagttttattaggagagtcttgtcttatttttatggtgttcattgatgattattgcttagatctagtatttaagagttgcaagatggtgatattctacttatgtcctttctttttcatttattaacttggatatcccgtaaagagagatgtcccatcaccacttacttgattgtcctgagaaagagttcatacaggagaagtaggataagtgattggttcctgtccgtaaccagttttcaggctattgaaaaaggaccattgtttgtttgtttgttttttcccccaataaagacttatttcaaatgcatgattttaaatatatatgatgttttgattcattacacattttctctcttatgaagttaaaattgtcccatctttggccaatgggagcctcttcaaattggctcctaagttttgtttgctgatgtgacaagatgtttcaggaccatcttgtataattcctgcctcaggtctggaatcagccatttctctaaagagccctggttccttttagtaggaaacaatacaggttgctaggcatatccaccgggtgggttgtcgtttttgtgtctctttagtggacaaatctgggggaaaacacacacacgcattttaatgagaaatgatatcgtgactttatattaaaattcatagttcaaatttaggattatagatatttcattttactttttcaattatatatttgtggatatctgtttcatgaatctaaaaatgttagttcttatgtggacataattacttactttgtaatgctaatggtattagcacagtatatgactaccaaatgtaatttagtatttttcttcttgtcttggtcctgaggatgtatgctattagaaatctacagacctactactgtattttaaagtcacatgaaacagttcctctccatgtggatatgctatcagcttgaaacctggaatcatttgtttcattttgctttacatttgtaagacttaaaaaccccaacttgcttcaattttaagtaaaacttagcataattccacagtaataactaaaaaatagttaaaagttaaggtatggttaaaaaaaatctagtttttgtgtttgctttctccaccctgtgcctcccctataggaaaacttttttttttaagtttttggtttaatccttctgcttttaaaatatgagcaattctattgattttcccttctgttttcatcttcttctccccgagataaacaaaaatgtaataggcctcattttctatctttgcttgttttatttcaaagaatattctggagatcagtatatagcagcacataatagagttctcattgctttttacagttgtgtattactctgttttgtgtaacagagtaatacacaaatatatatataccagagtaaaacacaactctgtctctatgtgtgtatatatatatatatatgtttatatatatgtgtttatatatatgtctatatgtatgtttatatatatgtgtgtctatatatatacatatatatacatatatatacatacatatatatatatacacacacacatatgtgtatatatatagttaattcagtcagatgcccattgatggacatttgttttttttttttcttttagaatagctttttggggtgcagtgaacattcactcttatcaagttggggatattgacaggaatgtgggatttgatgccttaaggtttgctggtaccttagttcttcatggtctagttttgcagagtactgcatttccccggaagagaaggggaaccttccattcatcttgaatattcttgttagcatcctagcatagtgggagctggcagggactgactgagagtgcgggaactggcgggacttttcatgcaggctgccgagtcttctcagccttcagtagaaatactccatgagccaattcctggttctcaggaccaggcagcaagaggtgagcctagaaggtgcagggctggcgaggtgctcgccttggctgctgttagagcaggagccccgtgggcgtccttttaacagagttgtattattttatggcacacttaatagacgttagccatcatttctctttttcacaaactgtgtctttcagagatttccttggcaaaggctgctttttattgtcagtgtgagttagactgttccttgggagttgggagtgggaggttggacagcggctgaagaatcatttcaattgaaacaagcgctatggagagaaagatacagttggttcgttgaaatttacattttactcctcaaagcaagcgtggctttcttgcaagttctttctaaataagtgaaaggtgagcttctaattcatttaaagagaaagaggtgattgtgaatctagctgtttctgtggtcatcctgggccacattgctcaagagaccaagtctcctggagttttaagaagagggaaatgaggtctcagggtttaaggaaataagtgtcacacagacatgtatagctatagtgtaggaccctttcagccttctttctattattaaaataaacctcagttcccttagcatccacaggatatccatcaggcattgctgctaactgatacctgataggaggtatttttagttaatgttgtgtggaatatggaaaaataatccattcagcaaatgccagtctcactgggcatggagagcattgtgtattcttaaatcagcgaatgaaacaaagatgtttgccctcatggagcttatgttctagtggaggagacagatagacaaaaagaatatgtaaattgtaccatttcctagaaggtaagaagtgccttagagaaataagattggttataggagaggatgcaggtttatgtgaactgaaagtaaaacaccatcattataaacaaaaactggtttgtttttgtttttgttttttgctttttgactaaggcagcatttggataagcagataatcaatgagctgttgtttggttacagacatgaaaagcttccatacatagacatcctgtgatgctggcagcatttcctgtctttttcatttcattgtagaaactaaggcattgatttcctatctataaaatgaggctgacatctgtcccgcctgcctcaccatgtggcttacggttgataacacacacacatgagtgtatctaataggtgaagtttttatgaactgcagtgctgttatttttactagtttcggaacaggaacagaactttgcatttgtgacttttctgcgttatactcagatgctattttcatttgggtacttcctgtgatgttggaaaccaacctaaatcttggggaatagaattaaacagacacctgtgtagttgattttaagctccttgaggtttagcgaccatgttcctctgaactatacttcatcctttctaagattttttcttcatacctccctgaggaggagtcagcagaaagtgatcattaactgcgttatgccatctattggaaggtgcacccttagcagggagattagcatgtgaaaagattcttacttcacaaatgatttttgataaaattgtaaaaatatcccagtgaattttctgaagttcttttctaggaaaaggaaaagtgaaaatttttcctctatcttaaaattcagattcaggtgtctataagcttttcttaggacatgactcagcgcctaagcagatgaacttggtagcaagtcttaggatactgctcactagtgctaccagcctgggagaaatctttgtagttgaaagttggaaaagtgtagtaggggctgtcaaaacttctgcacagagctgcctttggttctcaggtctggggtgatcagaatggccgtgcgcattgtgcaaactactgacttccatgcaactttcttagattggcagattttggattctgcttctcacacccgtggtggagcatgccttgcttgacttgtgagctacggtgacccaggagggaggagagtgtcatgtgggtccctatggaatcaaacatcatgctgcatttcaaacacattttaaaaattcagaactgtggtcgagaaaaaatgttagatgctggctttctctttacccaaagtgaggggaatgttttaatttaaataataggtactgtatttttaataattcaagtttctgtaatatgtgttgatctatgataatttcagtcaaggagattgactcttttgaaaagcatgaaagctattgggaaacgaaaaatattgaaattgttaatctgtcttatcttggggatgagaggtattccaaaaaattagagccattgatgttaccctaaaaatcatatcagatgtttcagaagatcagttgataatgagcagtactgcttctcatgtttaatagtacttttcattcataaatgttagccccctctaaggaccaggaacccgttatttagttatctctgtgacatttttactactaaaaaagaagtaaagccagtagttcgaaagatcatgcaattttcttttgtctgggcgaagacctagcgatgacagtgttgcatagttccttcatctttatttaagcttttggagcctcagtatctttataagactggaatgataaaacctctcaacagagtcattgtaaaatcacatcagaaagtgtatgtagagcacgtgataccctacctggatctgttgttacctatgattgttgctcccatataatacctaaattattggatttagaaataatttaaggcttttctagattacatgactgaacagtacatgtggattgctttaagtattcccaatcaaaatgaagtttcattattatttagaatgagtacataattcctatgaagttatgaaaaccatattggtaaaatatgtttttaaaataccatcatcttctgctgtatgctttttggctgttctaaaaggaaagaatcttctgggtttttttttatttgtttgctttctttctaattttagatgatgatttttggtgcacagaaaataatgaagagttttgtattgtgacttgaattttgaggtctcccgaagagagatcattagagttctaaaactaaatgaaggatccacttgagaaggctaaattttcttcctctattttcctgacaaccccgatggaagtaataaaataaatgtgacaattttaccataagcgtttagtgataccaagctgacttcattaggattgtatatgttaacaagaaatcgttctgcctgcctgtctgtcaaagtcacatactctgagatttgtactcttagtgtgtgatagaaattttctaaaatccttaagctaattagctttaaaattctcatgtggttctctcacatgcatgtgtgtggttctgtgtgagagactggcaaagctggaccagtgagggtcaggtgccatccgtcgcagattataaagtcatcagcatagcttggagaatgttccttttgctttcctttcaagacttagacccatcttgttgataggaaagaaagaactttgaatgcagggcaatggggaaaaatgtgggggagactggcctagagagcagctgtgagggaggtggttgtctgaggtgagtgaaacacatggacgtgacaacttttttttctgtccaaaacataaaaactgaagaaaggagtttttcccaaaacattggaagaaaaagacaaggccatatgtagtaccttccatgtggcctgcagagctcagagattttctcccagatcccctgaagggatgacatgtcctcactgtgcctcagctgaaacaaggacttctgccctgtgcaaatttgtgtagttgctttaggaataattttgacagagtgaatggatgataacataggatttctgtcttatcttgtgtctaagtgtattcctaatgtttgttttttaggtgggagagataaacgtggaggtcccattttaacgtttccggcccgcagcaatcatgacagaatacgacaggaggatctcaggagactcatttcctatctagcctgtattcccaggtaagttctgtgtggcttgtgcttgtcactgatgtcacatttacaagagatgtggcgctatactcgttagaaatcagctaaattgtagcctgcattccaggcaaagtagtataaaatgaaagtcattatctttcaccttattaccattttgtgaccattattgtctagtgtaaagccctttggggagcagggacatgaaggtaggtaagagctttgtgtgttgacagtggatctgggatactcagctgggatttcaggatgtggcgcctgagttagaaagccattgttgatgattctaataccgtgacacagaggcctgggtgatcagaattgggtgctgcttttgacaatgcatttctgcctacttggcaaacgttagttctttaaaaatagtctgttgatatgtagcacgaagtttgtggggcattaaaaatccttattagctatatattgggcgtagatttgggaatctctatcaaaattgagactccattggtaatgggaatttttagcatagatgccaaagaacaccaagagcaagcaatgttgtgttttctggagagtccgcaagtggggagtcatgagttactaggagctggcctgtgtgtatacttgaggaatttagaatctgtttctgctctggaaatgtattactcgagtttaatttgtagatctagctgacaactggtggaggaaatttcctccctatattaatgtattagttctttctcacacttctattaagaaacgtttgggactgggtaatttataaagaaaagaggtttaattgatttaatggctagggagccctcaggaaacttatgatcatggcagaaggcaagggggaagcaggcacatcctcacatggttggagcaggaggaagagggtggaggtagggggtcaggtgccacacacttttaaacaaccagatctcatgagaactccatcaggggacagcactagggagatggtgctaagccgttagaaccccccccccccgccccgtgatccaattaccacccaccaggcctacctccaacattgggggttacagttcaacatgagatttgggtggggacacagagccagatcacaccaattaatatctccatttaattgttgcagttatattctggaaaacataataccatgctgatataatctaaggatacagtcatgcctggaataggagatttggtgtgtgttgcaggttggaggggtgcctatctatgaggaaagggtgagtcctcaggtgtctcttttattccagaaaggcacatactgaagggcatcagtggcagccatggtagagtgagaggaggtgtttcctaagagactaaatgaggatgtgtgagagaaaactcggccataatatgggctggctagatagtaaccttaaggaacatgttacaagagaatgatgtaagatggtaacagcataatgggtttcaggggttgtggtaaaggtaatagatctaccacagcacgtggttcacagcactcaacctgtgtaggttgacacaagcgggacaaggcagccatgcccctccctaacagggctggctgtggctgatggcaatcagcttttggtcttgatagtttgacttgctggggaggttcttgggttttctgtcagagtatcctttatgagaaaactatcactgtgtggcatcagtgactaagtgagccctacttatctggagtaagttttccctttcttcttctggtatttcttaggcagctgacctgttgaaatcttagagttggaaagtagtttagaagttatttatactcactatcatttataaataaaaatagagtgtaaactactacttactaagctttgactatgtgccaagtctgtgataatgatggaaaaagaaatacaaagggcagggttaaaaaaaaaataactgccaatcaaaatgatacttgtcatatagtttaataagaactaaagttgaatttgatattcactcttgtgaatttgaatactatatagtggtaactttgacaacttgctttttggtcttgaaacctatgttaatagtaaatattaaaaattattcatttaattgatatagaaattggttcaagcacattttggataatctggatgacccactttaaaaaaaaaaccttttttttgtgggaaattgtgagaatacacaaaagtggagagaataatatcatgaacacacatatacccttcacccagcttcagcgtttatcagattttgccaatcttgtttttctctaattattcacctggtgtattttataacaaatcccaaagatcacatcatgtcattcaaaaatacttgagtgtgtaggatgaccctccggccactgaacagtctcttcatgtcagtacctaggtttgcgtttgcattaactgcagtcccaagtgacaagaaatgccattttgcttgtcctcgattaatgagcaaataagagaggtggattaacatgtaaatgacgcatttgccgagtgataatggagaaagatttcagagtagtccaaattgaaagaagtggccacaaagtgagtcctctctgggccctctcccccagggtcctgcaggtgctacccctagtgagtgtatagcagcaggagcgctgtttggttttaaccaaacaaattatgtgatacagatttcaccaatctgtaaaaatcatcagcaaattactggtgtgtgaatttctttggacttgtgattttgcttatgtgtagtttgtaagtctgatggtttgttgtagtagagtggtatgaacacaaggcgtttctacccagctgtacatttgtgtgtatgtcttggggcctgtgagaccttttgctgtgtccagtgcttcctcgtgcttcccagatttgaaggcagcccttcggccattcctcagttagacagtcacagggctggtgtcatatgtgaagggagaacatgggcctcagaatcagactgactgtgacctgggacacatgacttcactttcattgctttcctgatctgaaaatgtgataatgacctgtacattttgggatcattgtgagtatcgagtaagattattcctgtaatcttgcatggtgcttgacatgcagtagcttgctgagatatagtgcaataattttctgatttcatattcacccttctattttccttcaattactttccttttgacatgatttctagaggcagatcacattgttttcttctgcatgctttctagattgtctgggtccggcacagttcaacaggaacgtgacctgagcagctgtgagtgatttgagtattattgctggggtcgcccctccctgcccttttttttttaaacaaacaaacaaacaaacaattgtagtaacaaggtgagttcataagattcatttgcaatgaaactttccactaaacgtgtgtaggagaaataagaagcagcagcagttcttgctgctgtcattgcaagtcctgcacagtgacattaatcttagaatgtctctcggtggctgttgcttttattacttgaactgtatttaatactaattatgttctagaacattctgccttctttagaatgatttttggttgctaaatattaacagataaaccactcttactccttgttgtccactaatgaaatgatacgaagatttttaattgattcattcataaatactcacataagaagatactttcttcctctaggaacgaaacaagtagagtttctcttttttagggacctgtgttgaaaggggaccttatttttatgtgaactttctttatctcacagataaacatgaggctctttggtaaaaatgctaaaataactggttaataagtcacatttcccaaagaacagtgtctcttaggtggtggaagggcttgggggcccttctccagtaggcagctgtttattaggtgctcataaataggacccaggtttggggatgtttacaagtcactgctgtcttaatgatgactggcttttaacttgataaaaatagatggattgaaatgctgtgcactcccagcccagtccatttgccattttcattacttaggaagccgctgggtgggagcagtttgatcacagaggaaggcgaatagttaatccttctgtaaactgtgcaagctcagcgtagcttttggttttgttgttctcccgcttattcctgttgttaagcctggagtcattcaggattccttttaagcttctttcaagtagaggggctttgtagttcgtgtgcatactgtgtaaggccatgttaggagaaagacaggcttcaagggaatttatcttgatatggtgaagactgatggttacagtgcggtctaccaaacagcaactagtaaaacaaataaaacatattgccaccgttttacaatctcctgtctttggtgtacggcagcagaatatgtgaatctggagtagaatgccttactgggcagcaggcttcctttgcagagctcttggcctccgggcacctgcctcttcctgcttaggctgccctcaccccagtgcctccagggccctggagtttctgtggaatggaatctcgagggattgcaaaccccattagagcccaaggaagtctagaatgcttaatttccatgacaggagactttaggagatgtttctgggagtcccatttgcctctaggtttcatgaaggaggtcagaaaacaggtgatgtttctgcccgtgatgttacccggattgtaacccacgacctaattgggatgtggaggagaagtgatggcatgaggagtatttgaaatcatttcaatttacatccctatgagatagttattagaagttcatcacatcgttcctaatcagttttcagcatttgggtgataaactaagctgctggatctgttttctcctcctggctttagacactgtgctcctctgactgtgagccgccttctgattgggtcctactgctgggctctaaccatacaggcatttttttggggtgttgatgtgatacaccctcttactgatgtagatgtcatatgtactttgcatttgtaaaacgtgggaagctagttagtctgatagtctgaatcaagatatagaagggaatggggtgtgtgagtgtgagttagttgggagggggaaggagggcagggttaggggagtgagcctatgtaagagcatgaaattggttttaattttgaattaattttatttgcattacttaatgatagcaattggttttccaggtttttaatttagactagttttttggggggataattatccaaagcagaaaaatgtcaaatgtcttttctaccctaaggtacatttatgtttggggaaaaccacatatgcgtattgagtaccataaggtcctaggtatatttccaaaaaagaccttgtaggcagtcgttacctggttactgtctggtgcaggcatcagcagcctgcacagactgtcagagacccctgtgtaacagtgagggttgcagttgttccttactgtagggccattcggaagcttctatcactgaagttgtaaccaagtgcgactaagtatttttttaacctgtgtttaaggacaccttaactcttgttgctcattctttattgcagatttgcattgtatgtgtttcccatgtagtcagtggttgagatttaatacaattagaagctggcactttttttttttaagtgcaataatgtggagaggaagaacatagtgactcccagcactgccttgacgtgtgtcagaggccagcagtgttaagccagcgttgctaccacataaaggcttagtacagttgtggaactagattaaaaccacagagcctgccagaagggtgccaagaactcccagggacgggtggatggtatggaaaaccactgagatagcttcagggccagggatagggtaaagggaataaaatggaacataagaaagttctcatcattgccagccatgctagtggggggtcattttcagcacctggggtgctgggagtcctggggtaactgccgtccacaggtctcagactgtccccagtctgggttttgttgcaggctgtcagggttttgtactcacccgatgctccctggagacctttgctcgcaggagtgactggaggagttcatgtaatcaattaatgcaccaaagtcaggagaaatgggcatggtgaccgttgttttcctgaaaagaagacgggatgcaaaaccattaatacaaaattgaaatcttaacaggttttgcaggttgaacatgaagcgtgtatagcctgggtctcttcctttatggtacaagggagggacgagaaggagctgagcacagtgtgctccttcccctgcctccgcacgtgtccagcaggggagggaagctgggtctgtggcacccagtgggactctgaccaggcagagtggcaagagatgtaacccgtcttcagccatgttttctttctctgcagcgaggaggtctgcaagcgtggcttcacggtgatcgtggacatgcgtgggtccaagtgggactccatcaagccccttctgaagatcctgcaggagtccttcccctgctgcatccatgtggccctgatcatcaagccagacaacttctggcagaaacagaggactaattttggcagttctaaatttgaatttgaggtaacttcccccgtgtggctagacccactaaacaagttggtgtggtttactaaaagctattgaggctaatgagagattttttttttaaaccacatattaaacaggagctgcatatcttacgaacatgtgatacgtaaaattagttactgcatgaaataacagagctgcgttcatcatccgagtggattgttttacccacatgggcttaggtttcagttcccttgggttgggtgatgggctgttgagttgtgaggccttggcagagaagcttgctggctgccttatatttcacttgacaaacagctttaccaggcagcactgtggctttgcacagttacagattcattctccttgcctcagccctggagatgagggaatgttagggagaaatgcccaacttcagagtccctaagtttcatcctgtcatggataatggaaagaatgcatgtattaggcctctgatttctgaaaatggagatagtgtgttaaaaactgtgcagagtcctgaattcagttaggcatggaagattgccgtctttcagtggtaaaaacaagacaaaaccctcagcccactaattattttgcttcccactgtaacctcctctccttaagctaccaaggttctgacaaggccttcggtgcagttagtttaatgagatgattatgggaggaaagtcttcctgccagcatgaaacttgattcttgctccatttggaataagattttaatattttctaataagaaatactttttggttgaatagattgcttcctctggcaaatctgctcaaacgttaggtttcagtggatgtattcatgtattttaaggtaaacagcaataatattaaacatcagacagtgttaatccttaatcttcaggttataatgctatacttttcaaagtgtttgcacaggtgtattacttggatttttaaattctttccatagtactcatttttctatccaaaatatgaacttagttttaaatttgaaactactcaggtttactacactccatcagaaagatgaacccagtaagcctttatcttcatagagaataggaagtaattttggaggacagtttattgggtgttaattattttcttgatgcagaattgaaagtgcattgtatttaattataagtgttttaagtaaaaataatggtctggcaatacaattcatacaggtttttccagtccagttttgatctctccctcagggctcttaaaggcaccagtttttctatggaacttgttacattgttaccagcctctctctccccacccagtgattgcctctgtggagattattaaaagtccagcaggaccgggtgtggtggctcacgcctgtaatcctagcactttgggaggccgaggcgggcggaccacgaggtcaggagattgagaccatcctggctaacacggtgaaaccccatctctactaaaatacaaaaaattagccgggcgtggtggcaggcacctgtagtcccagctacttgggaggctgaggcaggagaatggcgtgaacctgggaggcagagcttgcagtgagccgagattgtgccgctgcactccagcctgggcaacagagcgagattccgcctcaaaaaaaaaaaaagtccagcaaacgagagaggaatgggcctatggtaggattgtaggcataagtgctggatcaggagtcatccctcttctacctctgctgccttctgatgtttcttttgccaaccagcacgccggaccagcccttcttgttttctcttttggttctaggtcacaactctttctccttcacctttgtctttgcatttaatcttccccctccatgttttccttgaggcatattaatattaatctgcttcacatcatgataaggtgaggttaagatttcttgccgaggccaggcacagtggctcatgcctgtaatcccagcactttgagattctaagggaggaggactgcttgaggctgggagttcgagcccagcctgagaaacttagcaagagcctgtctctatattttgttttaaaaattagccaggtgtggccgggcgcggtggctcatgcctgtaatcccagcactttggaaggccgaggcgggcggatcacaaggtcaggagttcgagacaacctggccaacatggtgaaactccatctctactaaaaatacaaaaattagctgagcgtggtgtaagtcacctgtaatcccagctactcgggaggctgaggcaggagaatcacttgaaatcggaaggtgtaggttgcagtgagctgaggttgcaccactgcactgcagcatgggcaacaagagcaaaaccctgtctcaaaaaacaaacaaacaaaaatcaccaggtgtggtggcacacgtgtaattccagctactcaagaggcttaagatgggaggatggcttgagcccaggaatttaagcttacagcatgtaatcatcgccacactccagtctggaagacagagcatgaccctttttttccttttttaaaaaaaaaggtcgtgtgcgatgtctcatgcctgtaatcccagcactttgggaggctgaagtgggtggatcatttgagatcaggaatttgaaaccagcgtgaccaacatggtgaaaccccgtctctactaaaaatacaaaagaattagcctggtgtggtggtgggcacctgtagtcccagctactcgggaggctgaggcaggagatcacttgaacctgggaggcagaggttgcagtaagctgagactgcgccactgcactccagcctgggtgacagagcaagactccatctcaaaaaaaaataataataataaatataaagatttcttgcttagactgtaattgactaaaactttgtcactgttaaattgcaatgtagtacagattatatacaactctaggactgttcagaatcacagcagattattgcaatgaataaaacattgcctctatccttagctctgtcaaatgagcctctgccagctttcttgccaactcttgaatattttctaaatttttataaattcattcatatcccatcatctgttatttgatgggcagtggggttaggcttaggcaagatgaatgatagggtggtctggttggagcagcattcatcgtttaataggcagcccacacgtaattgaatttagagtgatgttacacttaaaagggttttgatgcccttgagcaagacgtttgtgtaatagcaagtagtagaaaacctccacagagtttctggcatggatgaaaaagaatggggagaagaatgcattgatgtaagtgaaatttctgaattgtttgctctgaacttgcaatttaacctgtttcctagtttaatgtgtctgttatagtgggttaatctccatcttcttggaaagaaatctcatttctttagctctcatgaaatacacgattctacagttttgggtattccagctgacatatatgtgttgctataatggatttgtctttcattgtactgataatgcttctttcatctacatttatttttatggggccagaaccaggtatgttatgttttctataaatagattactttaactttgaaaacctgtgactgagcattgcaaattgcattatgttaaaactatataaaattggttcatcttctcatacgtgattttttttcccttaagacaaatatggtctctttagaaggccttaccaaagtagttgatccttctcagctaactcctgagtttgatggctgcctggaatacaaccacgaagaatggattgaaatcagagttgcttttgaagactacattagcaatgccacccacatgctgtctcggctggaggaacttcaggacatcctagctaagaaggagctgcctcaggatttagagggggctcggaatatgatcgaggaacattctcagctgaagaagaaggtgattaaggcccccatcgaggacctggatttggagggacagaagctgcttcagaggatacagagcagtgaaagctttcccaaaaagaactcaggctcaggcaatgcggacctgcagaacctcttgcccaaggtgtccaccatgctggaccggctgcactcgacacggcagcatctgcaccagatgtggcatgtgaggaagctgaagctggaccagtgcttccagctgaggctgtttgaacaggatgctgagaaggtaaagacgggggaggctaatgcctcagtggacatgggggaagccagcgctggtgggttcgggtggaaggaaagagaaaaggtggagaatggtaaggctatactcaccgtgtgtgctctaaaccagcgagagtcatttcagaaatggcactgaaatctgttttccggttttactcgttgtgcaatacagtgctgttttagaaattttgagttcaaattacttattctttggtctaggatgcctgtaagataggaatgatattttcacttaaaagagtgaacatttcggccgtgctcacgcctgtaatcccagccctttgggaggccgaggtgggctgatcacctgaggtcaggagattgagaccagtctggccaacatagtgaaaccccgtctctactaaaaatacgaaaattagccgggtgtggtggcacgcgcctgtaatcccagctactcaggaggctgaggcaggagaatcgcttgaacccatgaggcagaggttgcagtgagccaagatcgtgccattgcatttcggcctgggcgacagagtgagactccgtcttaaaaaaaaaaaaaaaaaaaaaaaaaaaagtgaaaatttcacagggttatgttattgacaaaacaccattccaatctattgagtatgttttttaaaatcaagatgagtaatgtgttaaaagtaacagtttctgggtaatatagttggtaatcacctctagtctcatgttttattcttatgcaccaggcagaccaactggtcaaagtgaatccttatcaattactggctaattgaatcttagcaatgtggaaactgggcacttacccataggtatgtgttgcaagccatgaacatgggtgaattaatcattgagttttattggagctcattgaattttatattacatggacaggagaatattttgtaaagtaaaaaaccacattagaattcttggatgtaaaaggacttttcaaaaggtgataatccagtgtttttattactaaagcttttaatgtatctgtcagtgttcttttgttttaagtagcaccttgtctaagagactggaataccttcttttcaattactggaagaccaggttactgtcactgggattctggttcaagtcatggtagcaatgctaattgatgatagtcatctatattttcttaaatgttttcattgcaaatgtcttaattgacatccttgtccaagtaacatctatattgaaccttaagggagatgtcatagttagtttttcccaccttttttatagtaaattttatgtttttgcaatctgcacaggtgtctgtgtacttcttgatcaaacagtggaatcttttagtcattgatatttctgtcagtaacctgtgggcacagcagaacccatccagagacccataagttcctaatttcaccctaacgggtctttaattgaacctcactgtggcaaattaagtagttcagcgtggcagggagactgggctgagagtcagaggatcagagtttttaatcagcctgggggattagagtaactctctttacttatctgcttcttaattccttctctgtaagaggaacacatcagataagattttctggtaggtcctgcaagttcagaactgctgacttgttcttcgaagtaaagactcttctgagagaatcagacagcgcttgaagttgtccagggaaggaagttgccctttcttggtactgccccatctgtgggcttgtgtcagtaatttctctttctggagtgattgcgggttgtctttttccttccggtagatgtttgactggatcacacacaacaaaggcctgtttctaaacagctacacagagattgggaccagccaccctcatgccatggagcttcagacgcagcacaatcactttgccatgaactgtatggtaagacactcggaacagctggaccctggcatgtgacagtgttttagcaaatgggaggcatttggcaaattgtatgctagggctttcaaggggccttcggagtggctgttgattgtagcagctgaccttcacatggagggtgttccctagggttccattgtctcactatcccacattttaagttttaaacaaaaatgaaaacaagcaaacagacgaaccagtgaaacttgaaccaatgacttggctagttcagcacagacacttgggatgctggctcctgtgctgcacttcataggagcccacgggggccccagcaaagctgctgggaggcacagtgagtcccccagacggagcgctgtcagtttgctggctgctgttcatgacagcgaaaggagcaagcctgctgctgacctcagggcactagctagttctcctgaggcatgagatttccttccaagctgagctggaggactgggatctggccctcagccttgcctgggatcccctggccctctttaaggttgttgcatctgctacccttggctgtcgtgactgtcaggatcttagaggccagatagggggtgactgtaggactacatcacagaaaccaaaaccaaaccaaaacactgaattttgagtagcacttctgttacagttttatagttaatgttactaaaactgtatgttctataggacatttgcttgcctctgtagtctgtgaagcttctagaaatttcctcttcagggacaaggagttttggtttggactttaagccagccttgtgaggattgtccactcttaaaccttgtaacgtttgttgtagagcattaaagcaatatgaaccggcctgggcaacacagcaagaccccatctctaaaaaaaaaaaataataattaaaaaattagccaagtgtggtggtgcacacctgtagtcccagctatttgggaggctgaggctggaggattgcttgagcccaggagttgcaggcaacagtgagttatgatcacgccactgcattccagcttgggtgacagagcaagaccttgtctcaaaaacaaaaatacaaataaagcaatatgaagacagggtttttgtttaagttaattcagaaagatgccatttaattaaaatacagtcaactaggtgctacaatttaggtagtttcaaagataagattttgcaatataatttttagtaataaatgccatcaaagttttacgtctgttctagaatttaaagtaagagaatttctggttcgaatcgtcaaacctgggcatagataaaaatttgtttgtaaaaaattactgtcagtttttttagaattttctgaaacttttggcaagagaccattcagtctgctatgccacatactttaaaaactagaaatactaaaatatgtgctagaaatgaacagaaaaatatattctctcttccccctttcttcagcattattagtggcagatttaggactcaagggaataggaaccatagtgtagaagacaggaaaatgggttgtggacgtagaggcttttaattctgactttcttatttgccatgtgaccttgggaaggctgtttaacctcttcgagcctcagtttcctaatctgtaaactgggggtaatacctgccttccatggtattacatgtatatgtaaaatgcaaaacatactgcttgacatatagtaagtactgtataaatgttaattcttaccagtgatgttatcaatataattaaagatgcagttaaagcaggtaagaaacttaaaagtatgagttacagctattttttttgggaggggggtcgaatatattttctaattttctacaatatacttctgttacttttctaagttaaacttgtaatacaatgcatgcgggtagctcggtgccatgaaggtgatgcctgctggggagctttctggaccaggcctgctccttgtgttgaatacctccacgaatcccttgtatctgtggcatttaataatgcagggcaagggtatttaaccttcagccccttctgctcgctatagtgttttgaacaatttctgacaaaataaggatactaaataccaatatgccaagttaacagcttttaaagaaagcatattaagggataccaacaattatgcatgttctactctaacagatatttataaaaactatgatgataagcctgtaggtgtaggtacttttaatttagggaattgcacattaccatattgatgtccaggctgtagatttaggctgtatgccaccatactcgtttatgtgtgctagaagtgatggagagatggaaaaagcatcatacatagactagtaaagtctgtttttatataaaagtgacacaggaagctgttacaatctaggaatgggcaggtatggtcagtggttgtcacaatagagccacccaaggagacatctcttctccagatcctaacagagtgcatcttgtgcttttcctaacagacctgtcggactggctttttctcttttaaggatatagagaaagcaaaattagcaaatctagtttcttgtcactttactaggagggaggaaaagagagaaagaatgcacttgggaatgggaggccttgcttttaatttaccagatgccagttagagcgttaatgccacacgagccagagaggtcaccttgctgagcatggcttgactgttgcagcctctttctgcgactccagacatgcgatgtctgttagctgattctagccttcagatgcagcccggagatgtaaccctgaggctggagtcctgtggctctaatcccagacagaggcaactccaccaagttctggtttgggtcagaaatagagggaaaggatgaatgaaagaagatacaaagaaataatgaacaagtgagttctttcagctgcttacttgggtggtctgcaggcagcaagagacaggaaggaggctgttgtggggtccttgttcgaggcagtgggagatttgctcagaggggttgtgtgggaagtgagagaagggggaaaaacgtagggaagtttggacagatcaggaaatcagattggggcaacgttgagaggagccaaagaggtatctacgattttgggggacccatgggaaggagtgatgtggtaacagtgaaaaaaataaaaaatacatgaacaacagcaacttcggatttgctgaaggtctgaatcccgcaccacaccacaccctgcgatactgagccttaaagaactttggaggtggaaagggaaactccatatgagagcttgttctgcaaaaagggtgggtttttaaaatccctatttttgcaataaactgatagacttgaagataggaattttgacagagtagaaaagctttatttaaaatttgagcatagcgttgttgtgtttttactgcaattcatattcctgggagaaggtggatctatttacagaatattttctgttggcacccaaaaatgacttgggcatatgtagaaaggagagcttgctttcacacaaatagcctttggttgctaggtacgtgtttttgggtttctgggttctggttaaaaaccagagcgctgggtccctcagttctctgtgactgcctggcagcaggcttgccatctggaccctgttcagtatttgaagccaagaagtgagtaatagtatatttgtgtgcacccacttgtgtatttgattgctttgtgctgaacaattatgcctttcagctagttgatttgtaattttacagttttaaaaatagaaatggaaaccaatacttcaagtttatggaaatctagagagcaaatatgtataatattatatatatcaggtgatgctcctgggagagatgtgatcactgttagaagcctgtgtttcagcaggtggcatctgggcttcttagaagggagcctcctatttgctctcccctaaggagccctcttttcctgcccactttccagaacgtgtatgtaaatataaaccgcatcatgtcggtggccaatcgtctggtggagtctggccactatgcctcgcagcagatcaggcagatcgcgagtcagctggagcaggagtggaaggcgtttgcggcagccctggatgagcggagcaccttgctggacatgtcctccattttccaccagaaggccgaaaaggtcagtgccttgaacccccagcccacgaggtggtaaccagaatagttcttcctccatgaatattggtgtgtgtgcaaacactcttgtgtagcacatactgtgagctccgcatgtgagctctgaagtcacttggccctgagtttaaattccagctcttttagtccttgctgcgtaaccttaggcaagtgacttagcctctctgttttgttttttcatttgtaaagtagaaataaaagtacctgtttgagtggactgttgatgtaaatgtgatgctaggtgccctacacagtgcccggcacagtaagcactaagaagtggcagctgctcttctcttcccctcctctcctggctccttctttgctcttattccttgttgatagtgctttattactccaattgggatggtttggtagcaaggaacggaacgcccatccgtggtgcagatgtcaagggtttagttttctcacaaactgcgaagttctaaggcgaaggcacctctagctgcacggctatggaggggtggtgtctgctgccctcaggcttgctgggcctcccctcacagtcagggcagcacacctcagctccacgcaccagctcctcctcagccacagtgctcaccctccgcagggatggctgtagctgtctttgcctgccactttataagggaaacattatttccagaggccccgcccccagcacatttcccctcggctagtcttggggtgcacatccatgccttgctgcaaggggtgggggaaagggtggatctggtgtttagcctccttagggaggtgctgcccgcaagggtgagggaggaaaatggcttttttgggtacacagttgacagtgtctttcataattataaacttagctacatggcatctgactttggcttcatttgttgacagatgtgttgtgtcaaaatttctagtttaagaagtaatgggtaatatatgcccccaacactccccatacctccatttaagcaaacttgcttaaacaaacgctctgaaagtagcaaaatgaaagggatttgctcatgactcagagtttattatcggaaggtgagcagcacagtgagtaccttttcaggatgtggagaaagggcataggaacttttaaccaccaggaagacacatatatggggtagaggaaaatggttgcttaatttaaaaaggaaaaatatcagtatatcttcctcagggttaatttttgggggaaagactggattcaggcatttgcacggatgcttcttaaaaaggaaatagtatctctttcatctagaaacagtctctgttgaagagtgaagaagtcagtaaaggaagatagaggccccaacttgcctaggattttggcagggcagtcagaatgttgcacaagacactaattagcagtgatctcaactctagagacctttaaagtataaagcaagagaggaagctgagtgatttataaagagaaacaaaccttcatagcaccatgtaaaagctgagagtttcaatggtaaggatttttctactttctaactttttgcatttgactaattttgtgataaaagatagacaaaagcccacacacaaaaacaactttttaaagtaacaggaactgcttcagcgtaaataaaaccatcttcatgaccctgtagccatctccgatccttatcgttgtacaaagtagcaataccctcgatcatttggcagtaaggtgatatgaatgaatttgaagcaggataaactgcgtgggtgaatgtcaggctgaagcataacacacagagaacatctttcataaacatgatgagattcagaattgtaaataaacccagagattaattaccactgtgacctgcctgaaaataatctagaaacatgggtgtcatggggcattttccttccagtgttttattataaaaaattttaaacatacagcaaaattgaaagagcctggggtattctcatctggataaaatgaatgagtgtaatttatggatttgaaggaaatgaaactaggtgaacacattattgaacagaatttcatgggaccctgcatgaactgtaagggcgcctgaagtctcagtgcatgtacggtggccagagaagaagccaaataggagtgaagggacagtagcctaatgaagaaggagcccagcgtgtattccagaccttaacgaagcaacaaggcctgcacgtagacaactgaaatgcacagatgggagattaggacgtcttcagaaagacagtccttacttgcaagtaaaaatgtgttgtgtctcgtccccctcactgaagaaaagtaagatccttgaaattctgatgctcctcactaaagtagttttcttttcccaagagagcaatcccaagactaggtcaacgttgttccctcattttaaatgatttgccttctagttatgctcaacctgttttcataaactcagtctggaaaggaccagaagcttggacatcctaagttaagtttccatcatagtcacctctttgaatcacatccagagtgttcatgtggaatttaaatctgattagggggacataaggctcaaatatgtgactccatggttaatgagcttactaacggcagccgccttctctgtaaggattacagctcttagctgcaccgtccggccctgccctctctctccatgggtggtggtgtgctagcatttgctgtggctttataaacataactctgaagttaaagctagatgagaatgatgtttcatagatgctataacttccatagatgtgtcagccagtctgttttgtgtcatctccagtgaaggttgtgggatcacagtatccgtttgcaaatatgtggacacacaaccacagtgttaatgttgttactggtagatgttgcttaggggctccagccttcgcttgtcttggtcatgtggtatatccacaggacagaccctttatattaagacgctttcacagcagataccattagaattaacatttttataaaacaaagtgacttgattttgctacagcttaaaatatctttttactgtgacctcaagctgcactgcccattgtgatggcctgtcaccatgtgtggctattgaagctactcagagttaaatagcaagatgataaaatcattttaaaaaatagaattaaattaaaatgtagttgcttattcactgtatcgggagcaacatgtggccaatggctgctgtaattgacagcacagatacacatttctatccactcgggtagtgcttgcagaggcttacctgcagagtgaaccacacatccgatcaccttaatttatctatgactttaggccttctgtactttgataataaccaaaaataaagtaacagtgtttgtatagttctttaatatttagagaaccctttaacatgaaatctcatttcatccttaaatcagcctggtggagcagatgggactgtagtattattgtcctgataatctgtatggggagggatttggccatgtttcccaagctagaactttcgctgaggtctatggctaggtctttcagttcctgacataataacaaactgtttcacacttgcattaatattcttataaaagttcacttcccataaatatttttagaattaacatttattataaacatgacatagatgcaagttctaaatctaggaaatttccgtccctttgtctcctaagtccagcttagtgcctgtgctcagctgaggctccgtcaagaggtggcgggggtgagagatggatgggagtgcagttcactagcttcaaggatcccagctctggttggtgggacccagaataggcagaagaaatgagtggctcccagattggaggccccctctcagcagacagggagtagtagagtaaatgcttaggaaaagcaatctgttaattatttatccaagttctcctcttaaaagctatgtatatgaatcactgttcccctcctctgcttgcctctgttttgcaaactgggtgatccaggcttccttcatcatttattcagcaacactttcttaatacgaccattctgctcagcttcaggatccccagatctgaagcaggctcctgatctgaactgacagagcaacatttcattctttcgcactctcctgcctttatccccagtcccccagatgctttgtgttcacgtattttgatctagggagcacttaaagcatcagatactaagacagctgctctgatctcattagactgcagtagccaccttctgtcctcatctcctaagtgtcaggctctgtgctagacatgttcccccagcattgcagtcccaacctgggttactcaggatggtaacacatatgtgtgtgtatgtgtatcagagtgagggaagtaccagtcccccctcgtatgatatcattgtcatattagaagcttttctaagaggttctgttatgaaggtacctgttgaatttcaacaccaaacttgacctcaggatgctttttctttgtggagtatctgttgacaccctgttccctgttccatgcatctcggaacggggattgctgtgctggtgctgttggtttcacaccctctgggcgttcagccttttggaaaacaatcaggcctagagcttggtctgtggagtctagggttgtgtcttagaaataaagaacagaaaaatgatgctgtgcaaaaccctctgtaaaaccatggctaggattatttctatcatgggctgttattaacccagaaaaagggcagaatcctttgtccacaaggttttcatgtagcacaccatccttccctggctatatgttttcagagaagtataatcagtgccctctcaggatactttaagaaattataagttagttctaattacaggaatatgtaaaacttcttgaatgttttttctttattggttgttgcttcaaaaattggagtccaatatactttaatgattttgatatagtgatatgttaatctgatgcttctgttcattacattatgaagtattatataactgaaatgtgtttccaccatgttctgtcagaagcgttttgatcttaagaatacgttgcaactcctcttggttttgggtgttctgcagtggccattgtccaggagcgcttaattgctgacttagacctgatgatttattaatgatgatggttaacctcaatcaatttgtgtttgaaaaacaataatttaataattggtattaaatgcaatacaggaagatgatagagtgaaacagagctcaaaaatactgacaatcatctgacctgaccaaattgacatttatagaacatgacacccaagaaatactcagttgacacttaatgccgtatgaactggcttcaagccgtaaggtctgcatagatatttttctgcactcaacaataaaaggatttccataaacagttattatttgggtgacttgtctattttaatgtcctaaaaataaactgggagtttgttcttactatattttaagggaattatagcacatttctttctggtcagttgagtattgcatttcaaatagtcatcctctgcattccctgctaagttaaaagatgtgtgaggaacaggagtaaagaggttaaaaccgagggaaatgtgttgatgtctgtttggcttaattgaattagcttttttaattgggccttccgcacttgcctttcactcttaactgtgatggatttcgataggatctccctaggaaatttggcagtgatttctcagctgttgatgatcctggagatggagggtgtcagtggaggagattgagccagggttgggatggctgccgcaggaccgttgatgatcctggagatggggggtgtcagtggaggagattgagccgggattgggatggctgccgcaggaccgttgatgatcctggagatggggggtgtcagtggaggagattgagccagggttgggatggctgccgcaggactgttgatgatcctggagatggggggtgtcagtggaggagattgagccgggattgggatggctgccgcaggaccgttgatgatcctggagatggagggtggcagtggaggagattgagccgggattgggatggctgccacaggaattgatgatcctggagatggagggtgtcagtggaggagattgagccgggattgggatggctgccgcaggaattgatgatcctggagatggagggtgtcagtggaggagattgagccaggattgggatggctgccgcaggactgttgatgatcctggagatggagggtggcagtggaggagattgagccaggattgggatggctgccacaggactgttgatgatcctggagatggagggggcagtggaggagattgaaccaggattgggatggcagctgcaggaattgatgatcctggagatggagggtggcagtggaggagattgagccaggattgggatggctgctgcagaactgttgatgatcctggagatggagggtggcagtggaggagattgagccagggttgggatggcagcctcagggctgttcgcatggctcaggcttttctcatttgcctgcaaattgggaaggatgggaatgatgcccctgcctccttaagcctttcctaagattcacagagaagttcaggcccctttttcttggtctccttttaattctggtgtcaatttcctttgaaacagtagcggaatggactggctgctcttccttatttcacataaatgatttttagatacctggaactttttcattacatctcaatgaaaaaggaaaggagtaaggctgacgtgtagctgcaaggagaaggagcatcctgctattgagccctagttaaggggcacgtggaggagtcatctttctgtcctcccttgctaggagtgcagggcagttagaaacgtggattcaaaggtggactgggagaatttactagaatgcccaaaacagggctgcattgctctaggggcacacccagacctgggcagcagtcagttgaggcattcatctgaaatgtggattcctcggactcaccccagtcctgctggaactcactctgggattggagtccaggagtctcatgtgagttgaggatgccatttgagatggagagtcaaccatgttaaattcttaggatctccctcaagtcccctaattttcaaaaccatgttaaaaaatgtccacttctcaatataaattgtcattgatagaaataatctttttttaaccttccaagtatatgagcaacgtggattcatggtgtaaagcttgcggtgaggtagaccttccctcagagctgcaggacctagaagatgccattcatcaccaccagggaatatatgaacatatcactcttgcttattctgaggtaagtggccagttttacttacattgcaaagcagcatcatttttgcatcatagtacaccggaagctagaaaaaaaaaagttttgggtagcccagaaaaagtttatagatttcgagttagactgcagtttaattgtttagcatttgaacccctgtgtgtgtggggagtggggtggggcagtaggggaagcagaatggtgtgcaggcagtagcctttccgatagagcgcttatatgctcagctgctacagtcaaggaaaacctagtctttttttctacatgtatttaagaaatgtgtattttgtgtgctcttcagtctagtcaaactcaatttaatcttcccaaatgaaaccttttagagaagatgggctagattgcaaggcacacatgtgtctattttagaaatctaagtgtaacattttctttattactttagggtgtattacattatttacttagtgaatccctgttttattttctgccaccttctatgccagactgtattgtaaggactttatgtaatgactgacttaatgctcacgtactgtatctgttcctgctgttcctgctgaagaaaatgagtcacagagataaatgactgcgccaggtcagcagctagtggagcagggttagcccaggcaggcaggctgcatgttctcagtcaccaccctctgcggcctctgtgccataccacgtggtagctgcttgatgatgcaactttagatgggttgacgagtaccacccttgcccatgccttgttcctctggcccttgagaccagcctacctttgtgataatagttacgttcctggaggtgaaggcgaggggtgtagagaggaattctgtgtccttacttttctgcaaggttttctccctgagtaagaagcatctatatctacagtgttctatgttaatatgaaagattatcgcaaggcttctgtaagagtttcacagcacctggaagagtgctggacagtgtagatgtttaataaatgctttctgtgtttaaatctaaatcttgatccaaacacatccaaacttgtcaaagttgttgggaagaaagtggccatttgcatttcattctgatatttcctgttgtgcttcactgcccagctgtcactctcatatccttgggcctgcctgtcttgacatcctagtgtccctgagcgaattaaatggacatgtgatttgctgctacagttttgtgtctcataaagatgttttggtcagtgatggactgcaaataagacagtggtcctataagattataatattgtattttactgtactttttctatgtttagatacacaaatacttagcattgtggtacagttgcctacagtattcagtatagtaacatgctgtacaggtttgtagcctggagcagtgggctgctccctatagcctaggtgtgcagtaggctgcatcgtctagctttgtgaaagtctacattgtgatgttcacacaaggacgaaattgcctaatgattcatttctcaaaatgtgtccctgataccacgtgatgtctaactgtatatttgcttcagaatgtgggcagtccttctctttcccgtggcagttggtatttgtttgtttctttagccacctttgcctaataagatacagttttttcaagtaacatttcgtgttggctatggaattaagaaagtcaactctgtattgtttcttaattttgcaccaatgtttcttaactaatttggttgtctagtctgttagaaactatttaaataagtgatagccttttctatagtaaaactgaaaattgaacacatttataatttttttaatcacattggctcatgaggattatgtcacttctaaaaaccatcaagttctttcccgtgatgtgccatctctatgcattgtctaattttgacctataacacagaaagcaaatgaccctgttactcacacatgtaatgaggcctccactcatctgcttatatgaatctcttgctttggagctgttctttgaatgcagtggtgggcttgcagccagctgtctgcatgcccttgcccttgccaaaccaagatgggcttgaatagccttcatttacaaggtgattggcagaccctgggaatacagtctttgtgcataacttaaatcagaatcaccttgacccagccagtgtcatcctccagccaagctggctctttcagtctgcttgttgctctcggcagttttcattaaatacagaatctcctaattgttaccagtgcattctataaaaatggggcatcttgacacaggaacttatgtttacctgtggtatagttttatttgatttacattggtaccagtatctcaaaataatttgataggaagttaaacagcctctcaaactgaggtcttagatggaattttagcctaagaacatgtttgcaactgagctgtaaactcaaggagacagtaatttgaactggatgaactgaaaggattttcagtagaacagaatgaattattttgcctcttaaattatttacattttgaaatagtttcagggctacaggaaagtggtagaatagcacagagaactcccacattgcctcgacccagattttccaagttgtagaatttcactacgttgctccaccctctctccccactgcctctctctccagtcagcaaagcaccattgatacaacatgaccatcatctccacagccactgatcctatttccccaagtgttccaatgatgcccctttctcttctggtctggggcactgtccagcaatgtgcgctacatttaattgccatgtcttaccaatcagtctcctttaaaatggaacgttctttagtctttctctgcctttatgtctttgacatacttaaagagtacaggcctttctttctttagatggccctctacttctggttgcccccagttctcgtgggctgactcaggctgtgcctttttggcagtgcatgtccttctctgggtgtcatcacagtggacagaggatactgacctctccggctatgagtagtgttcatcttggccacttggtcagattggtgtctgcagggtttctccaatgcacaggcaccatttaaaaaattagtctttgctgcacattttgtgggcagctactctaatagaataccagtctctgtttctcatcagacttctcacagccatagtttccactgaggatttctgcccatagcagccaccactgtgatgatgatcacctatttccattattccttctgtatttattaggtggctttctaccataagaatgagctgtatttcctttctcttttgtttgtttatatcagtatgaaagtatgagatcttactatatcagtcggttataatttgatactcttttgattcctaaattgttcagacttggccagcaggagcttttttctgtgtctttttgatatgtccttattgtcctttgagcacttgttcccagctcattttgtactttccctgcctaccctgggatcactcgtctcactaagtgggatggttccttacagtattgtatggtgtttagaattttaaagacctgggttctcagagttttgtttgtttgtgaggtgtcactgcttctagaccctcttagcagacagacttatgaaacatatgaatgccatccattcacccatccatccgtctatctctgcatccatctgtccacctaaccacccgttgttcatccacccgaccacccatccatctacccaatcacccaaccacccatccatccatccacccacccacccacgcacccaaccacccattcatctgtccatccatccatccattcagtcacccatccatccatccatccttccatccaaccatccatccctctatttatccaatccccatccattattccatccaaccaattacccagccacccatccgtccatccatccaccctcccaacctccatccatttatccatccatccacctaatcacccaaccacccattcatctgtccatttatccaatcattcattcattgatgcgttcattcatccattcatccaaccagtcacccaaccacccattcatcatccatccatccatccatccatccatccatccattcattctcctaatcacccaaccacccattcatttgtccatccatccatccatccatccatccatccatccatccaattacccatccattcatctatccaaccaaccacccatcctacagccatccacctacatttatcaatctacccatctacccatatccatccatctgccgtatcactaaattgcccatccattgactcagtcacccaaccacccatccacatttgtctagtccatctgtccatccacccagtcacccaaccacctatccatacacccagtcacccaactgtccatcgccacctcatcacccaaccatccatccacccacgcagtcacccagccactcagccactcattcatttatctatctacccaccacttacccacccacccacccatccacacattatctacacatgcacatacacatccatataaaattactgctgtatctatctgtgtctatctgtattaaaaatacatgtgtttgtgcatttcgaatccaatacctcagggttctttccatcctttccctttctaagtttgttaatctattctcaggcagcaagaaacctggcttctattttccttaatgtattaacttacttgttcacttggtgtatttgctccatttcccaaccattctgtctgggttctccacctccaactcctaccacccactcccttaacctggcacagggacacctcttttggcacctccacccctcacttcctcattttcttcatgccaagagggaaggtgtcaggaagatgggaagggaaggactgcttttgttttgtaagtgatttttattttatattcctaaatcagtggtttgcagacttgagtgtcttggcttaaaatgcagcagtactctaccccagagatagtgaatctccattttcagaggccttccctagttctgcagtgactgatgccaatggtacacagatcacatgctgagcagcactcctgagcttgctctgaagagctgggggtctgctgaggaggtgtccatctcacagatacggagcccctgctaagtgctagacattgaactggatgccgggtcatgtggggttaggagtacttataagcagggcttgctttgcttttttttatttccttttccttgcctctctcttcctgtccttccttattccctttcttctctcctcctctcttcattttctctacaattttttttctttgaacagggtttatagtttctagtctctgatcatataaatttgctttgggaaactttcccagcatttttcttccaagacgcaagcacctgctctgctgtgctttaattagacctgcccgtgtcactcctgtttgtgctttagcaacaggaacgcacctgggcctcctgaacactcacttgcttcagcttgccagctctgagcttatcttgttggctacagttgatcacaagagagtgaagcagtgtaaacgtcggagataagttgtagtcatttttaacattttaagtaagccaactcagctaccagtttttcaacaaactgaatttataaaaatgattttcatctcagtgtgcctgtgttgcctcacaagcctcaatgccaggtgtttggattgcaaggtgagactgcatagtaagcagccacacatccaccaaagggccactgctgcagccacggagcacaagcaaggcgaagtgccatggggcgttggcctgctggatctcatgtgacttcagggcttagattctgcatccatttctcagtttaacaaatgtgccaacttagtgtgtgcctcaacagggcctcatgggaatgactgatttgctgcctgcaaagctggttgagctcctgtttaaaggcactgtatcagtgggtgatggcagggtcagtgctattagcctaagatgaaaacacacagcaaaatgagtcacctggataggaaacttcttaaaaccaaaaaaccacctctccgtgatgtgtgtggaagctcagttcccttgcggtagagtcacttcttttttggcagagtggagtcttcttctgttgcccaggctggaatgcagtggtgcgatttaggctcactgcaacctctgcctcctgggttcaagcgattcttgtgtcttagcctcctgagcagctgggattacaggtgtatgccaccaggcccggctaatttttatatttttagtagagacagggttttgccatgttggccaggctggtcttgaactcctgacttcaagtgatccgcccacctcggcctcccaaagtgctgagattacaggcgtgagccaccacgcccagctgtcacttccatcacagttgtataaagcctcattaaagatcgcagtgttgctgtagcgacatgcagtgctgtagtcagcatctgccatagtatcagagccaacagcccatatgacagctgtcttcttctcaccccaaactcagcttgaggccttgcaagcacttgaaatataagagcagcaaaagtagagcccaggtgcagcctatggaacacacatgtcaggcatatggaactgactcacgccaactgggctgctccagacgtttcctgttttggtcttattttggtttttcctttctgataatcccaggtttacaggtgtcagagagtcaaaccaaggtaaactgatctggttttgaataagaaactgaatagctgaaagaaatagaaatcatcatttggaggtccatccaataagaactttgcctggagaaggaaccagctttctctgtgttctccctgaagcatgggaaagtatctgtcgttgggaacacacatgacctttcaggaggtaattgacctgcactgttggtaggagcatcttatgtagccatctgaagacagattggaacctccttactcagaagggttcgattgtttggccaaggaatgtcaactgttgctgcagaataagctgggtggttacctgctgaccccttttcattcttttctgctttattagaaccttgatatgagaataagttcagcaagagttggagaggagagtgaaatcattcccaggcttcgtgtggaggtctgtgctttgcaggccatggcgagctaagcctgaaaaagaattaagacggtgttggctttgagtcggcagaaatagtgcaattcatttcataaaagttttgaaggaacactttttctttattacaggctaaatgtcttggtgtattttgcctgtttttgttgtatcttgggaatgccattttctagcactttttagatctaaaacactgcgtttggacctaattgatatgctgtcactcatctttatttggtctttgggcagttgttgcttttgcagtggtaagcaagaatgtctagatgctattgtctttccttaggtcagagccacgttcatcccttgtgcaggtgaagaatattcctgctggaaacgctcagccctcatctgattttacaggaaacgtagagatcccagtaccagaaacaagaataggcaaatctctgaagttttatggctctttttaagggtgacatgcagaaatccaagttacaagtctatgtgcagttctgatgaacagtaaatattcaagaagcagcccattgttctacattttaaatagttatactaccttttaaatattaggaacaaacatatctttgatatggtaaaattttaaacttacctttaattactttttctgctttagttagtacttgcatttttctgaactcatttggatatcagagcattttagtttctctttataaaatgttaatctttgtaatatgtaactttgattgcccttcaagttccccagctgtgtattccaagaaaaacaaagagcagactgaaaaatgagctgatctgatcggttcaaaaattattataggaaagtcctgctatttaataaggttgattttctttttgcagctgttgtctctttgtggctcagagtttcagtgcctggaagctgaaaacagagttttaaacaaaatgtataactgaagtaaattcactcacctggttcagtagttaagaaactgtggaactacactacatgccataaacttacattacttgttttagcacttacattttatatgaatttttttgtctgctctatatagtctcttctttcattaattttctcctggttattctgtaccatttaaaaattattatctctatacaacagaacagcagtcctcataaaattgtagcatgttgtttccacataatattactgtaattacaaagactaagacattttgccaaaagtgaaaactatatatgccatcctttatgtgcttaaatcatactttttaattgccaaatctacaaaacttgtactgaaataatatagaatcatatttggaaaggtttattggcgaaatgctgtttttgaacatggatttggagttccatgctgtctggttttaaagtgggtccaagaggtgttatctcgcccagggtctttactgccgctgtcactatcagtaaatgacagtaccagtggtgggaccaacagacacattaatccctgcttatgaattctcagaaggtggagctttccttaatgagttgttttatgttaaggtatttgtgtattgactttctcagcagacatttcccactacccctccaccgccatgagcaagtgtgtccttcgaaatccagtcatgatctctggcatggagatctgttaaacagttgcagagacactcaaggaaagaaatattgcatggaatgttgttgcttagagtactccattctcagtagaagaatattaatggtgtcacagggatgagttttggaaacttgctgagggctgggaactcatcttgtccttttgcatttggtggtttaagttgcaaaacaatggcttaagatggaaattggctttctccctgtgtaaaagaaatccaaaggctgtcattccagggctagtgtggtagctctattagtaagaggatctgtggatccttctgtctttctgtgttgccttttttagcaggtaggctgctgttcttaagattgcctcagagtcatcaataactgctaaagctccagctatctcattcaagttcttggcggcaaggaggaggaagggacaaggggatgagcatacctgccagcttagcccctaaacagctttcctggaattcccattcaacattttttacttttgtatattggccactcatatatgtaagcaaggctgggaaatgtggcattacagctggagtgttgctgtttctgactgtaggggtttggctatcaaggagggcaagtggactttggggaagcagctgtcagtttctggcacatgttcaccaaatcataggctctgatgtacattttccaacagtaatgcaaggagtaaaatgtagaggaaatatttgtaaggaattctttttagggttaacaccatgtgaaatgtatgacttggagcagtagctctcagttctaagagatgcagcactccaatgatataacacaaattttatgacacctgctttatgatcctgaactaaaatgcatacgtagtttaatctacctttgcatataatttatatgtgtacataaaaattatatgctacattgtaagttggagacaaaggtgatttatgataaaatgtttttcagtctataaatgcctaaatacatctattgtaggtgaaaaaattagatattcagatgctggtcatatatataaaactattgtgaatatagcaactacaactgtagcctggtcatgtggcatcttggtgatgcgagtattgagaatggttttattgtggtcatgtgatattttgaaagggaaaacagctcttgtaaagttccaaagaaaaccaaacactgtctttgattaacatggttgttggatttgtgggaagatcagtatgttaaaactgggcaaaagagaaaaaccgtgtatttatgtgttaaaaacagccttgcctagatgatcacgaaaagcaggacatttcttcaccatgtgctaatatcctgctcatttcagagtaccctgcttctctgaatccaccacccaaatcaatcatggtgcctcctctcttcaaaatctttgcatcagcaatgtccacaccaatttcagtgacttctgggcacaaatgagaagcctgcttgagaagactgtttaaattttccatttttgttttaactgacactaattcagcagttaacttggttggtttttcctttattatctttggttatgtcagctgagctgatttcctcccaagttttgctgttaggctgtattaagtgaattttaaaccctgaagccttcgtaaggaataatcagcatttccaacgtctcaaattcaggtattgaaaagtaaacgtgttacaatctggcacaactgcagttagaagaggattaaaggaagcgattaggaaattctgcagggtcacttgccaccaggttttggtttaaaggctctcagtgttagcttttcccatttacctattccctgtgtgctcttttttattctaagggtttcttctaaactgggcttgtgtctgttaaaagtgcccctgaacttgctcctctttttttttttttttttgagatggagtctcactctgtcgcccaggctggagtgcagtggcacacgatctcggctcactgcaactttcatctcctggggtcaagccattctcctgcctcagcctcccgagtagctgggactacaggtgcccgccaccacgcccagctaatttttgtatttttagtagagacggggtttcaccatgttggccaggatggtctcgatctcttgaccttgtgatccgcctgcctcggcctcccaaagtgctgggattacaggcgagagacaccacacccggcctgcttactagaaactcaaagaggtttttagatttggaagtatctaagctgaaggatcatgtgaagaggccctacctacttaagacacctgcatcccacacctggttaccttatgcatctcacacacactttgtgttgtctgattgtcactttttttccccccaataacatctggcgtaattaattactcataagtcttatgaatcacttttaagtaggaaaaatacataatgtttttctttctaaattgcaccctcaccttttcttatttctttgattaacccgaatactttcatttaattgtagtttgagaataaattgccataatatagcacttgatggcattttaattaaaactaccttttaaagttaatgaaccaaatagaatggcattttaaattttcttttgtgaagttaaattgctctccagctatgtcagaaagtttaagtacatattctatgcctagtgctagattgatttttttgttttaactgaggctttaaggaacaattttgttccattgtgatgatctgctgtattctctttaacatgtctcgagataaaattattacttttaaattttaatttgcagatatcccaggaatgcagtttctgttagttgatttatggcatttaaggcaaatagtatgcctattcattgagtggtatctactacagtgttttgtagtaattaatgttcttttattttcacctagtgttttgcatcatttggctttgtgatgtcattggatagctgatggattgttttaaattttatcctatataaaactgcctctgagtaaaactgtggtgtgtgaatgaatgtctgggcatgtgtgtaatgtgtgtacatgtacgtgtgtgcctgtatgtgcacacacatgtatccaaggacagcatctgtggcacagcctaggccaaacctcagatcgtgaagaatcactcatttcttttgtgggcaggtcagccaagatgggaagtcgctccttgacaagctccagcggcccttgactcccggcagctccgattccctgacagcctctgccaactactccaaggccgtgcaccatgtcctggatgtcatccacgaggtgctgcaccaccagcggcagctggagaacatctggcaacaccgcaaggtccggctgcatcagaggctgcagctgtgtgttttccagcaggacgttcagcaggtcagtttcgcctcatgcccttctgcatgggaaatggcttgtgttgagtagagtttaaatacatcatcatattgggaagatctgtgcttaaggagtgatgactagaagataaggagaggagcttttttgttgaatgtaagtgaaaactgggcttaggaacgcgtgttcaggctgctgtcagccagtagctcctgtgcacagaacccaggagaggatgtggggcctacactgggaagttttcttctagaatcggatcattctcatttatatttatttgtgacaataatgctggtgtgctcacaccagtgtattgttataatttagttaacacttgtctgcttttccaactatgtaaacagtgaggtggtcatgcttcacttcccacgtggtaggtagtgcagtccatggtgcacagtaggtgcattataattagttgtcttgttgatgaaaagtacacttttatgactattcatttctaagcagttgccatctcttttgttttaaagaaacaaaaataagagtaagtccagttccccattgttttgcttccttattatagaataagagttttaaggattaaagctatgggagtaaaatatgacatagctttagggataaataagatgatagccatgtccttgcccccaaatagagggaaagacaagggaatgaatgaggtgtcacctctggggaggaggaatcctggagtatgcagggtagcccatggcctcaggaagttggctgggaaccgccgtgataagcctgcagtagagccactctcaggatctcaggtttccatctccctgagtgtcatgtgaaggtgagtgagttttctgctgaatgggctgggaatttggagagtcgccctgtgttctgatgagactgagattctctgtatgtcattcaccatcattctcatcattcttcacttcatgtgaatctggtaaattcaaaagacgttgaatgggccaggtgcggtggctcacgcctgtaatcccagcactttgggaggctgagatggcagatcgcttgacgccaggagtttgagaccagcctggccaacatggtgaaaccgtgtctctattaaaaatacaaaaatcaggccaggcgaggtagctcacgcctgtaatcccagcactttaggaggccaaggggggtggatcacctgaggtcaggaattcgagacgagcctgcccaacatggtgaaaccgtgtctctactcagaatacaaaaattagccaggtgtggtggcgcatgcctgtaatcccagctatttggaaggctgaggcaggagaattgcttgaacccaggaggcggaggttgcagtgggccgattattgcaccattgcactccagcctgggtgacagagcaagactccatctcaaagaaaaaaaaaaaaattagcctggcatgctggcacatgcttgtaatcccagctactcaggaggctgaggcaagagaatcacttgaacccaggaggcggaggttgcagtgggccgatatcgcaccattgcactccagcaagactctatctcaaaaaaaaaaaaaaaaaaaaaaaaaattagcctggcgtgctggcacatgcttgtaatcccagttactcaggaggctgaggcaggagaatcacttgaactggggaggcggaggttgcagtgaaccaagatcacacaactccacttcatcctgggtgacagagcaagactccatctcaaaaaaaaaaaaaaaaagactgaatggccctgtaatttttaattttcatataccgtgctttgattctaattttattttttgagttctctgaaggttacatatacagagtgcttcaggaatgatcattttgttattattcatgcttcttaacaatgttgttttagtccaagaagataattgccagagaaagaatacagtgcaggaaagaagaggctggagccagtggtgaagagggattgagaggacagacattgtgggaatgaaatcatgaataatcgtgtttttgaattgtccaaaaacttctacaaaccatgaaatgttggagtttaaatctaattgttgaaaaattccccacattccttgtatcccttaggttgagcataattccacatccgtggactgatgcacttcccaagagggggcctcattaactcttccgaggcagcagcagcaagggcaccccctcctttccccccacaccccatttctcatggctcttctttctctcatctcatgcttaggttagaaaagggcacaaggtaaggaagcccttgggaataggctgaatctggctatctaatttggtgccaaatacttaatgtgcttgaatttaaaaacagcaaacatgtagaaaggtaattataattatgaggccagttctttaagctagctttttttcccctctcaaacagcatattggcttggatgtcagcaggagaaagtgttttttgcaatacacataatgcatatatggtcctgttagcaatctatagaaaatagatattgctcattaaggtaaatatttttgttgatgaatgatctggaatggtctggacttgttgtgtgaacaggaaattgctctgtaggctttgacttgtgaggtaaagagtgaggctggtaagattaattaaagtaaatactgtgacaataggatgtcaaaaccaaaaacgtgtttctgaaactcaaggaattaatgacacatagggaagtttttgccatattaagcatagagtaggagaggcaagtcaagaataaatgaaagaaaaatagtagtactttagaaggacgttaccagcagaagataaatttgtaaagacagtagtaaccgaaatccataaaaacatagtaagccggttagagacacgacagtggttttcatttgattgttttgagtgatgcaaaagcacctgtaagtacattgagaaaaaggaagagcaagttactgaacaataggcgaggcatggaatgattacagttttatgaaagtaaccccagaggagtaaatgcttgtctgttgaaaaatatttgaaggagcaaatatgtctattagtgggccctgaggaactgaatggggaaggatgacagagggagtttggtttgtaaaacatggttaattttggtttcgaggttaattttttcccctcttaataagcgggggccaattcataacttctgtgtagaaggcattttggatggtagtcaggcgtggcgggaaaggtggttgaagctgctgtgtgtagcacacttaccgtgcttccaatttagagctgggcggggaattgggaagacctgctgaggactttcccagatgcacatgctggctgcctttgccattgttcacttaaaaagaaaatggaaattttttatcacatttcctaatgatcagatatatacatctctccattgccttatgtttattatcagagtaactctcagcgaaggtttggttgaatgaatgaataaatgaatagctgtgttactgctacacactgttttctagtttagagtatgctttagttttctctaggaaggtaactcatttttgctttacctgttcagatgggtagtagtagtccaaagaggatgccatcagacttgtttttctgcctcaactgttcggctggcgtggctcttcttggattgttgagattcagttactctagcatgtcaggagcagtgagtggccccatgtgtttgctttcctgaagcctactgagtcccctagaggaagcccctcagcagggatgccttctgcaaagcccccgtttcccccacagcccttcatgtgtgagcgccacccccttgcaagtgtctcttggcaggaccctccagggccatgttggaccattttttaattaatattctttaaaaaatgatcaggcaaacctagtccactctaaattcttcttgtccagtctttattctttttttctctttccaaaataccttaattgaatgtgcgatgctctgaaagtttcagggataaatatgttgacagggtccaagttccttttctcaaggaatttataatctgataagagcagattatttttagcagatagttttgtagtctactaaatttgactgtgccaggctcatctgcaacactcatgtctttggttattgtggagtataatttgctaaggcataaatttgaatcctccttgtcaaggtgctatcaggagtgaggggtggatgaaacttgcgacctcttctgtggtgtctgattgccttgcagcatacacattttgatggggcatatctacacttcagtgatttgtgcaaatttgagtgttcctgagagctttttctgaattcttctcaaacgtcaagggtctaatgcacaaggaaaaatgaaaggtcctatagtagaggggcaagtagcagctatcatattgagggctactaggaatatcttcgtggaagaggtagagtttgagcagctgtttgaaggatgaggagaaggtcagtagattgaggagtgggcaatgggaattccagcaagagtaggacagaagaggcaggacccatccaaggagcggcaagtgcctagtgtggatggagaggtatgaggtggggctggtgccagcaaggtaacatggggtcaggcacagaaaacgtggcccccacgatgagggttttgggcccctgttgaaggagctcatgcttacctgcgccgaatgccagtgcatggtgcaagggctgtgtgtgacttctgaacagcatcaagctcatcttggtgctttgtgggtgctcactgccatgtatgtgtctttcctctctgcatgctcacagctggcccattgaactttacccatttcacctcatagagttcaaagcccgaaggatctcctattctgtgccttttaacttgatgctgtaggcagtggagggtggatagcaggagtgaacctaaaggccaggaacctggttaggttcccttgtggacgcctgatatggtttggctgtgaccccacccaaatctcatcttgaattgtagttcccataattcccacttgtcatgggagggacccagtgagaggtaattgaatcgtgggggtgggtcttccctgtactgttctcgtgatagtgaataagtcttgtgaaatctgatggttttataaatgggagttcccctacacaagctctcttgcctgctgccatgtaagacatgcctttgcttctcctttgccttccaccatgattgttaggcctccctagccatgctgatctgtgactccattaaatgtttttcctttgtaaattacctagtcttggatacgtctttattagcagcatgagaacagactaatacaacgcccctgcaagtcatgggtgagtaagtcttggagagtaagaacgtgaggaccacagagacagccatcagtgtttcattcactggtgtttcccaagtgtctggaagagcagatgtcagtatttgttgaatgactgaatgagtagttgaaggaatttaaggaattccccaattttgctaattaaagattctttggggttaaaagttgcttcatttcttttaaaatgggggagggttggtcttatatctgggagatctgcctgaaggaatggaatctttgattgatgttggggaactaggggtgtccaaggaaggaagtgataatttcagtgcatgggaattttggaagtgtgagatctctcatgaggattttggtcatttgaatgcaaaatgagggtcttttatgctgaattccatctggaggagggaagttggcatatgcctaagaggcaaagcaacacatcccaggtctatagagaagtaatttcacagatttgcctcaggccccagcctatttcttcggcctgcaaaagccagctctgcaggaagcctgactcaggagctctaggtttagcatcacctacactagacctagcttttaagtgaagtttgagttcctgaactcccttgtcatctgttcattgagtcaggagggagttttctgattccagtcatcagaatcatatagccctagctgtttaacacttgcttctgtttacactccagcactcgcagttttgattgtgtctcttaattagaatggctacaggattgccatcttctctgagttctctattagaattagggagtgctgagtggaggcacaggcttggttttggattgggaactactgggcgcaggtagaggccacctgctgatcttcctggtgggtctagagccagctcctaattaaccttctgcagtagtgagcacagaggaggtgggactggaatccagccatcataggaaccacagccaggatggagctgcagatttaacagtgagaggacaaaggctggggaaagggctggctccctcccacacacccctcatctaaaacatcttcaatgtcagtccgtggtgaatgctagacctcaaaagttcccattcttcccctggtccccaaagcccacaaatgtgtgttgaattctgtgtctgttttatttcacttttaaaagtagtctcacacacaatagaatttgaagctggagccccctcattttccaggtaataaaagcaagccttggaaaagtcgaatggcttggcagaagcaccgagaacctcttggtgttttttctgtgtcaccgctctgggtctgaggaggatgcctaccttctaagctaagcaaagagtaaaatcaacgtgatactgaagaaagaatctttgagtggtgcttttagtcacagggaacaggctttcctagaagctgcaattgcccgtgaccatgaaggaaaacagccacttaagaacagagagagagaggagtttagtcctttaggagggaatcaatggaaagggaaaaggagctcccatgaccactctccagccccactcagctatctcaggcctcccttgcttcgccgcatggcgattagacagctgggggtgaataatgcggtctggggtctccctgagcttggcctccgtgggagagggaaaaataagaccagtgatttcatgagtaaagtacgccagagcactaggaaagaaagtgtgagctagactaacacaggatgagtatatgaattccagtaaactcagaaggattccttcatttgtgatttttactttgtaggtaaatttcattagtagcataatattgactatccttacagcactgccaaacaccagcctttaataaaaattaacattatctacgtgaaagtcttcctttatggccacctactttggtttaaccgatctgaaatgatgttgcttagtcaatgagtcatcttttgttgtatatccctaaaataccattgatttgatagtccagaaagctcagaatgtaatatgttcatttctctatcagtttccccagcgatttaaataaaagacagtgactgagtaactaaaataaatggaaccaggttgttaattttggttttatagagaatgtgggctggcagggaggaaatctttattttgcaactggaaaaaaaatctgactttgtataaaaaagaacaaattcagagtattttagatttacctttgcttttcatttgtttcatgtattctttaaatggattatagaatcagaggagcttattttcatttttgtgtgcgtaagatgtgacttagaaggggttctcattgttttgacttaaaacacactaattcattatgtattgtatcttgagaacagtggctacagttgacagatgattatctattttctctgtgtgctctttggatgcagaattacctgtaaaaacaaactagcttagtatgttcttggttgctttatgtcagatgtattatgtagtttttcaagtagcaattctagagatgaaactctagttttagaaatattttaaagacagtatttacaaactgaagtggaatgtagtgagcttggagttgagaagacctccatttgaatctcttttcttgggcaggttacttatccgagcctcaatttcttgcttaatagaaataatgattaaagtctgctctctttttatttgtagcttttatttgtgattcagaattcagaatttctcaaagattagaaaagtaacacagtgtacaatactaacacttctagtggcatctggacagcccccccataatcaaatgcatggctatttctatagctgaatgttcaaggacttgcacttattaagtactcagtaaagactatgtaagtaccctcaggttaggttttattgacggatgaatttttagaaccaagttttgaaaaatatttggaatttcagagctttctgtggttgagatcatggaactgtattgccctcccaagcagagcatagaacagtcattcaataaatagagctgatggcaatgatgcgatgcatgaccatgatagaaaaccattctaggaagtatttgcaatcaacacctctgcatttcaaagggaaaatatcatttacattggttttcacatcgtatgttgttgtgaggtaggctttgaaatactctcctgtttgatgagggtttagtatgtgtttcttagtctgtgttgctataaaggaatacctgagtctgggtaatttctaaagaaaacaggtttatttggctcacggttctgcaggctgtacaagaagcatggcaccagcatgtgcttctggggaggcctcaggctgcttccactcagcatggaaggcaaaggggagccggagctgcgtgtacagaacacacggcgagagagaagcaagagaaaaaggagggaggtgctgggctcttttcaacaatgagctcttgcaggagctaagagttagactcactccctcccttgaggtggtatcaggccattgatgagggatctgcccccatgactggaacacctcccggtaggccccacttctgacactggatatcatattgcagtgtgggacttggcggggccaaacaaaccacagcagagagagaaagagagagagagaaatttttaaacaaatttttaaatagtaattactgagaaagaggaatccgtaaatactctacaagaccacaaatactgagtattaggtagtagggacctactacagaaaataattttacaaatagcttatacaggatgccagaactctgcagcgggactgaggaagcattacctgtggccagttcctgttgcatctaatcaagggttggtaactattcgcagatttaccctaactcagttttgctgagcgttgtgacagcgtcatttcctaagaggttacttacccaacagcctgaaccattctgaaacaaaagcagaggtctttcctttttcatctcacctgtatgtcagggcagaagcagtgtagacgggaggatgagccctgaggcaggcatcctggcttctagtgcacactcaggctttcccataaagtcacagagggccctgcctgtgtcttcatctgtaagaggatagggatcgccctacccctggctcactgtgaggatggatggctcactgcacacacagccttaggtcaggggctgcttccacagcaggtgctcagatggcgagatgattgctggtcaaatgaccgtaatcatgccaccatcacgttcagtcttgcaattaggaccttggtttccttttcattacaaacagggagttaagctaaacattctgaacagctttctgccttctgacatttgacttaggtgctgagcgatggtagctgtttcaagtgtgcacggtccactttggaacaaccgtgaccttgggactgttgttttgtccattagagggcactggtgtactgaggaatgagcccacaccacaccctctgaacagagaggaaggtggtggtggtctccagctttactcttctgcctctgtgcagagtagccgtgggaagggatcagcttttgtgtttttcatctggaagggaagcagcaagccccaggccagccttattgtctgtggagttgaggacacagagcaaatagataacaggactgtctgggaagggggcggaggtgcagctggctggactggatagataaaggcctgtaatttgcttatcttagtatgttttaaatgggaagatttcacaagcatgtctttaaaatgttacttagaccaggtatattgactcaggatcactgggtaatctgagtaatctacccatacttagaatcaacagcctcatggggagtttggttttgaatattagctggatttcatagctgtctgcaattatttattattattttaaaagtggaaattatcattggaatttgtacatattcctttgaattattttcatgtttattggaaatacgatttcacctggtatttacatttctgtctgaaggaatcactgttaaaagaaaaatgcccattataatcctgagtggttggtttatagcagcttttatttccaacttaaaacttcctaaaatacttggaaacaaatttcttttttatttttattttgttgttgttgttgttgagatggagttttgctgttgtagcccaggctggagtgcaatggcatgatctcagctcactgcaatctctgcctcccaggttcaagcgattctcctgcctcagcctcccaagtagctgggattacaggtgtacaccaccacgcccggctaattttgtatttttagtagagacagggtttcaccatgttgaccaggcgggtctcaaactcctgacctcaggtgatctgcccaccttggcctcccaaagtgctgggattataggtgtgagccaccgcgcctggccagaaacaaatttttattaatttaaaaatgttgtattttgcttcctctggccctttctaccaaataatgtttatcttttattttttgaaattgtgcccttatttcaagtctctatggactttccagtaatcatcaggtttgctgcttactggtgacttaatttttctctttacgtaagttaagtaatataccgaatatattatataatttaaaaaaaagtctccttagccctcctgtagatcttacaggcaggtgaactgtagcagaggtgttacttatgtacctctaaattcttttcaagctagaaatatttgatacttctcttttgcatggtttggcctcatgcccaggagcacattccattaaatgtatccattctcaaggccgagaggtccagaagttgtccttgagacatttctttagccgtggaatggacctgtgttttataatataaaagactgtgggacaaacaactcagcaacgctttgtctgcctcgaaatcaggtggtgaatgtagcaataccttataggactctctttttaatcccaagaaagaaaaataatgtactaaatacatgagttaaaataatatactcaatgcatgagttaaaataatgtgctcaatacactaatgtgctcaatacactagttaaaacaatgcgctcaatccaccagttaaagtgcacgcccaatacgctagttaaaacaaagcactcaatacaccagttaaaacaacgcgctcaatacatgagttaaagtaatgtgcactcaatacgttaaaacaatgtgcaagttaaaacaatgcactacttaaaacaatgagctcaatacgctagttaaaacaatgtgctcaatacactagttaaaacaatgcactgaatacgcttgttaaaacaatgcactcgttaaagtaatgtgcactcaatgcactagttaaaacaatgcgcccaatatgctatttaaaacaatgtgctcaatacactagttagtgtgctcaatacgtgagttaaaacaatgcgctcaatacacgagttaaaataatgcgctcaatacgccagttaaaacaatggactcaatactctagttaaaataatgtaccgaatacattagttaaaatggaatatgtacagcctgtgccgtcaggagcttgaaatgagatggaagcttgccatgagttctggttataggcggggatgccatttgccacactgacattaagatgcttgacatagaggtcatcgaatgctgacaactacctgtgactgtcaccactgggcaggtaaggaacctgaagctgagaaggaataaggaacttgcccaagagcacacagctaaattctatgtctctgtataggggggctggaaatggaggggtggaaatgagaccaggctcggcctccacccccaccccacacctcccacacgtctgatttcagtgcctgccagttctagaagggtctgtacagaggaccacaagaggtttgttaaggtctgcaatttacctgtaatactaactttgctagaccttgaccagaaaggaccctctgccaggccctcagatgtgaaggtcagtggtttggagcaatgaggaacatgtcaggctctgatactcaccagctgctgcttttttccccctatatctatgaacatggctgatctctctacagtacagttgatcaagggcaaggaaccacaagctaagccccttttattttgccattagcagagccatggctggttggcttcccagattgccccctagaccactgtctttgctgtgtgtgcccatttgttctttagtccaaggtgattttgatctgcatcgtctgaatgtttgtgtccccccaaattcatgttgaaatatactccagaagaggtggggcttccaggagggaattaggccatgagggcttcacccttgtgaatagcattagtgcccttataaaagaggcctgagagagcttgtttgccccttcctccatgtgaggacacatagaaggcaccttcaacgaggaacaagccttcaccagtcactgagtctcctggctccttgatctgggacttcatagtgtccagactatgaagccctacatttctgttgtttataaattactcagtctaaggtgttttgttagagcaggctgaatggacaaagagagcaccagagttacaacatgcaaagtatgagtgaaccttcaatactatagctgtgcattaacaaatatgtttaaatatttaaaatcttttaaagtttttagtttttagctaaagacatcactgacttagttttttgctggttatctcctatccatcaaagaggacaaagtgggcatttgatgtagtgtaaatgcagttgtccctcagtgtctgcatgatcgcccacatataccaaaacctatgggtgcctaagtcctgcatttggtcctctgtatatgtgggcttcacgttctgcaaatactgtagtttcagtccacatttggttgtggatgcggaacccttctgtacggagagccgactgtacttattttttaaaaccacataaaagtggacctgtgtatttcaaacccatattgttcgcaggtcaactctagtttgttagatattgtcagcgttttgtgatttaagtatgagacccaatgaactactcagttccaactacgaagtttaaaacataagattatactgctttgtttttactttttctttagtgtggtggatttcacctagcaagaacttttaagtaattaaattcatgaaatgcttagcttttgcagcatcttagtttaaagaataaattatccaagctcaagactgaggcatgtaagtgttaggttttacttcatgtgtttgagtcttctaaagaagagatggaaaaaaaatgactctgtagttaaacttgaattgccttagtagtgtagctttaagccttataaaattgctaagttaaattggccctgtgtgacttcctaatcactgtcttatacaatacccagtcagtttggtggcccagtggtgcatagataagttgagatttaatttaatcattattgcatgcaatgtttatacatagaaaggtttccacttttaatgtaagagatgattaaagtcctgctgggaaagctgatgtaattatcagcttgtaattatcgagtgtgttaaattagtatccaattacttcttcccatttttttttctcgtttgcttcttgtttcttacagagttttaacaacagaaggggtcttcattggataaccttaaacattgaacatggcaggacattgtttttatggcatatgtacctgtatttcattgtaggtgctagactggatcgagaaccacggagaagcatttctgagcaaacatacaggtgtggggaaatctcttcatcgggccagagcattgcagaaacgtcatgaagattttgaagaagtggcacaggtaaaacaatggcttctattattttatcccataaatacccgtgtggttgattttggattacagttttaaccacatttgagataagttagcattagctcgatgtgtttgacacctcagatgaggtaaaggctccgatttcagagtgaagttgtcattgcctaggcagaaacatgatttggtaagttgacgctttctaaaatacgatgttcttggaacagaaatgtgacttgggtgtttttgtcttgtttattataccagtgccttttgactactttgtgaaattccagtttataatcaggaaataacagttccttctgcgtttctatagtagtaggctaagccttacttgttctgtttgcatttctttaaatgtgtgggcttaggaaacaggagccgggagtccagtgtgttccgaatgtgggatttgtggggtttgagcactggccgcctgactttggacaagtcgcttaacctttctaaggttaactttctgatctgaaaaataagcccagtaatttatttaataagatttttcttatagtcaacttctttaaactagtgagttgtggcttgatgaagtaacacagcagagattcagaaaggaagtggtgaaatgttatggttgaattcatttaaaaatgtactaaatatagatttattatatagaacagttctggtgttctgagaaggaggaacccaaaattcgaacctcatgtttaggtggtggaagcgagtcatacagtgtaacttctgcagacacaagacctagctgcaggggccctgggtttcagaatttgttttagacacggctgcagtcacctcaggaagcacttggatccattttgcatgcagttttgcagagtcaagaacttcctcgtaactaatttgaaggtcctttccttaattttgtacagtgattgtgagtagctctatcctgttgaatgaatccatgctaattgatgtgtatgtgtggtgtgaatagccatcgtgcattttcatgggctagtgtaaaaaaagaaataaaaaatacttttcatgcgaagctttttgcaaataactgtcaggaagatactctttcatgttaatgttcctgttttagattttaaaagttatgattaaaacagccagtaaagcccagaaaactcaggttcaaggaagaatctggttttgagagcacagaaggtatctttactatcattagtaaatctttggcatagcatccttcctaagtacctgctctgtgaattcttaaaccaccctcgctcttttctgcctatccccctggattcaaattatctttcagagatgtaacctgtcacaaagttattatccaggaagccatttctgtcaacagcttttcgtatgtgccacgtaattatcttgtcttcctggataaaagagtttgtcatttaggaaagcaggagaccttgaattcattcttgatttttaaaagaaaagcagaccagtgactccctggtcatgacttaactcattcatcttttgcaaggaggataactgcctccataacacgtggacatacagaatgtccccacgtgtagcatgctctaaattctgatttgtgacagccgttagagcatgcatatgtacaaaataggctgttgctttgcagtaagtttggttcctaatataagatgtattgtttttaatcttttaaaataaattactagtggaaaattcaggtcaaattatttgctatcaagcattttctttagactggcacgtatttacagggtaccaaatcttctcatctgctaatttttccttattaaaaatacttccaaaatttaccaatatgactccactgctttctgattgcaagacagtggaaaacttcatctctcggagcctcggttttccttgctgtaaaatgatacctaacacctaccttcaccgagtcgctgtgatgagaatacatgtagaaatgcctgacacccagcaggcgcttgtggtgctgtctttgcctagaacagtacgatcattcagattattcagatcttttggtgaatactagccttgtgtttacgttttgggacaagagccactagaagccaaatgcgcctgcgactttgcccttcctgcagtcttcagctgcaggaccagtttttactaaagacggccagaggctgtatttggaatccagtggaaaataatgagacttggctcttcctgcagtcctcagcagcactggaaagcagcaccagaggatgttggagttgtatcacccgcgggccacttcacctcgctaaaaccctcccactcccacactacacaacagtgtgtgtccggtcaaatggtgagagacatagatagttgtctgtgttttgctgtgtccagagaaatccacagcacttcttgggtccactgttagttagcgtttgtggtgctgcttactctatcctgtggacacatgttgcaggggcggtgagcttgtctcttgggatgccgtgttttcccttcacggatgaaaagacgatccctgggaatttgtgtgccttttaggtgataatttaagttacctggggcttttaatttgcactgtagatgtcctggcccatcattcttctgattacatttctgtattaataaaataccttggaggttttcaatatgcagactttgttgtcttttaaaccaagcaaatataatgaaagtatttaggcctcaaatgctcattttccttctttttcctatctgttctaagttcccaaaatcccttattttccattgaattctaagtacagcccctggtcatctttagtgagaaacagccctgcagccaaggattgcaggaagagcaaagtctcatgcacctttgccttctagtggctctttttgtctgcttgagtcctaccaagttctcaagaaaaagaggacaccagttaggcccccaccctggcctggccttaccttattccttttaatccccatggcagggatgacccacacaccacagatcagaaaacggctctagcatgagatgcctcgggaacaggatagtaggagttggacaggagaagcccagtctctcagactctcaaatgctccctgactctgatatcctccccactttagtccagtgtctcagtttcccctcgtgtgaggaactgtggcttaggtactggttgttttaacaatcccagctctgctgactgacttggtggacaagttactgcacccctctgtgcctcgatttcctcgcctgtgaaatgggaaatcaggtagtatccatgtcctgccgcttttgtgaggcacagtgttaagtgccaaaaaggtagcatttctgatgagtatggttgatactagcacaaagaaatctctgttctccagttgcagaaggacccagggaaggtctcgttcccgggaaaacctggccaggggtttcagaggcacgagtgctgacacaggccccaccagccctggcaccttttgtgctgtctcatgttcttcaagcacaagattaaaagggaaataaatgatggctgtttcacgtctcagatcattcagaaatgcacttgtttctttgggacattttaaaaaatatctttacttgttggaatagacgtgggaaggctttcagaaacgtaatacttggctgttgggaggctctgtcatctttagatccacttaccaaatatgagaagtccacaattccaaaactgtagtggtgatcataggaaaacaggattcagctctttagaaatgtgcgtctgtggcactctgggttctctgtacagcttgctacaccgttagcttcattcagcatggaggccccgttgtgcccatgatagagatgcagacacaggagttccgaggtgacgctcagctgggggtaagcagggacttccaagccttcttccctggaaggaagccacctgcaggtgcggcctctgatggctagagaacctttgtaggcaagagtgcaggcagaccctccacagcagagccgttggtgctcatggctgaccatggtcacaggagtgcccactcttgtgcccagaggcacaggtggcagccataggaggggagggcctggatgagagaagccctggaaagcagtcaggaattgttccataggtgaaagctgctttttagatctgtctcgtgtgtgtgtgtgtgtgtgtacacatgcgcattcacatctgtctgttaaaaaccatgtatgtattcatgcgaatagctccaattccagcccaatgccaagagttcactcaagttttctccttcgctatatttataactcccttttctcaaatagagaaacctggctcccattatccctcaggtattggcttacttgtgtaattccattctactaatgtaaccagtctcccaacttggaggccacccctccccacatgacgccctcacatcctgctcagaccctcaccgatgagacgccttccctgctcatcttacatctctgagaaggataaggattcaccttgtttctcaagggaaacccaaagctgacttcctgggccttcttagaaggcctgagctccgttcctttcctgtcctggcatcccccagcgtctcccggggctcccctcccacctgtggacccctccgcagcagcttcctgtaacagcatcagggctctcgcatgccttcctgttggaggaacccacttacagcctcagattattaggaattaaggtgatttttagagtattttagacacgtgtttacactttgagctctttaaaactctggctactttagagccattatagttattatttcctttttctcaaaaaatgtggccaggcaaagtggttcatgcctgtaatcctggtactttgggaggccaagacgagaggattatctgagcccaggagttcgagaccagcctgggcaacattgcaaacccccatctctcctaaaaatacaacatttagctgggcatggtagcgcatgtctgtggttccagctacttggaaggctaaggtgggaggattgcttgagcccaggagttcaaggctgcagtgagctgtgatcacaccactgcactccagcctgggccacagagtgagactgtcatgcaagctggaaaacaaaacagaaaaataaaaaatatatagccttaagtagaaagaagatgagcacagaattaccaacaagtagaaatgtgtgaaaagggatagcaacttatgtttgtttggaatttaacctttaacttgtacttcgagaattatcgtaaagcattgtatcatacggaaagacatagactggaactctctgcttggtgataaaactggaagaaaaagtgaagcaggcatttgttgctgggggccgtctcctgactccaccttggcaaaaatctgaaagctctgagtcacaagacagccagcaattgcctgcagatagtccatcactaccttcaatacaagggttttgatatggggttcaaagtttaacaatctaaaacaacagcgggaaaggaattctgcatagaattcccaaaatcatctctccccatcatatttttctgtttgattcatgtaagtgatcaaaaatatcacaaattgactgtgttgctatatattatggcgcccagcctggctggtctgcttttcacttaccttctgtttctctgggatgttctcttgtgcagaacacatacaccaatgcggataaattactggaagcagcagaacagctggctcagactggggaatgtgaccccgaagagatttatcaggctgcccatcagctggaagaccggattcaagatttcgttcggcgtgttgagcagcgaaagatcctactggacatgtcagtgtcctttcacacccatgtgaaagaggtaaggtgccaggagaccaaaatatgatctgtgcttgaaagggtctttgaactcttttggaggaacctaaatttagtcataatgtgagaaagtggacaaaggtggcaagttgtaagatgtagcccattagtgctgagtgtgtctgcgtggacagggaaaagccgggcttgtgctggctttccttgttttgtgagcgcatggctgcctttgctggggctttccataaagagaggacccatgagggttgggagagacagagaacgtccatttctataagtaggggacctgcgcgttgttggtcagagctgttgggtctccttcctggctgtgaacctgtcacatggctgccaacatgattgcctctggattttacgagacttctctcagatgctagtaaacgtgagtgttacctaatattgagtttaaatgtgccagagccaacctggtacgaataatattaaagctaatgtcataggcatgcacctgttaatcagctcatctcatgacaagaaataatgttatttggtgtgtgaaaaataggtaggtactaattataccttgcatatatgttattcttggtagaaatcatataaagttacatgaaagaaactactatgtagcttctgaggaaaaaataatttaaaataaaagttcatattcagggtgactacaaattgagtagggatgtcaacttaccacaccttacttctgtgtaaaaaagaaaattccctgcgtcactgaggaccttcacagaggatcgtaacttattcagatgcagctcttgatgaactggaaatgaggggcccttctgggtaactggggactatgcacatggaagcttgtggtcataggatgggaaaaaggatctggaagagtaggactactggggaaagaggggagggcgaggcctgacttgcctcatttcaaggcatcagtgctcggagacccaccaattcctttaaaggaaaagaacggcactaccagctctgagatcttggacagttagtcctcagtcgggtcatttgttgctggaatgtttggactgcaggcttccctctgaaaccctgtgaggctgtgaaggagtggaggagagtacacagcaaaccactgggacccctggggtttgcactcagtcctgccccgggctggcagctggctctctcgatcctttctgccaaggggctggtgcttcttggtcccgagatggtcatcaggatagaaactggcacagctaacttcttttcctgctcctcagaatgccatcactgaaattgctcttgaaaattcttaacaaaagaggctatttttttgaggagacacattaaatggacattgttctgtggcagttcctagtcattgctgcacgtgcctctagactaagtttcccactcattgtgaaccgagcttgtctcttgctgccctccagcctctgctagctctttgtcccagcctccctgtggcaccgctaccagagtaatttttctgaaatagaaatttgactaggccgtacccctgcttttaaactaccagtggttcttcttgtatgtggggagcagcctgatacctccacatcctcacaacatagaccacgtttttccttgcagcctgtcttgtgctgtgtcctcctcttccaggacccctcccgctcaacacagtatcccctgatccagaactttctggcacctttgagacaaggatgggcgtggttagccgctctcccttgcaccttctagagctccctctacatgcacctgttaacggcagttgtcatgcgtgtgattgtgtgttactttacatgtttttacaccgtagctgagagagaaggagagggttaaggtgatctgtgtatgaaaacagattgtggcatagttcactaagctgtgacattgacagaacatgggccaggagcacagcagcctggacccttctgagggcagggacctgggcagggatgtccagtctgcaggttcctcattcggggcccagtgaccacagttgccctggatgctgtagatgccataagggagaggcaggaagagtgtcaggcagctgggagtggctgagaggccaaatcgagaggaaggggcagagggaagagggccttgcatctgtggcatgttccagagccaggtggttggagctggtgtttgtgtggcatgcctggccatattctatagcagcttagcagtctgaggtaagggtctagcttccttataggacagaagactcttcccaccaagcagtatttgtgatttaagtcaccttttcaactcggcagtggttttcagaaaccagacactaaaggataactggaaggaaagtgctttttcaaaagctgttacctacaaataattaaaaaaaaaattagccgggtgtggtggcacctgtagtcccatctacttgggaggctgaggcaggagggtcacttgagctcagaaggtgaaagttgcagtgagccgagatcacaccattgcactccagcctgggcaacagagcaagaccctgtctcaaacacagaaacaaagctcttgtccagaggcttcgtttgggctcattggcttttgtaacagcagtgtttttaaggaacaatcttctaataagagcatccacttataagaccatggagtctgtattgtcactaggtttggaaattatttaaaagtaaaaatacattttgttttcattgacttacacaataggaatttctagtatgtatgagtttgtagactaaggagaccttaaatcagttttaaggactaagtggttcacttttatgactgcaggatttttagtgcagtctatgaaaggccatcttagtagcagagaaactggcatgttttcctcgacctgcaccatcttacttgtgtgcacgtcacgtaacctgggaccaaggagggatcggggcccagttagggagggcatagcaggacacacgtgtgcccgtgtgattggcattcaaggacgctgcccgcaggctggaatgctgcccgtttcttcagtagatttgtctttccctgaccagcctgagaatttccctcagttctttttctgtgctgtacaaaagccctgaaactcccaggaatccttggtaggttccatgcgggaaagaatggtttcttcagtcatcgtattttgaagctggttattgaatgaaaactaagataagcttagaacaagtttaattagtttaaaatgaaaagctagatgggcctagaagaggaaatcatgctaatttgctaggtgtttgcataaagtcactaaatgtatttgcatatcagatgaacgaaaaattgctaaaagatacacattgtctgagtctgttcttcttaagcagatcatacaattaaaaattacatagaagaagatagaaaaagtagcttgtcttggctgggcgtggtgattcacgcctgtaatcccagcactttgggaggctgaggcagttggatcacgaggtcaggagatcgagaccatcctggctaacacacggtgaaaccccgtctctactaaaaatacaaaaaaattagccaggcgtggtggcgggcgcctgtagtcccagctacttgggaggctgaggcaggagaatggcatgaacctgggaggcagagcttgcagtgagccgagattgtgccactgcactccagcctgggcaacagagcaagactccgtctggaaaaaaaaaaaaaaaaagaaaaagtagcttgtctttttcatttaggcaaattcatgaagcttttttagaagttgctaaaggctctcgtgacagaagttagtcttccttgctgccaggtgttccacagtggctctcgtcctcactttatctggagtatagttgtcactgtctctttttgcaataaattcctggccctctgatgaacaagtaatacaaacatgaggtcataacaactcactttaaaaaggtgcaaagtcaaggtgatgtttactgagcattagctcaggaatctctttaagaaacccctggaagaaggtggctgccggaagtcttgttgaagaccaggctcttagactccaaaaactgagacctctgtactctggttcttttaccccagaggacagaatagacacttgttcctgagaagagagaaaaggggatgcattttacctaggggacaaatattttctacctcgaggtagaatgcagcaggtggttgatagaaatttcagcccatttgcccctcaagcccagatttggaagtattccaagatgctgttttctctaaaaagaatcctgaggttcgtagcctcctttcagaatgcctgcagcctggtgctttgttctgtttttgttttgttttttaagtatttggaaggaatgttgattggcctgacataagtttgggtttgatttgggaggatctttctcctcctacacgttgtcatccactcttagtccccctgcagtatgcattccccttcagtcctgtgtatggcatttattcacatcagttctgttgataatgctcctgctatttgtccttttttgtttgtcctcctttccttttgaatgcatttttcactgtttatttgttcattcactcttttcactcattcattccaaagggtctctcaaggcaatggtaatgtgcaaggaggtgatacctaaatgaatgaccaaaagaacatgcttctgcttttgtgtgtctcctacattttagacatttgtttgtttctcttggtagcctttaaattccttgaagcccaggaccatgtctcacttacctttgtgtttccactaactagtctacctcctggaattggcagatactcagtgaaagcctgtgaaataagtgatgtctatttctagcatattattctgagatttaatgatagatttagtgattgaatgagatttccattttcaaatacagcaaaagcataactattttcattcattcatattcattcaacttcattctcaaaattaggtcctgagttaactaataattacctttgaaatgtgtgggttatttgaggcaatcaggtggtgacattgagctctcagccagagtttgtttctggaattgattcagttccattgcattgatttttgttctcagaagccaaggtttcccaggaaaaatcattcccacttgaattgggctgtgattcttgctgcgtttaagtaaaggaagcctcttggttctagttctgcaaacttacacactgaactgggacaagtttttgtttagagtaatggctgggaaaagaggaacctttcattttattcagaagtcaaaaacaaaggcctcccagccacctggagatgttttgttgcagacaccagcctggctctgtctttatgcctaacaattgagcatccagtcttctttgtgctgggaccattgctcagctctgcaaggggaaaagagggagaaagccagagctgccaggcttcttgcactggggccgggggagggttcctgggaagcaggtgctctctggcttcttggtacgtgaggctctcggagctgcctctcctctgaccctcaggtcctcaccgagtttgctccaggagtatattgaaaacatacccagtgctctctcaagcacccactgcttagagggcccagatttcttttccttctttcccttgcagagctggagactgcatcgggcatctggtgtttaaactaaacaggaaaactgactaaaggtccacagtgctcattgtgtagactagctgccctccgatgggtgctctgattatcagtggttccagtgcagggcctgtcactaaacaggcctcacttcctccttgggggctttcccatgggaggtgtggctttttactctacatggaaatgactctctgcagccacagaacacagtcattttctgaattatcccagtctctcatgcgccctggattcctccagatgccttatatctcttgtgcaaagttgtctaaaatttggttcccagcttccaagccttgccttttggccttcctggaagtatttttgttgatgagtcgtctgtcattattctctaaaatgatttgctttttgtttctttcattcctatttccaccccacatatacacacatgcttcttaacttaggggattacatgccaataaatctattgttgaaaatgcactaatactatcgcaaagatgaaaattcacaggctgaaccgttgtaagtccatatgctcctcaacttacatgtgtgatggagttatgcccaaataagtccatcgtcaagttgaaaaatcaaaatcaagccatcttaggttgaggaccatttgtttgtacctccaaagatgtcatatctttaaacatactccctagcttttctttttactttttattttgaagtaattatagaatcacagaaagttgcaaaaaaaaaaaaaaaaagagagagaaatggacaaggaggtcccatgcatcttcaccaagcctcccacagcggtagcatcttgcataacctcagcacacaatcaaaccaggacactgactttgctgcagccctcaaggcttattcactttccgcgaggtttagatgtgtatgtgtgcccatgtgtatgtgtgtgtttagtcctgtgcaattgtatcatgtatagatttgtgtaaccaccatcactttcaagatacagaaccatacagaattttcccatcatcaaagggttccctgcactggcttccttcagtgatatctaacccctgctccatctctaacccctggcaaccacttatctgttcttctctgcttctattattttgttatttctaaaatgttacataaatggagtcatgcagcatgtaactttttgagatggcttttttttaactcagcacaattcctttgacacacccactttgtcgcatgtgtctgtagtagttccttcctctttattgctgagtggtatttcatggtctggatatatcacagtttatttaactatttgtccactggggacattcgagttattttccgtttttggctattacagggaaatacacagaaattatgaacaatcctgtctaggtttttgcgtgaacatggttttcatttctttggaacaaatgcccaggagtgcgtttgctgggtcctttggtaagcacacgtttagtttttaaaagacactgccaaactgttttccagaatgagcgtaccatggtacattaccaccagaaatgtatgtgagtgatcttcagctcttcagcatcttacaagtccaggattgctttaagcttgtcagtgagaatggttaaaatccagtatgtaatattttagagtagaaagttcagtgtatatgatcgagcctcagtaatttttgtttaatatgaattatttagctgcgctctttagtgcattaaattctctctatatgcttttacacatttgatttctttatttttctgacatgggtacaaatgagtaattaaatatgtccaccagctggtgaaagcaagaggaaactaacagcctagaactgtcgactgcatcatcagcccctgtgtgactgagcattagatttgaccttggcatcacttggcacctgctggcgtagcattatgtctttacatagactgcggtatctagcgtggcatactgattttaaaaaacaggtggtcttcccattggtgggaatatccaaaaaaaatacatctagtcaattatgtctttctataaaaatataatctttattgaaataattgagaaaatatagtataacaaacacaccccctaaatttgctgagtgatctgggataagttactgtgtagtacctcaacttccttagctacaatataggataatacaatctctaaggaaagtgagacaaattaaattacacgtggaaagcacctcagaatgcttttcttagggtagctgctggccagtgttcttttttcctgtcctgaccccgattgtaacatcgatatagataaaataatacagactttaaagtaaggggcaaagatacaaatatctaggtataatgttgtctctacctcattaatctttgaacaacagtaactgcttaatcttcctgtcctcctccgagtaataacctcactctgatcctattcttaacatcaaaaccaaaagcctttcgtgggatatacacaactctgtccatctccagctgctggccctcagagcagagtagactgctgggaagaacccttacccatagttcccttcatattggcaaaaatcattttgtacacatcactaagtacaaagtatttagatcttagatcccagctaaagtttcaacagaaataagtgatttttttttcctccaaataaacatgtataaagcatttgtactggccagtgggaagagagtgatattataatattatctgaaaggaaagtccttttatcagaataacttaaaacgctacattttttttctgtaagatgatgtaaaattgtggtttaaatttatacaatttttatttgttaacatcggatcactattttcaagtagagaaaagttttatgccaacagagagcttagaagttattgtggaagatcatgcagtgctgatatacctgacacatcatagtcaccgagtagatgattatcggatgaaggaattaacaatatattatcttcatttgtaacgcagtttttcagtagggattgattgaaaatataagactgtccactgacttcagattttatagtttcttgctgagggtcatttgtaaatggagggttgtaaatgtctgctttaattagctgtttgtcagtaggacttgattaatgtaatgtaaaaggtgaggcacttcaacacaaggtcaagagatgaagtgttaaggccttaaaatgcccaattggaaataggcgtacatgaatagccctgttttttttgagacatagtctcactctgtcacccaggctggagtgcagtggtgtgatcttggctcactgcaacctctgtctctcaggttcaagcagttctcctgcctcagcctcccaagtagctgggattacaggcgtgtgccaccattttagtagagacaggtttcaccacgttggccaggctggcctcagactcctgacctcaagtgatccacccacctcagcttcccaaagtgctgggattatagacatgagccactgtgcccagccctgtttacttgttaaatttctgttttaaagggcattttatgattctctatttcttattttgttactcagcttcataaactaaatattttattatcaaagaaccacaagtctttggtgaggaaagaggtaaacttacctgtatgtattttcgtatgtatttctgacacatttgtactgatcttcgttgttcttattgaataggtagagagattggccaacaatgtattagctagagttttgccaggacagcttaaaagctccagataagccaggcttggagagactggtaaggctttttgggttttgttatcatttgtttgttttcccttccatttgttgaggtacaaaaatcagaaccagaagatcaaggaagggttgagctttctgcttgagagctgtgatgttgatgaacgacaagcagaaagtggaccccatcatctctcactttggttcttggtctcctcgaggggagcactctccagacataggccagaagaagcaaaagccccaaatggtgaaggctttgtaaggaaagacttatttaatctaagcacgttcaagcctctgttctaggacaaattagatccctgggtaccaaaagaacttgataattatatcaccatattgagcatatcagtccaagcaactgtgggaaagtgggctgatgccagaagctgaaaacgcacttgtgctttttaaagaaggtggatttcacgcattactcagagtgaggttaatcctaggcagagttctagagacaatttttaaaccgctggtcaggaaaagtgaatgaacaagttataatgtgttaactttattttgttctctactaggtttctggcttgaggaaggacatgtggtggaattagtgggcaggcatttgaccaggcctttcaacatttaatttgtagacaagaaaggaaagtatgggctatctcttagttactagaattagactgttgaatggctataataaaagaatcaaccaagggtgctagcacgagaccaaaactctcctcatcctcccacactgatctccaggtagaagatgtcaggaggcaagcttctgatagtaagacagtcctcataccccacaggtcagtaaggaagtcacgtccagtctggagccacagttagatcagacgtgctgactgacaaaggtagtggtggatgatgctggaccagtcatctcaggtggacctgaggtcctgcagaacagagatgatgctggaccagtcatctcaggcggacctgaggtcctgcagaacagagatgatgctggaccagtcatctcaggcggacctgaggtcctgcagaacagagatgatgctggaccagtcatctcaggcggacctgaggtcctgcagaacagagatgatgctggaccagtcatctcaggcggacctgaggtcctgcagaacagagatgatgctggaccagtcatctcaggcggacctgaggtcctgcagaacagagatgatgctggaccagtcatctcaggtggacctgaggtcctgcagaacagagatgatgctggaccagtcatctcaggtggacctgaggtcctgcagaacagactagtttaatccctggtgtcaccgcctgtaggggagaagagtgcagtcttgccttttaactgactccacgtaacctattcaggacttttatgtctgtatgtgacatctggagagactgctcatcccaattcaggcatccggaaaactactttgctgtgttaagcgctatttttcttaaaaatgggcaaatttccagcgtatagcaaggacaggcttagtgccacagccgaaataattgttgctgcattaaaagctttgcaagtgagactgtcagtgcagaggttggtgagtggatgacgtcagcagtgctggagggagtttctagcgtcatgttgcaggtgtctgttctcatgcagaaagcctgtgagtggttgaattggtttggaaggtgtgtgtatcaaatctagacaagggcctgtcagatacgtcaggtgctagaattcagatcccaacagatctcagcaccaaatcaaccacagaaagtttcattaatcagttttaatatatgagtgttttgaatcagtacagagtaagaatcacataggtggcaacagcatgtgtttaatgaagaaatgagcttacatgtgttatttggttgagtccacaatgctgtcatgcccccaaataactccttccactgtggtgaccaagggaggccgtcgtcttgctttctggctgctgtttggatcacgtgggtattgtgtacagttgtccagtccctatgtcgttttgttttgcttaatgaatatcacatcaatttaatgtgtccacactgggcaaaactgacttgaggagtgtgagagtaataaaaacaggatatattccagaatgatcatctggtaagaacatgccctggaagctatagttataatatcctcgaacagattacactggttatttatacactctttagacttcttagtgctcaacaattgatgaaataccatttctggggagtcatgcttatgtttaattttcagtaaggactggccacagttctatttatttctactaaaaacatctccttggcaaggaaaatgccctttccattttcctgcttgtgtgtgcgtgtgtctgtatgtacgtgcacatgcacgtgaggatgtgtttttcctgcttgtatatgtgtgtgcacacacatcagcatgtttttcctgcgtgtatatgcatgtgcatgcacatcagcatgtgtgcttttcctgcatgtgtgtacacaaacatgcatgtgaacctgtttttcctgtgtgtatatgtgtgtgtacgcacatgagcatgtttttcctgcatgtttatgtgtgtgtacgcacatgagcatgtgtttttcctctgtgtgtgtacgcacatgagcatgtgtgtttttcctgcatgtttgtgtgtgtacgcacgtgagcatgtgtttttcctgcgtgtttatgtgtgtgtacgcacgtgagcatgtttttcctgtatatgtgtatgcacatgagcatgtgtttttcctgcatgtttgtgtgtgtacgcacgtgagcatgtgtttttcctgtatgtgtgtacacacgtgagcatgtgtgtttttcctgtgtgtatatgtgtgcgcacgcacatgagcatgtttttcttgtgtgtttatttatgtgtacgcacgtgagcatgtgtttttcctgcatgtttgtgtgtatgcacatgagcatgtgtgtttttcctgtgtgtatatgtgtgtgcatgcacatgagcatgtttttcctgcgtgtttgtgggtgtgtatgcacgtgagcatgtgtgtttttcctgtgtgtatatgtgtgcacacacatgatcatgtgtgtttttcctgtgtgtttgtgtgtgcacacacgtgagcatgtgtttttcctgtgtgtatgtgtgtacgcacgtgagcatgtgtttttcctgtgtgtatatgtgtgtgcacgcacatgagcatgtgtttttcctgcatatgtgtgcacacatgtgagcatgtgtgtgttttaccctattattccatatctctttccttgctcttttttttaagtgttaaagacttttactttcagactattttagaggagtcatttcattaaaccttttggaatcccactgaagccgcagggcccaaggttaagctgtgctcttcccttaggaattgacagtcgtggcgactgctgtctttagtacattaccaggaagtttccaagtggcagttctacaagatgagcccttgaagaagccaatcctgttttctatcttttgctttcaacatacgaggtgaacttttacctttctccatttaatataaaccaaaatccgtcttttaaaaaaatgtttatttttaacttttattttagattcaggggtacatgtgcaggcttgttatatagataaactcatgtcacagggggttggtgtacagattatttcttcaccaaggtactaagcatagtacccaataggtattttttctgatccttttcctcctcccagcctccaccttcaagtaggtcctagtgtctgttgttcctctctttgtgtccatgtattcttactgtttagctcccacttgtaagtgagaacatgggtagttggttttctgttcatgcattagtttgctaaggataacggcctccagctctgtctatgttgttgcaaaggacacgatctttcttttttatgactgcatagtatactctgaaaggggagagtgttgggaggagagtgagcttgtgtcaaaggagctccaggtcatgctctgcccgcagagttcaagaaataaaatgtcaccctaaggaaaggcaggcaggctgtgagaacatgggcacgatctgcaggtatttgaagacttgccacggcaaagaggaattacactttggccaaccgcagtgagagactgtggctgctctccaaatgacctgagggtgggggagcagcatttcccaaacttgacacccctgggtaacaacttttgttgaagagagtgtcttaccttgcggggatgttgggcaatggaaagaaaataaaaaaaaccccaaagtcaaattcttcttttagacttgatactgtttggttagtttaagtccatggtgttccgtctgtgagctttggccccaggttagtcacgtccatcttctgtcctacttgggtgtcatcgccacatcccctgtgccttatctgtactcagtctcgcacctctgcagggcatctaccctctggtgctggagtgtccacgcactgtcccatcttaacgtgcatagctgccctgaatatgcccctgtgtttcttctgctttttcctcctttcttacatgtaatacatttgcatggataattacttcatgatgctaactttggtttgccctctgttcctccccacctccaccccatacatccttcataaattttctttgatcatattaaggcggcggtccccagggaccggttttgtggaagacgatttttccacagaccagcggtgttggtgggggcagggatggttttagggtgaaactgatctgcctcagattatcaggcgttagttagattctcatcccgtaaggagtgcacaacctggattcctcgcatgcacaattcacagtagggttcacagtcctgtgagaatctaatgccgctgctgatctgacaggaggctgaactcaggtgttaatgaccacttgcctgctgctcacctcccactgtgcagcccagctcctaacaagccacagatcagtactggtccgcagcccacacattggtgacccctgtattaagggatcttttactccacctacccaagaatgaaaaggtgcttcccggactctactctttcttatcagggcagcaggcatgtggacccacagtacagttcgtcatttcagacagaggaacatgctgcacgtggatgaggcagttctgtttttatccctggtttttatacctgaaactgtgtcacattttatgtgcatagtggttgtcctctgagattccacctgcaagttgccattgaaactcctacttctgcttctgacttgcagcagctctgggaagctgtggctttcatacttcccctgctggccctatggctcgcccattcccacaagtacccagatgattgtctttgtcaaaaacaagagtagggaaacagataccaatggcaacagcttctgttcaccaagtgcttatagaagttgaatacttcacacgtggattctcactccggcttcccagttagagaagatgcatgtagtaaaatgctttcattacatacaggagaaaactgaagatagagtgctccaagaatttcccaaggccacacataggataaggaccccaggagatgtgttgggcccctccttccataccccacctccagacggacaccgattttagcctgggttcaaactgcatcagcttgtaccccactggggagcacagagaggttgcagctggaacaattcccagcttagggccctgatcctactttcgacttaactggaggcttggtcctttccgagggtccaccaccccagccaggtcctctaggcatcctctgtggcggggtctccctttccaggtagtgaggaggggccttttcatctcaaaagctagcttttcaaggggatttcttccagcagagctgtggggcccatagaggcttgtgggaggcttcccacatcttaatcactcgggttttcaccacagaactccatgtcccttcctagtcatccttctgtgtggatcctggtccatgagccgggccctgtacacacctgcagcccacttgtgggctgagttcaggtcctcttccacccagccctctggcctgcagatcccctgggcacctctcagcactagagatggccagcaatagctctgatggcctccagggggcagccttgcctaaccctgtggctgccagacctgcttctgtttctcagtagaatccagactgctgtgaacttccataggacacaactctcttgctgctgggcaaagatttatctttttattataaatttgcagcatgcccagaagtacaatttttcctcttaggagtttatggtaagaattttataggcatcctagaggttttttctcgttgctttattcagggatattttaggcatcatgtacaccattttaaaaacttaaaaacagactttccttgagtgatgtttcattatgatgtgtgcccattcatccccagttgatattagaagtgacctttatctaagacttttttctccaaattgaatgagaatatttcctgtaggaccagacagaaaaattccgaaggggcaaatattttaaatggttaaaatgtagccttgctccttctgcctcatttagtttggtccttttttaatgtcatgatcccaggatcagttccttcacggtctcctcagtacccgcgctggtttcaccagccagcgggaggatgagcacatccagtgtgcggtaaaatatccaggatgttgcggggaatacgctagtttttgggtttttttttttttaactaccaggtggaagggaaaacgtttgacccctaaagattcatggcgcttcccctagaattgagaggaagtgatttctatagactctaacagactaattctagcacgttttcctcatactgtactatttttaggagtaaaaagatttaaatgtgggatgatgttaagtttactagaccaagtgacatattttgaacaattggtaggaacccgaatgtgttttgaaaaatatctagagaaggaagattttaaaactgtgatctttcttattattagaagagtttttcttagaacaaaaacagtaacagtggctagcatttacttatttcttcactctgcattgtcttctcattgaaacttctaagcaactttttttttttttttttttttgagactgagtcgcccaggctggagtgcagtggcatgatctcagttcactgcaccctctgcctcccaattcaagcgattctcctgcctcagcctcccaagtagctgggactacatgtgtgtgccaccacgcccagctatttttttgtatttttagtagagacagggtttcactatattggccaggctggtctcaaactcctgacctcaggtgatctgcccgcctcgacctctgagtgctgggaaatacaggcgtgaaccaccacacccagccccaagcaactttttgaggcaggcattattaccatgcccattttatagatgagaaaacagagctggatccaggtaacttgtcaaagttacaccctaggaagtgttaagtcagtgcttgaacgcaagcagtctggctttgcaacctacactcttagtcattattgtctattacctcctatgagaagtgtttgatttgaatgatcgtttatggaagaagcactaatagtaactcttaggctgttgcagtggagttgcatagaagcacagctatgtatcgtgcatccggccagttctgagtcatttttcatcttctcttcaccggagtgtaaaaatgagacttggtaaaatcgttttgtatcttaagtgttatttttggtagtatttgctggagaagaggaattttgcagaggtccccacccaaatggccagcctgccccccttcctgtaccacgagttgggtccttgagtgaggcctcacagtgagtcaggggacaggctgctgatctcccagttcagggcccagacatccccgagcttcggctggcagggcttcagggagagggcccagcggtgctgggggcctgacccctactgtctgagcagggctgggagggtggttgggacacctgtatttcagggccctgttacgaggtgtgtcctgtccagggtatgtggattctcttctgctgtcttgattaattttgttctgttttgctgattttgctgtttttctagtaggctttttttaaaaaagcgtttttgttttctcaacagatttaaaagaagagatattaatttctattagtggcataagaacctagctaaaggggagtgcagctacagccagaggcctccattggctcctgccagcaggggacctggtttctcagtgcccagaagggcagcttgtcactgagtgacccggacgccctcctgctgcgctgcaggttcaatatttgggtcagagttggctcctttacctttattttcagctacatttcttccaatttgattggagtgagagaagagcaatgggctgcaggattgtagagtgtcagctgttttctgaggacctttttcagatgtacatttgcttaaatcattcacttctgctccaagtttgaacataaagtgcagaggcagcaccgttggtagcgtcttggcagtgggacagagtaataagctaactatgcagagtcccctgttgattccttaagtgttctccattttttgtccattgattagtactatagttatcacaggcaggggacccgggaatactccatttcctaggtcccattggacagtgacaagggtgagggcagcttcagtgaagcaaatgtattcaggcagaagatacagttgagatttttgagagaaaggagtgaaataaatggtttattttctttgtgagcagaatcagtgcagttgcacagcaccgctttttcatcagcgtccaactgaggagaggaagttggaaggtgggaggctgcagtggctccgtgcgactcaaagggtttgctttgggagtgagtgggcaccctctgtgtgtggccagttgctcaccccaccccaccacctgcatgtggaaggcaggttaccatcttaagtagaaatgtccatggattggataatgtcatggatgtttttgattaaatattttgactctttcatgaaacattacagccttgttctggtaaatggttagttatagctcagcgcagccaagttggcacatacttggtttgttagagcaaatcttgcctgttcagttaatttaagtccatccttataaccagggtaataattttgtccagagcgttgctgttgacgtgaagccctctgctgtgtcctctttcatctgctcctcgtagtgacgcctttaggtggcattgatattcctaggatccctgttttagcaaactgagtctctgagaaatttaagtgatcttttaggtcacacagctaatgctttgtaaagcatttcctaaatccagatcgccttactctaaatcttataatactgttactactatgccatgtgacttggcaacttggaatgtttttcatgggaaatgttagtgcaaattggaagagtccttcatgctatgatctttcctatttataaatgcaactgccatgttcatgagaatttagaggaaaacaaaagaacaagaaagcatcttattgatgataaagcctttatagatggtgcagagcatcagttcagatttgatgaattggtgcgtggcattttcatgtggaattaaatactgatgccaactgtggctcagtattctttctgataccagcttttgggcatagtacttcatcacctggggcttctcttccttaatgtataaaatgaaaattttgaactagcttatctctaaaactccattgattaaaattcttgaactgtatgaaatttgataacttagacacaaaaaataggtagataatatgagaaaagttaacaaatgttttatttactttaatattttcagtaaaattaattcttaggaccctgggtaacaggattgaaaaataacttctttgccagcacttttcttattttaaaattggcctgctatattttaaatgtgtactgacctgcaaataacaataaaagtatattttatgtatgtaaatattgctcagtgaacaaattgtagtatggaattgatactaagattttctgtgttaaaaatggaagtcagtttccctatgcatatttcagagaaacaaagtcatctggtaatagtgtgtttttgaagatatgtttgacagcaaaagaacacttaaaagcttagcttggatttgccatcattagtaattagggaattggaaattgaaaccatagtgagatataccactcatttagaatggcttaagttaaaaagactgaccacatcagttattggtgaggaagtggaggaattgaaactctcatacgctgctggtgggaaggtaaaaatgatacaccactttggaaaagcttggcagtttcttaagttaagcatacacctgccatatgatccagccattctacacctaggtatttatctaaaaggaaggaaatcataagttcatacagaggttgtgcccaaatgtttacagcagctttatttgtagtggctccaaactggaaataaccgagatgcccaccagcagatgaagggatcaattgtggtttcacacatgcagggactgctattcgacagtggaaaggaacgaacccttgatacacacagtagtatggataaatctcagggtaattatgctgaatgaaagaagctggacagaaaaaaaaagagtacatactgtcccattccagttctagaaattattttagaaaatgcaaggtaatctccagtggctgagagcaggtgagtgccagggagggagcatgacagagggcatcagccagctttgaggtgagggagaggctcacggtgaagtgggtatagacaaatgtcagaactcacattggacactttacatttgtgcagcttatagtatgtcagttagtcctcagtaaagccgttttgtaaaaagcttggcttggaaacagaagaccacatgcacacacagtttctttctgcaagtgcagttttgacttatgagtcttgaggcagcaggcgttgcacagggtatcaagcgggaggtcccgacttgccccatctcaccagctgagccggctgtccccactagacatacagaagatgcgtgagctgactcttagtccctgaggaggctgaaagcattttctctacatacaagccaccagggcccatttaatgtaattaattgtctttttcagttccgtgaatagtaccccagagatctgcaggagttaatggactttcaggaagtaggctctgctccctggctcccacctggcccaaagtcattcttgccactctcattccagggtgtctttactcatctaggtctccagcagcctgttttatggtggtggcagtggaggtgtctgcatcttttcagcatgcacactctttccgttgaaggcccgaactgttggcagcctgattgtggggcctgggctcgtgccgtcacctccctagctccacaccctggtccctggccaggctcggtggtgaattcctctcatcacattgtgcacttccttctgtgtgcttccgggggaaatcggtggtttaataatgaaaaattgaaatacaagtgtccacctgctaagtaagagcccgagacatatcagcagatgtttctgcgaactgagggtcttttcttatttccactgcagtctggattgagcctcgggagaatgggaaagagcagcttcccttccctttcctttttctcttttgtgacagtgctgcccgccgttcgcctgtttattttcctccctgcggcggtggcatgctgcttttgttgtgcatgtgttccgctggcagtgggactggatgcccctccctcccgtccttccttccttccctccgggagtggtctgtcaccagtcccctcccagggcaagtcacacaccgtctccactggggccccttggacaccgggcggcccacctggtggtgcagccaggccggccggcctcacccccctctccccttccccagctgtggacgtggctggaggagctgcagaaggagctgctggacgacgtgtatgccgagtcggtggaggccgtgcaggacctcatcaagcgctttggccagcagcagcagaccaccctgcaggtgactgtcaacgtgatcaaggaaggggaggacctcatccagcagctcaggtgggcctcacccctctcctggtccgaacagattctgaaaccctgcctgtgactccccttccccttttactcttgtgagtggtcagctctgcttctctgtccagctgagtgcagagctagtagtgtctgtgaaggcaaaggagagagaaacggctctcttctctcttttcctttcccctcccttctctccctccttacagttttaacttcataatagttttcattataacatcgactaataaaccacataatttaattttaatattttctcttaacatccaactagtaattattgacacttctttataaaccagattaatgtgagcttccaaggattgcgccctcaggctgatctagagcacagcagtattcacctcccaacgtccagattcagtcaggcctgcatggggcggacacccacccccaagtgctcttcaaagcaggatatggaggcagagccaggattggttttgtttcctctggaagcaaattttttttattgggtcagggggaccatttaaccccctactgtatcactcaggaaaatttatcaaatcgttgactgataactttacgtgacgttcactttgctgagagaggcaggcagcagttacttaataaaggcttaattgattgcattaaaggttaacctctcgtgtccaatatgactctgtcatttatactaaccaggtatcatccattttttacttaagaagaaaagtggctaaaaatacaactctaaagtaattttctataattattagccttcttaccaagtgatttcagaaaatgccagagaaattcttcaatgtatcctcagattcagcaggattgccccgaggaggaagcctaatattgttttgcaggagagcagcccgttccattttctgagacaagcagtgcagcttcctgccagctttcttcccctgaagatttgcgtggccggatctggtatctaacaatgtgtgactttctcatccaattcctgttcctctgtgtgctctcgcagggactctgccatctccagtaacaagaccccccacaacagctccatcaaccacattgagacggtgctgcagcagctggacgaggcgcagtcgcagatggaggagctcttccaggagcgcaagatcaagctggagctcttcctgcagctgcgcatcttcgagagggacgccatcgacgtgagtgtcccgcggctggcgcctgcctgcctgtgggagcccttggcttcctccacagcaccggcgccctcttgtctctgccctgctgaggtcctgtgtcctcacccacaccccaaccctctgcaccaggagggggtgtgggagggagagagggtccctggaggctggaattggatcatccctgggaggctggggtatgctcagccctggaccctaatgttggaaactatagagcaggcagctcgcgtggcaggagcagagcacagcaagcgctgagcggaacagaaggaagccagcacagctttctctcggccttggggtgttaaaacctcgattgggttgcacacagcactcccttgtcctcagcttaggcacaggcatcagcttcaggcagcaagtcttcctctcttcctccctgtcgtcttctcatccttcccactctcctcctgtcctcaccctccccttttctctctctctccaccttctctctctcctaccttttctcttccttgcttcctccctttctctttccatctttctctctcttgcccttctctcttctagagtgggaataatcctgacttgtggtcgtagcattttaggtaacaaaaaacacaatttccccccacaaagaggtgttcttagattatccatgattcttacctaaacgtggacttttgcatcttatatgtgaacaggagaaagaatttacaggtgtcttttatctttcttcaacaaaaagagagtggttctgggttctgtgcttaggaggagctctcttttttgataccatgcgagcagaagtcagtccaatcacatgagcacgaatttacctgggaacgtgacgtaaggagcctaagctcccctcagtggtgagcctgctctcctggagtctagccgcttcttacagctggtggctgtgacagcccgaaggcctcctccacatacctctgggctgccctgtgggtcctctgtgatggacacctgtagagcacaccctctcaatatttatttcttgtctctggtttagaattcatcagcagtccttggcactcaggctggggatggcagggctgtgcgtagcctgccctcagtcacctcggtacaggagggaccttctgcccatagtgggccgtgtggcttcccctgggcctgtctataggcctgccctggggagtggttttggtttgtggtgcaagggccagaccagccctgcgcaggactctcctggatgcctttgcttggccacttgtctaagtctccggcactgttttcgttaacaacagaccttcttggctctgctcattctcatcattagtgaataacaagaaaggagtcaaaccctaaacatgtggcatggtgaaacctgttcagatgctctcaaagtcttgacatttagatccacatggagccatgtggagaagaggcacctgcacgccgacctctgccccgtgagggcctgccatgtcctccccaaggtagcagcacagaataaacgggaggccagccacgcctactttcctctctgacttcaaaggactcgcttttgtaaaacttagctgcatattgaatattttcaactagaaaacacaaaccaaccagaagcattagttgcagtttttcttccaggacattttgatacttgaaaaaaaaaatcgattcgtttatcttaatactataaagagaaaaaaatttttaatatttaaaaaattgtatttatcgtaagtatatgaaagtacttccgctttcattgaaccagattaggaaacaaaaacatacatttttcccccaacaaagccacgaaattacaagtgccctagttagagccagtgtgccacagcctgggggagctcatcctgagcagaggaagctgtacctgcagcccagtctcaggccagcttcagatatggttcagaagctgttagaagatcacagcctgagaacctctgttctctttaatcctgaaaaatgaaaatctgagcagttcaggctttggccaggtttcctctgttatccaggaagatgccacatctgacggcccataggagtatggagttatgtcgatggtagaattgatctgttacccggttaatttattttaagtccctcatatctcttgtgtttcaattggagtagcgtctccatctcagatgtggatggaggtccagtgtggacagtcctcctgtggagaaggtgcataggatccacggaaaatgtcactccactgaagtgggtggtgtcgtcatctctcgcaagaagcttttcctgctttttagattttataatctttttaaagtttattatggccagacgtggtggctcacgcctataatcctagcactttgggaggccaaggtgggcagatcacctgaggtcaggagttcgagaccagcctggtcaacatggtgaaaccccatctctactaaaaatacaaaaattaggcgtggtggcgtgcacctgtactcccagctacttgggagactgagacaggagaattgcttgaaccccagaggcagaggttgccatgaggggagattgcaccattgcactccagcctgggtgacaagagtggaactccatctctgaatgaatgaatgtcttcaaagctataccgaagcacagaggacagtacagtggaactaccgtgtgcctgtcccacagattcagcatgattttgccagactggttaagcttctttggttatggctgtgctatagtattttagagaaaatcattgccagtttattctttcactcctaatggtttttctaaaagatgaggccattttcttacatcccctcaatcaactaaacatctccccaatttgacagtcatttcttattgtcatcgactcccagcgtgttcggattgatgtgggtgcctcaattaggaggcatgtgaggttggctcttgtgtttaatggtcagtttcttaatctagaattgtctctcctttgtcctcctcctcttcttttcatgccatcatttgctgaaataactagattggttgtcaaaggaaccagatcccacattcagtgtttgttcacttgtattattttagattgtgtaacttttagtttccctggcgtttcctctaaacttagaagttagatgcaaagacctgattctggttctgtttttgtgcacgagtctttgcgaggtggtgcatcgtagttccccatgcgaaggctgggcctgtctaatcccacttccctcgggaccctgaggccggttcaggcaccattatgctgagccttctgtggttaagtcccctcagcctttttctcacgacagtttactatgcgctgatgatcattgcttatgagaatgtgaaaacaattttcaattttattattctttctgcatttaatagctagattcatctataaagaggaattcttcattatgaaatgttcttttatcttttaattaagcaccaatatttaggataatgattggttttctatctactttttttttttttttttgagacagggtctcactcttgcccatgctggagtgtaatggtgccatctcagcttactgcaacctctgcctcccaggttcaagcgatcctcctacctcagcctcccaagtagctgggactacaggcacatgccaccacgcccagctaatttttgtattttttggtagagatggggttttgccatgttgaccaagctgttcttgaactcctgacctcaagtgatccgcccaccttggcctcccaaagtgctgggattataggcgtgagccaccacccccagccgatttactgtctacttctagtggagaccaaatactttttcttttctttctttttgacttttagcttctcttactatttttgaacaccattaggaatattactggatttttgtatatacggtatattttacacagttttggtaatttttctctttggatacacaaagagaaaaattatttatcttctctttcggtatctgtggccattgggaaccccttcatctggcttctgtgtccatttatttatttatgtttaatttgtttaaacagctttattgaggtgtgatttgtataccaccaaactcatgcatcttaagtgtttgacgtctctgtcctttggcagagagacatctcttccttccttacttggtacagagtgagaggtggctgcatgtatattttttttgtcttgatcttaaataccttctttcagattatctcagacctcgagtcttggaatgatgagctttctcagcaaatgaatgacttcgacacagaagatctcacgattgcagagcagcgcctccagcaccatgcagacaaagccttgaccatgaacaacttgacttttgacgtcatccaccaagggcaagatcttctgcagtatgtcaatgaggtccaggcctctggtaagagggctcactccatctgtgtccgttgtgatttcttcatgtcgtcatggcaattcggcttatttcagtgggatgactgcaaattttgttagttcctatgataaaggtattatagatacctgttctttaaaagaacgtttgcatttttatgtaatacagtcacatttaacatggttagagtactcacccatgatattctcacatactattttaagtatcatgaactttaattctacacaatgatatgttgtatctctgtaaatgaactataaatcccaggaaaacattttcacattctttatttttttagtttatgttttaccagcagatgtcactataggttcagaaatgtattagaaacttagcaacaacctgcatactgcattattcattttacacaaattaaatgcttaccaaagaggaaactgcaagtaatgaggataacaacaaaaaaaaccctgaaattcgctcatttgtaaagaatgccacactttcctagttatcagtgtgggagtagaaatggatgggatgtggatgtggattgattgcctatacatcctttgacacactttgccctccttgaacttgcccttcagcataatggcttggcccccagctgggcagatcattcacaaaagcagattttgtgccatccaccctttgagaacagaaggttgaagtgctagctgaattctagggtctccctttaatgtccacaggtgtggagctgctgtgtgatagagatgtagacatggcaactcgggtccaggacctgctggagtttcttcatgaaaaacagcaggaattggatttagccgcagagcagcatcggaaacacctggagcagtgcgtgcagctgcgccacctgcaggcagaagtgaaacaggtgagcaaacgactggatgcttggggaggctgcgctacagatgcttgatacctcatcgacttcccggaaattctgacctgtagcattgggaaggattgtgcctgctcagaacacagctttcctgatatgtaagataatgcgcacatacacacacccccgccccccgattacagccatccctaatgtgtgaaaagggagccagtggccaggacagctggctggctgttcacccagcacaggcagcacttgaaggtaacagcccttggcttctttcagtattgatagtctgtctcttgcttgaaaccctgagcatattgcttcttatatgactttttctgcccagtactgttaggatctggattgtttctcagactccagatgcctggggcatttcttttgttatcaggatactgtaataccacatcctgatggcatgacaaagtgaaaatgggacatggggaagggattgcttttggctcagtgccagtgggattctgtgcatggatatgacattttattaactggcttgatggagggagagaaaagcttatggtgccctgaaagatgcagagaaagcaaacagaaagtaagtttggttggaggggacttaagatgcctctggaccatgagcaggaggtggtgcagaagtaggtggcactcacatcagaacaggtagactcttcagtcagaactgttgaaaagagcacctttcagtctcccacatgccatctgcagtgtgggtatttttacatataaataagtgttgtgacctgctaacaaagccctccttcttgccaaaacacaaaacagtttatttaagaaataacggaataaataaatgtatcccttaggattcacctttgcctaaaacagagactaaaaaatagtggctttgaaaaggtgttttccgcatgtgacaagtcagaatgtagaagaagattgctggtctgcatttagtggtcccatgatacattaggctgagatcttggtgatggctggcctttcccttctggttgccaagtggctgttgtagctccagccatcacctccatatcccaaattatcaggaaggggaacgcataatgagaaagaggcagcccctctatcagaaaagaaatattttcacaaacttccccagagactcctgctttgctttcattggctagacttgtacattactgtagccaagctgtaataggagctgagaagtggttttattgtttaagccctcttccaaagttggggttttacttagaaaaccccagacacagagtggttttattgtttaagccctctctcaaagttggggttttacttagttggagtttttctaagtaaagccccaactttgggagagggcttagacaataaaagtacttctgtgctaagtaaacgagagggcaataggtattatataggttacttgaggtcactgccacaccttactatccagaagacctcccacaatctgtggtttccactgttagaatttacttcctctgagtgtgtgtgcagttgagaagctcatggtttgaacctgatcattgtagcacaatgttattcataccttggttattatgccattcaacactgcagttaagttggaaaaagagttcgtgaaataaattagttcccccttttcaagcatttgccaatttttcagtcctaaaaatgctggaaaggaatgaaaaatatttttcttgattatcagggaattcctggtgtcagtaggttttctaaaatatggcccataatctgttttgacttgtggactaattatcaacaatccactggaccctccaccttttcatttcccatttgctactaaaaataacagaactaattaaaaagatgcagcacttgcagtcaggtaccatggaagaacatcaggctgttgcctggattttaggatgatgaaggcatcagtgcctcgtacctgccaggagcaactggactatcttgcacgcttgtatctcacccctggtggtccacaggattctctgggaagtccactgcttggagttatcctgtgtaatgtttcaggtgctgggttggatccgcaacggagagtccatgttaaatgccggacttatcacagccagctcgttacaagaggcagagcagctccagcgagagcacgagcagttccagcatgccattgaggtaagggcgctgggcctgcctgtgtgttggctctttcattcctcaggacaaacatcctgaatcccccaacatggcactgaccatgggaaccacatggggctggcttggtaaagacgactcagaggacccaaattggcaacgcttctaagtctgcagctgattacaggaaagggaaacagtgtggtgccacggtgaggtgaggatctgcatcccagccaggcagcctcactgcaaggatcccaaaggtctcggaggccagggggttcctgttgttctcctgttgtaggagccctggcaagatgcactttctctcatctggaatggctcagaaccgaggagcccacgttgcagtctcagctgaggttttctaatcttgctggtctcttaagcacatttctgctatgttaccaacctcaaccaagcagagagctcagcaagaccaggtgtatatcatgaattcactatcagtcagtaaacgatgccgacagcaaaactcctcagattcctgcttaaaagcagccttgttcaccttgacaagggtcactgccatgccagaactgtcgcaaaatgactcaggccaattccaggcctgatccaattaactgtcagcatgtggactaattatttttattttttggtatgggtagggcacatgggtcatggttctgattggtagtggtgaggtaatgtcaaaggaaaaagaacatttgattacagaaatgttatctcctgctctgctcacatacatgttgtcagctagagaagaaagctacagaagttgccactaatttattccctggattaatttattgtcaactgtttggtgccattggacatgcattaacacctcttcctgaggtgcaaactctgggcatctgtatactgtgccaagggatttctagtaattaaattgcaggtaataaatcactgtgtctgggtaaaggattagaatatattgtatatagtgttttatgggatcatttgtacttcttcaggcgaaatgagaggttttgctattgtttaaaaaaaatctgtccttagagacctgtgctctccctgaccacaccctcccttggctctacggcctcactggagagaagcttacctctcagcccatcctggctcttctagtgaagacagctgagcaaaatcctactgcatttgccatgccatttgcatagatttatcagatggcatggacctccagagaacacagttgtttcattcttagctttttgatttttctttcctttttaaaatcaatagttcttgaaaacttttcactggagtccagagtttaagttgcaagtgaaaataaaaagcattcactctggccaccttttctctgcttgttcatttgcttccagcagctattatgagaaggatcaacaggaataataaacttggaacatttcaaccacttctttggctgttaagggtctttcctgctatttctcagactaagaaccctacaaccgagacccattctgggaggtcctgatcaatttcatccttcattagctaatttaaacatagatctagttgtttctcggcataaaaccttttttgctaaactgtctgctgtgcttttagaagcatcctagtgagtattaactgaaggtatttccacaaaatcatgaagaacagagtaactgtagccatcctggttcctttctagtcagtggggacactgacaaataagccttcccttttgttctctgtctctagaaaacacatcagagcgcgctgcaggtgcagcagaaggcagaagccatgctacaggccaaccactacgacatggacatgatccgggactgcgccgagaaggtggcgtctcactggcaacagctcatgctcaagatggaagatcgcctcaagctcgtcaacgcctctgtcgctttctacaaaacctcagagcaggtcaggggagaggttcccttccttgaactccactgatactttattttgagcttaatttattggacagctcaatcattgttaacatgttcatcgttattgaaacaatcagttgccagtcaagcagggaaaaggcattctggagttaaaattattcctgtgtaccttagatgtcaaaggtaataagctagaaagtagctgagaagacacctctcttcttgtcatttaaacataggacctgaagcacattagagagagacaggatatttgctttggttttgttctcgctctgaaaagtctgcctgcttttgaccctgtagttgttctccagccaggtggagcccatggctccttcttatggtcttgatcctcctgacagcatcttcatccccagagcccgactgaaagggctttccagggataccagtcggcagtggcagatgccaagtctgagcctcaaacttttcctgctcacaggtctgcagcgtcctcgagagcctggaacaggagtacaagagagaagaagactggtgtggcggggcggataagctgggcccaaactctgagacggaccacgtgacgcccatgatcagcaagcacctggagcagaaggaggcattcctgaaggtaggggcagcgctgcgggacagtgcacccatcagaggcttcctgcctgccaggtgcgcgtggcacagtcatcgcttcccaagggagcctgccccacacctcttgcctgctgtggaatgtaacggggcagtgtcgcatcagtgagaagtcagctgaagaaagaaaaccttaaaatccttttcatgtgcgattgccttgtctttctagttttcacagggaaatagctaaaaatctgtatgagtaaggattggttggaagtcacaataccaggtgatgctggagacagagtgattgagtgattgattaatttggtgaaaaacaatacctatagcttaaaataatcttcctttggagactcagcctcctcattcccttcatagggaatgaagattgcatctcagaagaggtgtaagcacggcatggagtagacacagtgcgagcgccacacggcttgtggtggcagttgctgatacctactcaggaaatgcttccgacaagagaaatgtgtcacatgcagaccaggctgggagttttctctctgagaagctttaatgaggaatttttcaagactgctttttcttttctttctttctttctttctttttttttttttaattcagcgaaggggtctcactctgtcacccaggctggagtgcagtagtgcagtcacaactctctgaagacttgaacttcctgggcttaagcggtcctcccgcttcagcctctctagtagctgggactacagtgctctgtcatatttttataaatgtcacatttagtcatacatagtcacagacgtgctttggaacagttaaatttttcaaagtagttgaaacatttagcaacatttggtgctgaatgttctgtgttgcattcttgggcccttacagaatttctgaggctctgcttgttatcaccacccagacccattaaaagtaggggtggtggtcacttttcctccttaccttctcattgcttcagcgttctcacctctctgaccactttcctgttacacttaacactttctgtgtttttttctgaagtccgtcatctgacagagttattgtttagtctgggaggataaattgtaactctttggaaattatatctggtaacttactttgtgctcccaccacagtgattttctttttaagcaagctcccggggtgaaaaaaccatcacagtttccacggtcattagttataactacgtcaacagctttttaaagcccctgcccccaacatgtccctactgcttaagtttaccaaatgctgaccgctgttaggatttcgaggtggaatcattagaattttcccctttgtccaggatctgtttagtatgaaagaaaaatgaatgccacttagttcatataattaagatagctatttaggtaaaattacaaaacaaaaatacaggcggtcctcaagttacgatggtttgacttgtgatttttggacttgttggtgtcagtgcgctgtgcattgagtagaacctgtacatcaaatgctatacaaccattgattttcactttcagtgcagcattcaatgaattacatgggattataaaataggttttgttttagatgattttgcccaactgcaggccagggtaactgtaggcttaaattgagcacttttaaggtaactaggctaagttaaactgtgatgttgagtagattaggtgcaataaactcatttttgacttacgatttttttgacttacaatgggtttatcaggataagtcaaggagcatctgtaatcacaagcctttttggatccctttgttcaactagaattttgtggtgtttgtgtataggatatttaagtacctttttattatgggaatttgaagatatgtacaaaaggagagagaatggattctcctcctattttactccttacccaacttttctgattatcaatgtatgggcatatatctaccttcagtggattatttaaaattctagatatatcattttatttgtgaatttaaacattaaattctccctttcagaaatacaaataaaataccattatcatatctttaaaattatagtaattctttaatattatctgaaatccagcattgttaaaatttttttgattgttctgtaaatgttttttttttttttttgagacagggtcttgccttgtcaaccaagctggagtgcactggtgtgatcatagttcactgcagctttagactcctgggcttaagtgatcatcccacctccgcccccctaggagctaggactacaggcacttgccaccacacctggctaatttttgtatttttttgtagtaatggagtctccttatgttgcccagcctggtctcaaactcctgggctcaagtgatcctcccaccttggcctcccaaaatattgggattacaggtgtgagcctccacacctggcctataaatgtctttttatacatggttttaattaaaattcaaacagggtccacatattgatttggttgggtatgtcttttgaatcacttttaatctaaacaatactccctcctttcattactatttattaattgaagaaatacgttcctcggattgaggcatttcccccattccagattggtaattacatcctgtggggtcatttagcaccatccacaatttgtagatttttgttaggttgtgagccttgatcagagctggtttgaaaggcggagggggggcgatggtgggggaagaaagagaggcgggggtgtgagagagagagagagagagagagtgcaggcgagcttggaaaaccttgccagtggtgcttgtacttcctatgggattactcaggagacacataatgtctagttctctcttttgtctctgtgattggtaagaagattgatcagtggttcaagtacggtcagtgcagttcatccctctgtacttcccatcagcctttcagctaatggtgttagtacccagtggtaataactgttttttaggaattgcaaaatggtaatactctaattctatcatttcctttggcctcgattagctagaattattccctctcagctatttggttattctaaagtagagtttgtccagaaaaggcagagtaaatgcttgcttgatcctttttatttgccattttcaggataatgaattgttgctatagcaacttctacatatgacttttttttagtatcatcatggatttaaatatatttggtgtgtttcaaagcagtcactgtcatttatcttttaacacgcagctcatcctatccataggagccctttcaaggcaggttgcttagctgtccttagccatcaccctcgtagtcttcagcgtcttccttgttgtttggtttgacagcgtattagtccattctcatgcgctgtgaagaaatacctgagaatgggtaatttataaaagaaagaggtttagttgactcacagttccataggacaggggaggcctcagaaaacttacagtcactgcagaaggggaagcaaacacgtccttcttcacatggcgcgggaagtagaagaatgagagaagtacagggtgaggcagggaaaagcccctcacaaaaccatcacatcttgtgagagctcagttgctgcacgagaacagcatgggggaccacccccatgattcagtcacctcccacgaggtttctaccgctgacatgtggagattacaattcggattacaattcaagatgacatttgggtgggaacacagagccaggccatatcagacaactcgaaatttcacacgaatcagtagagactcatgatgtgtttttctcttaattgaaaaaaaggtagcctcgctccatctactgaaaaagtctggaaacagtgaccaaccccaaagccctgaccatcccgaatgactagactgtgggctctaaataccatttaacactagaaggagatagagctccttgaagaaaagattaattccagacccaagacaggaaatgcacaagatgtttccaattcacatataattaaagggttttttccttaccttctttgattttatatttgtattcttttatctaaaacccttattttaaaatatgtgaatgaaactggtttggtttatcctgctgcataaacataaacacatattgtcagttaccataataacatcacataacaaagtttcaaccagggttggcaagttctgaactgagggctaagttgggccacattgatacagtttacctgtcacctgtggctgctttcatctgttgtttgtttgagtagttgtgacggagaaacagactgtatgaccccccaaaactgaaagtgtttactgtctaccctacgtagaaatccaggcacagcccagctgagttctgcagctcaaggtcactccttaggctgtgatccagggtcaggccaggtgtgcaaacctctctagactggacggagacagggcttcccttcctccgtgaccgtaagccaggggctgccctctgtttcctgccccatgggcctctctatagggcagaatgtagcagcaggtgtcatcagagcgagggcttcaggagagagagatttttttttaattgaattagattttatcctatgcattttctaaaccagcaggtggccagataaatattttaggtaaagacatacgttagagtgcagtgatgtgtactccaaatacacgtttgtagaagtcaaattagcaacacattgctctccattgttttttaggcttgcacccttgctcggaggaatgcagacgtcttcctgaaatacctgcacaggaacagcgtgaacatgccaggaatggtgacgcacatcaaagctcctgaacagcaagtgaaaagtgagtagagctgggagtctccaggggtggcccagtgcatgcctggcaagagacaaaaggagcctgcacgttgtgttctgaactctcaacttcagtttcattttaaatgtccgtttcatgttaatgaagtccttactaatgatcttagtttaataataaaaagattaaacaaatttataggttgatattatattgaataggttgataatttattgaataagttgaagaatataaacagggagaaaatgcaaattcaggatgatatttactgacattggctattttgttaaagtaagtaaaaaataaatagggggaaagggaaaaccagagttatctataggcaaaggatttttaaaagctcaaatagagaaaatacatcccaattttatcactataaagtattattaattttgtatacctaaggcatagttaataaaaacaaattgaaaaataataatatataggttatatcatttgagtgtaaaaacctgtaaaaccgtgtttgtgtgtgtgtgtgtaagtgtttagaaaaaggtctgggaaaacgtatactaaattgtaataggattgatgtggaaggaaaatggataaagaaactaaggcacaaagcaagtaactttgaccagggatacacagcctaagtttagttttataggaaaaaaaattgtgataatcagttagcaaatgattcatctcacacttttcaaaacaatatgattggcaaaaactttgtacattacattctactgtctgctcatctgattcatctgttagttgtcacaaaataattttgttacaccactataattctctaagttctttcagtaaaacatatttattgatgggctttttcttctggaaaaatgtgcaactcacaaaagcaaccgtttttctgcatgaataagtcttctgggccagcaagttatttgcattgataattggtttatttggctcatttcctgtagaaataagttcacccatctctcaatattgctttcatttgttggttgtgtcctgtcttttctgattgaagatattgtggtcctttttaggttgcgctagtttgacacacgtttttgtgtgagagggagactgtgtttcgtttattccctcgttagatcttcattatgcctttgctgttgtatatcctaatgttggatgctgtgaagaattaaaatagaagtgttctgtttccctcagagcctacttgggggtgaaaggtttatttatgctcgagtcagtgcactaagttcctgtaagagtaatggtggcagaaaagacagtctaaccccaaggcacaggcaaggaggagtctcagaccacgtggtcagaggacccccaggagcttgaggaagccccgtatccaagagggcgcttagcactgtttgctgctcacttgcccgaaattagtactggctcaggcagagactgtggaaataggagactagaaaaaatgcgttatctcatattcattttcatgtgcaatattttcatgtaagtgatagcttaattttttagcagacttcagatttcaaagttttaatttatctcactgtgctagtttacctcttcagtggagtaaaaataacagcatgaccactggtccctgggggatagttggcagtgtctaaaggcattttttattgtcatcaaaaatgatgacaccatattgtcaccataagaatatggtggtatttagggtgataatggtagagatggagaaaagtcaataaatttggggttcattttggaggtagtattgagagagtctgttgttaggctggatgtaaatgctgctcttctgttcttacttatcacaaagtacagactgctaggaactcagtaagtatttgtggaaaacttcctatattaatggttttccagtgtaataaagttaccgggaaccctttatttgatttgcagtttcagtcttgggaatttttttcttaagttttttgtttgtttcataaacttctagagcaaaacagacttagtgtcaaaaactcaaaaagtgtacaaatacatatgttagctaattccttagctactggtaaccactgtcaaggcttttgtgcaacctgtctgtgcatgtaaatgtaaatatgtagagaaatacaaacatatatttcactcacccatcccactttttaatttgttacaaaaatgggactatattaccttgcaacttgcatctttcacttaataatatatcttagtcatctttctgtgtcagaatttaaagatctgctgttctttttaatacccagtatagcatttttgaagttaatttgacctgtctctcaattgatgggtcatacattgctgcctattttccactgttctaaccagcgcttcagtgttccaacatctttgtacaaacagttttgaatagttgtgtaagcactgttcatctgaaagttaaattcccagttcaaaggaatgcatgcaccttttcagtgtcattccctggggtcatcatactcagtttttctccctccataatagaggatcatgattacctgttcccttactctttccaacactggatcttacccgtctagcaggaaagcagtgaaagatggtctcattgtttgaggttaaatgtgttcctgtatatttagtgactgtattttttaaattgtgaacttcgtatttataggctttactcattcttctaaagaattgttcatcgtttttctgttgactattctatgtcatatgttcccaatgcttaaaaattttttgtctgtgcaccagtttttggtggttcttgtttggttatgacattttaaatgtttgtgtcatgaggtttgtttttttttttcttgcctttatagcttcatgcttctctgcttccccacttcatgtcctttcctctcctaaggggttatggttttgtatttttttttgtttttttttttagacggagtcttgccctgtcgcctaggctggagtgcaatgacatgatcttggctcactgcagcctctgcctcccaggttcaaggaagtctcctgcctcagcctcccaagtagctgggactacaggcacctgccaccatgccctgctaatttttgtatttttagtagagacagagtttcgctatgttggccaggctggtctcagactcctgacctcaggtgatccacccatccgcctcagcctcccaaagtactgggattacaggcgtgagccaccgcgcccagcttggtttttctttttttttaatccacccttgttgattattactccactattttgacacaacctttaatctgtataaaagtccatctacacaaggttttaatagtcttgaaaaaaatgctgattttttttcagccattgtcgaattgcatattataaaattgtgcattatgtcgaattcatattacaaaatacacatatcccacgaatccatccagccggaggtattacagactgacgttaaatttccagtggtgtctttatcgtaagatggtcaaatggaggtgagagtgagaagaggtctggtagacatgctcactgagacaggaaagcagtgtgattctttatttatcgtgctgtcttgcaatggcatttgcataaaagtctaaataaaaatgaatggaatttcgcggttgttttaattgattgcaagcaccaacatacatcattttcttttttctctcagatatcttgaatgaactcttccaacgggagaacagggtattgcattactggaccatgaggaagagacggctggaccagtgtcagcagtacgtggtctttgagaggagtgccaagcaggtcagtgcacacctggtgcccagcctccccctaaactcccgtgctcacacctgtctccacagagaggctgagcttgacatttccgccatcttgaaaaccactttctaatgacaaacagtatagccttctagttaagtttgttataaaaagaaaaccccacagcctggtaaaagcatgtcactcagtgattttgaccctcagcaagtgtgccttcccctactgtctttacctcatctctaagacagcaaagtacaagtaataatgacaaggattatttaaaaattattggggaatcttggttctgtacttaggtaaatatgatggatttttttttatattgatgtatttatattttcaagacaaagtttttatttttccgattaatcaagttaaaattaagtaggaaatgtgacagaatatctttctttttctgtttcttttttttttttgagacagagttttgctcttgttgtccaggctggagtgcaatggcacggtctcagcttactgcaacctctgtctcccaggttcaagtgattctcctgcctcagcctcccaagtagctgtgattacaggcgtccaccaccacgcctgggtaatttttatattttcagtggagatgaggtttcaccatgttggccagcctggtctcgaactcctgacctcaggtgatctgcctaccttgacctcccaaagtgctgggattacaggcatgagccaccgcacctggcccagaatttctaataatttagtatagtcaaaaagtgttgatgtatcaagggggtacatttggagtatccccttcttaagtcattttgggatgaagtgcttctgcctgtatcatcagtcatggacgaagatcattttattgtaaaaatctgaccccgtcttaaatattaagattcctgtcacttctgttttgccttaatggttgcttaagaatccgtaaactttcatccagaatttggggggtctggagggaagcacaggggagaaggtgattcccccagcgtctgtgtgtggcccagccctggtctgggtgccttaaagtcccccagggcaattctgtgatgacagttggtgttgacccacattctgaccacgacacggacccattttctgaatccagcttgcaacctcatatgcagctgatccagagcaggcattggatacatgctttttagctgaagaaaaattaactttcttagcagaggtttcccacttaaggaacagctcttgttccaatctgaaaaatgtaagtctagaaggacgcagcccatgctcagaactgctcagttcccagagttagatgaactgggttcctaggccagggatctggcgccccaccttggtccttctctcctcctggtgacgttccaggtgtagccagcatgttcccaacagccaggtggcatgcagtcacgtttagtaaattatactctcttaacatttattagacagtttaaccatattcaagatcatcggaggcctggttagatttctaattagagatggtttcaggttcttttctcacataactttattatctctcttgaaagacaatccctcagctatagaaaagcaaaattgtacataattttgttggcagagaaagataatggaatgtattgttgcattttcctaaagtccgcttattcaccgaaaataaaatcctgaagtgcgtgctgttgcaggtggtgccccatctgccttccagccgttctgcttctgttcactgtcacaatatgcagcacatacccagtgctttcgcagaccggcctccagggctcttgctgatcttgccttggcgcaggcccctcccgcctgctggccacccaccccaggcctcactgctctccttcctatctcccactctagtcattgcctttcttggcgctcatttttggcttgttcttatctctctttcctcttctgtcttttctgtgcgctgtctcccagcccaggcctccatttctggtctccggattcacaaatcccagttacatccttgacatcactccacagtgactttatgagaagcagaactgcactctcggttccctgtctccgtgtccctcttgtcttacgtgttgttagaaacaactaggtgtggtgttctcagttccctcttcccggcgccccgcctcctccttcgcgccccgcctcctccttcgcgccccgcctcctccttcgcgccccgcctcctccttcgctcctcgctcctcgctcctccctcgctcctgcaccaggtccaggaggcgcagacctctgggtttctcagccccatcctgtcgtatcccatcccgcttcccactgctgccctggccatgtccccttgcccctctgctccagggcgctccccagggcggctgactcccctctctctgcactctagtcccttcctgaaaaggctcatagtagtggtttctttcattgtacttttattatgcctttaggttcatggttacaagaaactcaaactattttttgttttttttgtgggagtgtaaattagttcattacgacagtatggcagttcctcaaagatctagaaccagaaataccatttgacctagcaatcccattattgggtatatacccaaagaattataaatcattctactataaactcatgcacacgtatgtttattgaaacactattcacaatagcaaagacttggaaccaacccaaatgcccatcagcaatagactggataaagaaaatgtggcacatatacaccatggaatactaagaaactcaaactttttattgttgcgacataagtgatactgttataaccatctagaatatcctttttaaaaattttgtaattgtggtcacacttcagttttatttaagaaacttgcctctctgggagggaatgcttctcgatgctgccagccttggtttgtgatttgacctttaaatgaggtgctcggggctttgggctcctctcaggaatgtgtagccctctgactccattcattccttccccttccaggctttggaatggatccatgacaatggcgagttctacctttccacacacacctccacgggctccagtatacagcacacccaggagctcctgaaagagcacgaggagttccagataactgcaaaggtgggttcagagtgtactttgtatagtggcctctaagtcgaaagcgagtcttcaaaaatatcataaagaaatacctcatgagattggagaaaaggatgacccagtgggctgttccacattaactggaggatgcttcctccttccgttcacgtgtgtccctccgtgtcctccacctcctcccttcatctgtgtcctttgtccctctgatgtctgtgaatacggccatctctctccttttcttccttgtccttcccattattcccttctacactttccccttcctgtttacttctctaagatgttttctgaggacttgctatttttatgaaacactatttggtgtccccaagttgacctttatgtattcttggggtgttttctttcctacacctgggggtgtttcaccgtctttagatggtgaaaactgttacagtcgtgttgctcacgctcagtttagtctgcagttgtctgtgttttatggttggcagagtctgtgtcatcgcctctgttagtgcttgttcagaggtgtctaaaacttgaggcattttcatttttctcctgaaaataaaaataaaattatgaaatcgaattatctttatggcatatgccatatgtgtgagtaaatatggctttttgaggaaaaatataagaatctgcatattgacctgaatgttgtcccaattaaggcttatacctgcagaggctgagtccttccaagaactcacaacagttttgaggctcttttcaagtcaccattacaacctgtggggttgttgtttttcagagtctgagtatacgtcctttgtagtattttctgaagtgcctctattgttgatgacagatttcgagtttttggaaaaatctgacaattatttcaaatgtataagagtgggaaataaatgataagtgggataatatttttggttaaaaagaagtgtttctataaagtagcaagattggttatctcctgtggcccctaccctggctttgaaaacataacaggaatttttcaatcatgtagagagaggacagctactttgtattatatttatttgtccatgtttatgttttctgttactgttactgactcctcctgctcttctttgccactctctgctcctggtccccaaagctctcctttccctcggccctgaggtgctgggctctctccttttccacggctcctatcctggaggctcacacaggcaagcagggctgcagagagaccaggcatggggggcgcagcaagaagacccggcccagggtgggggtgtggtgagcactgggggagggcagggcgcaggaccaggggacagtagctgcccccagaggcacaatgagctctaaggagggccgccccaccctcccctgcagggagggatcatggcttttcctcctccacatacacacctggctggacagttttcactttttgttaatatttagatattacataatagttatgcacattatatgatccgtatttaggggcgtgtgtgtgtctgtgtgtgtgttagacatgggatcttgctctgttacccaggctggaatacataatagttatgcacattatatgatctgtatttaggggcgtgtgtgtgtctgtgtgtgtgtgagacatgggatcttgctctgttacccaggctggaatacataatagttatgcacattatatgatccgtatttaggggtgtgtgtgtgtctgtgtgtgtgttagacatgggaacttgctctgttacccaggctggaatgcagtggcaccataatggctcagtgcatcctcaaacttctgagctcaagggatcgtcttcaaactcctgagctcaagggaggctgaggtgggaggatcgcttgaggccaggagtttgagaccagcttgggcaagatgacaagatcctgtctctacaaaaagaattttttttaattagttgggcatggtggtgtgtgcgcctaaagtcccaagctatgtctgcttatttgaatattgtttgattataaaggtattaagaaaatgcctaacatcacataccacactcaaagctagatttaagatttgccatctttcacctctgctccactctgcaggccattgtgtatggccagacagcctgctcactgcccagctccaggggccatgcatgggggatgtgatgtacacatgactatttggaattgagtaacatggtggcctgctccactaataaagtgtatatgaaagaatttttccattcctgaatactccttttcctcaagtttgatgtgtggttattgaaagattgggcaatgacaggcttatttttattcttgtattttataagaaatgtctaaaattgtgagtgatatatgacctttctgatcctcagatatgtagaactgtttcttttgttgggtttattgaattggttataccaggaggaactggtagattttgaaaagaacacccctcacctttccttttcttagcaatctttttctttggtttctgactgcctttcccttaatcagaaaacacctgctttggtgtttggagatgtcctttgatttttcatcatgagctgaggctccctcacttgccttctgtcacccgatcttagaatcttctaagaaaccattttgcttttactgtatagagaattcttagctctgaaaggaaagtctttcagtgcacttgttacaatgttataacatttttagtgttgatggaaatgaagctggaaggctaaacaagagtctcccatccccggctcgctgagactcggctcggtccctttgcagctctcagtgcagtcatttctccacgggtcttgcaggcaccacctgcatccaggttgtgggtgtttatttaagagagatttctgtcctcactccaaacctagtgacgtaggctctcttggagtgaggcctgcggatgagcatttgaacagctcaccacttgatttttgcacacactgaggtccggaagccattgccttactgacgccacagccttcttcccatagggcttcctgtggtcctgatcaccagcgtccgcaatgccaaatgccttactttgttagaaagtgtctaacaccattgaatttctgtctaagaaaatgatgagcaaagctctcttgagcttgtggacttaagacttcaatttgcttttatttttctccagttcctcgattatgcctacagatgaagttgttcagttaaaatgtttatgtgctttttaagcactgtaacgatctctagagataacaaatagaataagaatgaaaatccttataatatctcactttaaaagatgtaagaattttttttaatgatgttttccaaggtaaatggctttggaaaaaaaattaagttggatttatatctcaccttgataccgagataaataccagaagaagatttaaatatcagcagtggtacctaatagtaccagaagaaataacaggatattttttatatcctcgtatggagaaatttgtctaaatgacacaaaatccaaaccatgaaagaaaaggttaataaattcacctacacaaaaaaatgtaaaactttacacaagacagtccaccataaggaacatctaaagttaaaaatgaaatagagaagatatataggcagctcatatcacaaaggactgatttgccagtaagaaagaacttttacaaatcaataaggaaaaaaaagaccaagaaaatggacaaaagatattaaacatgtgtcatagcaagggaataaatggccttcaccatgagatcatcaactttacttaatataagaaaagcgtacatcaaaaccacactgagttcatttcacccagtggattagccgagatcaaaaaggtggaccccatgctgcgtggacgaggctccgttgctgggggagtggagcagggcagcccctcagaggcctccggtggcatcttcctgccccctcgcactcctgcctgctcacactgcacttcctgtctgccccagcagttccaggtctcacaatgtgtgttacggcagcagcactcaggcacgtgtctaaccaccgttcatgcaactgatggatttcttgcattgttgccgtggtagacggaatttggaaacaacacggagacctattggtggagagacgttaacttacgtgcatccacacagttcacatccatatagtgaaatattacccagctctacctaaacacaggcgaggactttagttctgatcaggaaggacaactaggatgtgttcagtagaaaatgctaatacagagcagtgtgtgttgtatgcaagtacacgtgtaagaaatatgagagagaaaaatacttatatacatttgcgcacttgcttgtacatgcacataaaatgtctctgaagtgatagcaagaagctggtgattggaactggtgacagtggaaggtggggtgagaagagtttttactttgtatcttttttatctttggaattttgaatcctgtaaatgtattttaaaaataccaatgcaagtaaaaatatactgagatatttttaaagttcataggttagcagatttatggtacttagtttttatcacaccattcagttgctcaataattcttgtttaattttggcaagctgcattatctttttatcttcacttctgtgtccccatcacttaaaacactcaatagctttcttaaccccttaaagatagacatacaggtagtttacagtgccctccacagatggcccttgtggcaatgtaagagatgttagtgaaacaagcaaagatttctgggctgtgaaggtgacgttctcacaggagaaggacagacgacgattgtaaaaaatcacttgcaccctctgtcagaaggccatacatgctatgggaagcagcagagcagaagaataggcagggaggcaagctgcagtttaagggggtccagggagggcccgctaagagagtggcgtttatttgagtagagacatgaaggagccatagggatatctgggggagtggctttccaggcaggagcaccagtgcagaggccccaaggagggtgctggcctggaggggtgagttggtgagccacagctgggggacgggggtgctgttgggtggctaggggctggctggagtgttggggttatttgtgtagagtctggaggatcttgacagctgacttcacaggttacccagtgaattatggcttagaactttgattttacaagctaagatcatttatctgggttttgaactccgaccttctttcttttggggatttttaaagtcagtttcctgaatatgtgttaaaaagattttctagttaaagcttaatggagaatagcaggttccatagaagaggagtaactcacttatttgaaaacactataacaaaggaagcctaatagtaataaccatcgaaatggatgtgaagagagagagctgttgagaagtcagagttgagtgaggttgccaaatggtatatataacttgttgtatggttgtctgtgtatctctgtgaaaaataataaactatgcttaacttaatgaaagatcttttctgtgtacatacaaaatagaataattttagagagagctctcaaacagggaaacaaaatttacagtacctctatatagatgatttcctgactagtgaattttccttcacattttctgagagttaaagcaatcaacacgacacagaggagcttcatgaggaattttgttgagtgcctgctgtggggacagccgtggccacacatgcttcaggaaaaccaaaaagtcagatgactgcttgccccgaaagagctgtgggtccagttgggcacaaagagtaaacatgcatagagcgaggagctgtctttgctcagcggctttgaggagagtagcagcattgtgaagaccgcgttcttcgcatacattcctccatgcatccattctacacatttttactaagcacctcctagatgaagacgttgctgaaaaatagtctaagtttattctttgaggtcataaaaatgccattcgttgtagcagagctgaggagagatagctggtcaggaatccgggagatggagtgggtggacctggggctttggtctcagtttctaccatcagccggttttcctgttcagagctcagagttggagtcaagtcgccactgtgtttgaggtttctggcagtcggattcatttgcctcacaatactttcctgttgttttttgcagcaaaccaaagagagagtgaagctattgatacagctggctgatggcttttgtgaaaaagggcatgcccatgcggcagagataaaaaaatgtgttactgctgtggataagaggtacagagatttctctctgcggatggagaagtacaggacctctttggaaaaagccctggggatttcttcagattccaacaaatcggtaaatggccttgtgcaaactgaataaattatggtcttcttcctaacgccctctctgctgatttaattaactgagttcattggctctgttattccacagagtaaaagtctccagctagatatcattccagccagtatccctggctcagaggtgaaacttcgagatgctgctcatgaacttaatgaagagaagcggaaatctgcccgcaggaaagagtaagccagtctttcagaatctaccaggattcactggaaaagtgaagagaatgtcatttggacagacatgcttctgtgtgtgctttgaagtcacatggcacccaggctttttgttgctctgggtggacttagttgtgtcagcacagacttcgctgcgttcactgtcctcttatcacctggttcagaaacagcatctagtttttatccctgtgcctgtgtttcatttggagttgatgaattgtcattaatagatagtgacactaaggagaggaaattaatagtttttatcacgcctaaaacaaatttagttgtgtaaaagttgccagttagtaaactctatataaataaaaaagagtgctctaatccagtggttcttaattggcagttttgcccccaatgtgaggggacactttggttgtcacagtggggagggggagggagtgctgttggcctctagtgggaagctgctgagcactctccagtgcagagggcagccccacagcagagttacctggccccagatgtccacagtgccaggttgagaaaccctgatctgtcggtacctcagtaaagtgtgtgcagaaatctttttttcccctttgaattagcgggtggatactgttctatttgtgattcacctctccaaaatgatcaatctaagactaatacttttagacccactctgttatttcataaatccataaaagtagatagtgaagtaagctgcaccctgactgtactcctcactgtcttcctctctttaaggttcataatggctgagctcattcaaactgaaaaggcttatgtaagagacctccgggaatgtatggatgtaagtaagttttttttttttttttttgcttgtttatttagattgagcataagcttgctattttattcttacctgttggtagtccttagaataatcacaatttttttctgtcatttttttaaatgtaaagtatgcttcagcagccggtttcatgtttctgcacttctgtagagttctaggtttgtttttcactcattacagagatgatacagcattaatcctctcattctgtttatcacatgatggcctggctaacactctctttgtatagaattgtacagcagcttcagagaaatgtgcctactaattatgactggcaactaatactcagtggtatcaggaatattggttatacttgtggagtaggttaattccaaaatttgaagctgggaataattttagagttgaaaagtataggaactcctctcaagtattaacagcaactgagggccttttttagaagggttttttatgttttgtaaaagggtccagtccttagttatactttcacttatacattaactctgtgtgtttacagatgtcagaaacagctgtttcttgaaaatatggtgattatttttgtctaatccctgtttccctctcggctagacgtacctgtgggaaatgaccagtggcgtggaagagattccacctggcattgtaaacaaagaactcatcatcttcggaaacatgcaagaaatctacgaatttcataataagtgagtggctttttctttgggagcagttacgcttgaaatccatgtgctgaagtttcatcacaagaaatgaaccattcccattgaattaagcagatttcagtgattttgtttccatttgaatgaagcctatcagtctttctccaaaaagactgacattctagaaattcttttaatacagactcaactttatgtttgtacttatcttctacagaaataagatcaggaaaactatgaaaatatttttataggaagcttaatttctctgaagccgagccgtcaggtgccctgtgacttacttctgagggttgagagacagtggagcccccttgggactgcaggcctatgctgtttgctctcttatagtaagagaaaggaactgaagaagcaacagaagtgtattctgaccaaaataaaatgcattttcctttggccacaggaggtacatgattctcttttaatattgttaaagcagcggcagcagaagctcctttaggtggcctgtgatgagatgatgctggggtcagcaagagcgcagtcccctcacccctcagcagaaggcagaaaagaccaaatgggtcttcagccaaatatttacgtctccgaagtatatgctcagtgaacacactagcacttgcccagaaataaatttgttagaaagcatttgaaggcgaaactggctagctgtttgaaagtcacaataacttaccctagttaagagctacatgttttgttcattctttagggggcacagatttctcagtttctggcatatctcactagtaaaatgttttaaaacacctttgtaatatgataccatttttattctttgcagcatattcctaaaggagctggaaaaatatgaacagttgccagaggatgttggacattgttttgttacttgggtaatgaaacctcaaccatttgttctctcccagctattaggtgacgttgaaggaagttaggagggatggtcttcatttcctttaagtcaccatcttctgctcatatccatgcttgcggagaaatagactttacctcaaagaattgcatacttcaactaattgtttttgtggagtgagtttttttattggccctggtgatggtttgaaatagaatatttagtgtgccaggtctccgcttgaccctggggatttgctgataggtgagttcccagtccttctgggggatcgtctagtctagaggggaggcagacaggtgaacgtgcggtcatgctgtccaaagcccacagccagctctgcacgcgtgactgtggaaagagaggactggtgctcagcccgacgtgtcggggtcggggaggctgctgcagctgcatgctgtcagaacgatgtgtttcttatttcagtagctttctttttaaaatagagtctcttcaactcgaggcttaaatttccgttatccatactgcttcttttctatatgaaagtttatcatgcgttgacttgttatgatttaaatgagatctttttttttttggcttacaggcagacaagtttcagatgtatgtcacatattgcaaaaataagcctgattctactcagctgatattggaacatgcagggtcctattttgacgtaagtaatagattcctaaagagaccataattttccaagttgtgtacataaaatgcggcattactcataactttcacctaattgatagtacaatgttttcatttttgtctatcatttttgtctatcattttgtctatcatgtctattgggctattcttctattgtcttctgtttttaaaagatcctacacaaatactggaagccttatatctgtaaggaactcagattgtaatatatagatgtatgtttgtgtgtgtgtatatgttattatttatattcagtcatttataatatcattactatttatattcaatacattttttcacctgtaatactgtatacagaaggcataaactattaagcttcttttccccctcagtaaaacaaaaataaatgtgaatctttttatttttcctattttaatttcatgatgttacgaattttcaaaaacaacctaccagtaaagttttacaaatagtgccataacaactaggataattagaaggttaactaattgtgttctcattggagtaaacgtagatacaggtcatctgtgttttgaaagctgttgcagcggcttattcagcacaaaagagatggagctttagaacgtgatacacagagtgctttctgggtttccagaacttggtcaaatatgtgccaatacattttgattgaaggataaggtgctattgaatagtgtgcatagtttggtgcataaggttgtgaggatgttggacttgttttctgtctttacacttgtgcatggactggtgggatcatcagctcttatgtgaaagtctggggaagtagaataaacttttcagtttctatctttgagatgaagccctacctgtagatgaccctgttttaattgtcattctcctgaccattacattacacattacacatcactgcctttgttaataggaagccttctcccaggccaaagtggccttttcttgttaatatttcacatgattctaggtctttgccatcagacaaaattcagcacctgtatatggagttagaaatattttagtattaagtatttcacttaaacagtgagggcacatagcacatttaatgtttggaatcaaagccattttagaaacccttatgccccagcaaaataaactatcatcagagtgaacaggcaaccaacagaatgggaggaaatttttgcagtctagccatctgacaaagggctaacatccagaatctacaatgaacttaaacaaatttacaagaaaaaaaaaaaacctatcaaaaagtgggcgaaggatatgaacagacacttttcaaaagaagacatttatgcagccaacaaacatatgaaaaactcatcatcactggtcattagagaatgcagatcaaccacaatgagatactatctcacaccagttagaatggcgatcattaaaaagtcaggaaacaacagatggtggtgaggctgtggagaaataggaatgcttttacactgttggtgggagtgtaaattagttcaaccattgtggaagacagtgtggcgattcctcaaggatctagaaccagaaatgccatttaacccagcagtcccattactgggtatacacccaaaggattataaatcattctactataaagacacatgcacacacgtttattgcggcactgttcacaatagcaaagagttggaaccaacccaaatgcccatcaatgatagactggataaagaaaatgtggcacatatacaccatggaatactatgcaatcataaaaaaggatgagtttgggccgggcacagcggctcacgcctgtaatcccagcactttgggaggccaaggcaggtggatcatgaggtcaggagatcgacaccatcctggctaacatggtgaaaccccgtcactactaaaaatacaaaaaaaattagccgagcgtggtggcgggcacctgtatcccagctacttgggaggctgaggcaggagaatggcataaacctgggaggcggagcttgcagtgaactgagatcacgccactgcattccagtctgggcgacagagcgagactccatctcaaaaagaaagaaaaaaaaaaaaaaaggatgggttcatgttctttgcagggacatagatgaagctggaaaccatcattctcagcaaactaactcaagaacagaaaaccaaacaccacatgttcttactcataagtgggagttgaataatgagaacacattacacagggaggggaacatcacacactggggcctgtcggggggtgggggtctaggagagggatagcattagaagaaatacctaatgtacacaacgggttgatgggtgcagcaaaccaccatggcacatgtacacctgtgtaagaaacctgcacattctgcacatgtatcccagaacttaaaaagaaacccttatgccctaaaacatgtcttcaagaataagagaaatcatgcctgagagatttcacaatttatatgctttcagtattccttgtacagttggtttatttttttagaggctttcttctacagcttcctctcttctccaggctatctgataacctttgattatgcttcttaccagtaacaagcattattgaacatctgtatggtgctcatttaactctaagctctgtcttaggtgctagtgtaaagtggtgagtagcacagacagggcctgtcttcacagcaaggaatacagcaaggaatacaaccagttgtaaaggaatacaacctttacatgcaatacagatcattgcatgtaaaggacataattacaaaatgcaaagtgcaaatcatggcattaaaagtgcaattgaacagtaaggtagatcctcctgctccaaagtaccccttcctctccagaagtaacattttagaagcaaagaagtttgtgttaataatttaaaagcctcttaggaaaaggaaactttattatttcagcatgattaaacagttgtcaggtacagtatttggaaaagtaatgtgttttatggccatgatttaatagtgtagccctatgataactcttgtttcttgtttggttttaatacaggagatacagcagcgacatggattagccaattccatttcttcctaccttattaaaccagttcagcgaataacgaagtatcagctccttttaaaagtatgtataatgcgtcttcagcctgtgaaattttatgaattatgtattattttgacatttactatatatttatataattaccctgaattttttgaaacacctagtcaattaattttactttttaattcattagtatttattgacctgcctaatttctcattgcaggagttaaatgagagtgtgtgtcatgattatgcgtctgaactgcactgactgaccctaaacataaaatgagaaatcatcagttcttgatattttagtacccttagttcccagctgtggcttgctgactgcgggccaggcatggtgcactttggtacgctctgcatatgttaacctcccaacaatgctagtctgcaggcatggaaactagcctcagactgtaaggagtgtgcccagaatcaccactcaaacacgttaacaggctcagctcagaacacagatctggctgatgcccagggcttccactgaagccacggagaacccatgcccaggaggcttcctctgtcttgttgcttgtccctgatgtcacacccctcgcggcacaccttgtccatacagaccgcaagtattggagtcaggctgacctctgctttttattagttgtgagtgactatagttaaaatcacatttaagaaaacaatagtgattagtcttgacaatagaaaggtaaacaaaacttagaatttgtgctaagagttgtcacaaaatgtattttatttttatattatatatcatcaatacacattttcttgactacctaaaaattgacagattttgtctggtaatgttcagcataccattttctcagctggtgaatgttattaagcattaaaatgtagaaacatgcattcatcccagtgatggtattctatgaatcctgccatgttccagggactgccctaggctcgacaacgggaagttattatgtaatttgtctagatataaaagaaatttagaagatggagttacaaatgctggaactcttctttaccctttttgttagcaagaaaaatctacagacagtaataagtagctacatcgttttgtgaaagtgatactattatgggatttttcaattggaaaagctctcctgtacttttatatcaaaatgccgttaagtgattatgtgaccattcccgcagaaatatatagttactatgaatgcaaaataagtcaggaggctaatttgttcatattcaaatttgtcctttgctttctaattctacaaaggcagtttacctttcagtgtcctcaagatgtaaggattttgttttcagcatgtagttctgctaaactggtgcttaaatttgtaaacctcgccttactctgccagaggttcttcaggagaacagtgataagctctcttgagctccccaacaaggaaggttttctgccagttgtcagttagtaggctcagtacactgcatttgtgagcagtgtttgccatgctgcttagaatcacaggtaaacaccatctggtgatgagggaaggtgcccatcaggcagctgagttcctctcaagtaaccactgggagaccagtgctggctgcagtgtcatacctctcttttgttgactaccaagacacaaaacactgctattgctattactgactggtagtaattattaatacaccaataagaaagtatcttggctgtaatcccagcactttgggaggccgaggcaggcggatcacgacatcaggagatggagaccatcctggctaacacggtgaaaccccgtctctactaaaaattcaaaaatactagccgggcatggtggcgggcgcctgtagtcccagctgctccggaggctgaggcaggagaatggcatgaacctgggaggcagagcttgcagtgagccgagatcacgccattgcactccagcctgggcgacagagcaagactccgcctaaaaaaaaaaaaaaaaaaaaaaaggatcttggagcccaccagaaggtgaacttactgttcctgttatcattcatttaataacggatgtttctctaaatggctttgcaatgtaatcacacacatagggctccccagagagatgtaattcaaccattagagcttttctaaacatcctacgcaaaaaggaaatgcatttgactgtaagtaactcatgcggtgttactgtttctgctgcgtggattggctggtccggtttagatgggacattgcattcatagctccaaggtgcagagtcacgctgggattgtgtggtaaacgcacagttggacctgacatggcagtcagctgtaaccagtagctgatggtgtgttacataataattaaatatttctatttatcttttttttttttttttttttttttttttttttttttttttttttgagacagggtcttgctctgtcccccaggctggagtgcagtggcacaatcttggctcactgcagcctccacctcccaggttcatgtgattctcctccctcagtctcccaagtagctgggattacaggtgcatgccaccatgcccagctaattttttttttttaagtagagatggagttttaccatgttggccaggctggtctcgaactcctgacctcaagtgattcacccacctcagcctcccgaagtgctgggattacaggcatgagccaccacacccggcctctgtttatcatttttgaggcttgattgttaacaggtatactaatttcatcttaaactgtgaatacatctggcttactctgattagaacaggacaaaccctgccatccattgaataaagaggtagtagtttatttctatgagaacatatgcccagttgaccacattctgtttttatcttgaaagccatgggctttcataaactgtttctgccaaggtcttattggcagagcattctgcagtctttacctagtttctgttgtttatctttgcaggagctgctgacgtgctgtgaggaaggaaagggagagattaaagatggcctggaggtgatgctcagcgtgccgaagcgagccaatgatgccatgcacctcagcatgctggaaggtaaaggaccctccataccccagtgtgcatctatgcagtttctaatgacactgtttgtaaatggatttcctgaaccctaaaaatccccgctttatgtctctatgttagtggttaagaacatttcttaaagaatcagtgtcattgcttttcttgaggaccacataaaatgtttctatactcattgaaagccttttctggtcccttcactggaaaacagcctctccacactctggactccaatagcactttgtgtcgcttgctgcaggccacctgttctccctgttagatggatgggtaggtgggtgtatgggtggatcaaaccccaggactgtaaaatccttaaaagaatgtgttgcttccccacctctgtatccattgcatcacttgctagagcctggaacatagtaggcaccagatatttccttgtgtaacatggtaaagagaaaattagataaatatgtttcaaaattagagcaattataatttccataaatgcctctgtttaagaaagctcttcctgttgtgcaaagcttggttcttgccaggctacacagaataagttttaatcctgccccaaatgcttttgctagcctgtgtctttatgggtaacactgaacataggtgccactgtgggtaataagacccaaaactcagaggccaagcaaaacagatttttctttctctgatataaaatgctgatctggtatggccgcccttcatgatgtcatccaggacccaggctgtgttccagctagtttctctccattctagttgtttttctggctggctaggtccagggtgtttcaagaccatgccaacattccatttagcaggaagtggggaagaaagtcagggaggaaactccagatgggcagacactagcagtagtacccgctactttgctcacttgcccagagcgtaggtacctgagctgcttttaactgttcctggggctgggggatggagtgcttattttgagcagccctagtgggagcttctactatgagagtaaaaagagagtggaagtcaggaggtaatgggcagcctctgccctagggctggctttactaagccctggtggcttcataaccaggtgataaagcaggccacttccatgaagagaggagcagtagtgaagtccagagcacgaatgattcacatgcagactgtcacattcagaggagggagggtgcaccaagcatgggcagccagggacttctccaagaagcaagaccaggacaggtccttgaagaaagcctggacctgagcagagtgtctgggaaggatgctctgggctgaggaagcagagagaatcaagacggaggctgggaagtaggtgggggcttagaggagagtcggaactgtttcagaggaggagctttcggtggtgggatgctgcaggagagggctgaagagaagtagagggtggaaccagatctcaactgttgcagaggcccaccagagggatagaactcaaagaataaagccatgaggaatcgcaaaatgtttttgaacaaaggaaaatatatgtaaagtggtgtgttaggaagaattatcctctgtaggatgggtcagtggcgtcgagtcaggatcagatgggaaactcttatctagggttggccgatgggcatttttaaaattgttgaaaatactaataatgctttcttgtgcatcagtttttatttttcttttaaattgatttgcctcccttttttcatgttgtagggtttgatgaaaacattgagtctcagggagaactcatcctacaggaatccttccaagtgtgggacccaaaaaccttaattcgaaagggtcgagaacggcatctcttcctttttgaaatgtccttagtatttagtaaagaagtgaaagattccagtgggagaagcaagtacctttataaaagcaaattgtttgtaagtataggcgttcagaattgtaagtctaaaggtaacacaattgcagtctttttgtaggtagagaagaattgttcattgtcttcagtttaacctcccaatctgtcctgaaatgttcaagtctgaattgtggtagggttttcatcttcagtgaaattatttcccaccctcaagtccactagagggtgctctggagtttatagacttaggaaacttgctcttcttaaatcctgtatcatataactgcaggataagaaaacatttcataagtgaaatcatttatctccggtgtgcttaactagctttataaataaaataatcatatctatgactaagttcttattataattaatttttcaaccataaacattggagtatatggaaacagccttactgggtggctcacatttaaaaataaatgtatgaaatataagtgcatgagtaaatttatggttgtttataacagtgaaatgtcattattagagaaaatatacttaagccaaagtacagtctgaaagatccacagccccagctatgtggagacagctgcccctgagtgcttggcagatccggtgatgcattttaattcgtaacctgtcattgtacttcttggcaagagcaacatacctgctgccattttgtgaccactggctagccttaccagcctccccaagggcagcatcgtctctggatccagtgtacttccatctaacttagtgggccgtttctcagaggcttattcatgcagggtcgctgggcagggccaggcagaagggacgattgggttgcactaaggaggaatcatcatcaagaaaagaatagaaaatgccaagaaggtgggtttctttacagcagatctcttataaatactggtagatgtttgcaatttggacaacttacacatcatactttttgtgatgtccatatataatgaaattcttcaggtaataaaatgtccccgagtatggaaatcatctgagtaataatctggaattcacaggttccaaatgatggttttcataccattttgtttggcttgtgttctgtttgagatcgtcttttggatcacagcttgcctgacatcattttaggtcacattctgactggaaagaaaaaaatgcaacattgctggctagtaatttcattagctggctttaatctctctttagagaccaagctcatctgttttagcagccaatacatcttcacttaatttatcttttagaagttaagattccctcagaggctacctctggagctctggatgatgaatcacttcctttgctggggtggagaatgcatcagggggaccttgactgtgggggaggggctgaagctattgacctttctctgcatgcttccatgttctgcatatattacagagggattttgcctcttagccgttaaaattattgatgaaatactaaaagctaatgctattgataaagaaattggagaataagctgttaaaacatcatttgccctctgggaagctgtgtcattaatactgaagagaacatggtggcagcccttttgcaaccaggaaagactcattttgcagtttgttgcttgtaagattgcaaatagtcgaatcttgattgtcagatagtaggattttcacatgttggtttccttcccctgaattttttgctcgttgacctgcactggggtctccagtaagagacgctcacaggaagcgaaggatgaaaccagtcacctgtagcctaagaacacaatgtcctcattataactcacatgacagctgagatcactagtgacgttcttataacctaacatggccacaagtaaccaaaacctgtttccttggtctctgttctgcatccttctagaattttactgtcacctaattatataattgtctttttatccagacctcagagttgggtgtcacagaacatgttgaaggagacccttgcaaatttgcactgtgggtggggagaacaccaacttcagataataaaattgtccttaaggtacgttcatttgaagctgggaatgtgctgtttgaaacatttactgtggccatccatgcttgcttttccgttgttttcatattattattatttgttgttgttgtttgtgtgtgtgtgttctattcagattggtgactaccacaaaaagaatagtggaataaattcagtttggtgttctggtgatgaaacaatttgagttaaactttcacttgactcctgaaagggcaaatgaagcaaggtctttttatatttttcccattcttccagtctttgaattcattgactctataagagatgcaggaagtcagggtacaggaggaatgagatactgaccaaaaactctgattgcgcacttgacctgtttcgaaaggaaaaagtcacctggtgcgtgtttgaggacctgcgacaggaagtcgaggccaaccgtacccacagtccttacagagtcctcagctctgtggcttaatagtttggagacggagggaaagaggaatgattattagtgacagggtttgatactgttatgatttaaaattcaaaaccactagggatgctttagggtatatagtctttgggggaggaaaatatcttggaatatttgatttgaactctgttttgattatactaacctctcctgggaatggtcaagagctctaaggttgtcttatgtattttcctcctctgtgtttgagaaaatacagatggaacttttggagccatctggaaatgccatcagcggctttgggatgtttgggggacggtggagctaaggcttatcgaatattgggagatgagccagagtgtaatgggactctggtgtatgaacctgcatgtcaccccttgtgtctcttgcatgctttttcatctctttggtattttcagtgactgtgagttactcccctgtatgtcagccttctagagcctgttcttcagtggaagccattgtgttcataagatttttgttcatatgtgatagtgggttgttttgcagtgaatatgtgattatcagcccaatgtgctctggctagtactggcataaagccctatatgatatcagttgcaccgatagctaaatttaaataactgtattttcttcctaaggtctaacattttaaggtatactcaaaacctggaaacttgcaacttatataaaccgcttatccagactagctacagtagtagatgccaaaaggtgcttccaaaaaatagtgacagatactttagccagatctggactttcatttaggatgtcgtaaatgctcatggtacagttgacaaataagactcttcttatttgtcaggcttcgccaggtacaagttttctagggaattttgggtaatacctttctgacttccaaggagaaagtaaaggaaacgatgttctcattaatttcagggattgctgcatggtgttggtgtagagaggcaggcgatggtgatggtgggaatggtagtgtaatgatgatgtaggtggaggtggtggagacgctgtggtggtggtgatggcggtgaaagtttagatggcagtgagggtggagatggtggtggtatggattttggtggtcacggtggtatagatggtggtgagagggtaagggtgtagaggaaggtagtggtatagatttggtgatgggggtatgggtacagatggtggcagtggtgtagatggtggtgatgagggtatagatggtggtggcatagactttggtggtgatggtggtgaggttgtagatggaggtcatcgtgtagaatttggtggcagtggtagtacaggcggtggtagtgctagtgcaggcagtggtagtgtagatggtggtgagggtttaggtgttgatggtgagggtacagattttgttggtctagatggtgtggtgagagcgtagatggagatactttagattttaatggtagtaaggttggagatggtggtgagggtgcaggttgtggtgagggtacaggttgtggtggtgaaggtgcaggttgtggtgggttgtgagggtgcaggttgtggtgagggtacaggttgtggtggtgagggcataggttgtgagggtgcaggttgtggtgagggtgcaggttgtggtggtgagggttgtaggttgtggtgagggtgcaggttgtggtgagggtgcaggttgtggtgagggtgcaggttgtggtgagggtgtaggttgtggtgagggtacaggtggtggtgagggtgcaggttgtggtgagggtgtaggttgtggtggtgagggtgtaggttgtggtggtgagggtgtaggttgtggtgagggtgcagcttgtgagggtgcaggttgtggtgagggtgtaggttgtgagggtgtaggttgtgatgagggtgtaggttgtggtgagggtgtaggttgtggtgagggtgtaggttgtggtgagggtgcaggttgtggtgagggtgcaggtggtggtggtgagggtgtaggtggtggtggtgagggtgcaggttgtggtgagggtgcaggttgtgagggtgcaggttgtggtggtgagggtgtaggttgtggtggtgagggtgcaggttgtgagggtgagggtgtaggttgtggtggtgagggtgcaggtggtggtgagggtgcaggtggtggtgagggtgcaggtggtggtgagggtgtaggttgtggtgagggtgtaggttgtggtgagggtgcaggtggtggtgagggtgcaggtggtggtggtgagggtgtaggttgtggtgagggtgtaggttgtggtggtgagggtgcaggttgtgagggtgcaggtggtggtgagggtgcaggtggtggtgagggtgcaggtggtggtgagggtgcaggtggtggtgagggtgcaggtggtggtggtgagggtgtaggtggtggtggtgagggtgcaggttgtgagggtgtaggttgtggtgagggtacaggtggtgagggtgcaggttgtggtgagggtgtaggttgtggtgagggtgtaggttgtggtggtgagggtgtaggttgtggtgagggtgcagcttgtgagggtgcaggttgtggtggtgagggtgtaggcagtggtagaagtagaggtatcgtgctgctggtgtgtgtgcttatggtggtagagaacgtgatgggaatggtggtagtggcgatgatgatgtcctcatagttgtaaaacaaaattttggttattttcacttctctagtctggaaaagagaattttatttttaagtcttaagcagattgcgactacccagattatgaaatgaactatcccctctcttagccaggtaggaccttggtatttagtactttacctcagttacctttctcttactatttctgaaaaactgacatcttttttcctcgtttaatttctttaaggttaggagaattactctctaagtgtaacgatcaattcatatgagaattttctttatttctgaaccatattaacagttttcctcagttgtttccaaactctgccagttgttcttttgcaggtacttctctttagttgaccttccaaatacttttatcaggcatttaaattccaaccaatttgtagtttttagaaaagtttcttctcccgagtcccttactttccccccgctttccccggtcaccctgcctccttcctgccccctcgccagaagacattggttttcctgctgtcctatgtcactccggagaagagggagcaagaggctgcctttacccatcatttcttttccctgtcactacctgttagtaatgttaaagacaggtcctctggttaaaacggtttctgtagaaagaggatgatcaattttaatttcctttcccaacatgggctttgattttctgttttcaaaaacaggatacacagtgagaaatgctgggcgctccccactttgtgacctcatctacgatgagttatgacgggttaattataactgcagggaattatgcttatatcataggagattgatattttctgtgaggaaattagaaagctgttaggaaggcccagaacatgcagaaagaaaaaaaaaacctcctttgaggcagagttaaaaaaaaaaaaaaagtctggatcaagtgatgtcgtgcgtgctcagtctgcaggtgcttgctgacaatctagtctgtgtggttctcagaggacatttcttgagagttgtaatggagtcaaggtgaatctgccatcggggattggcagttggtgagcttggaacattgggcacatttcttctgtccacacctcagttgctcatttataagacggggctgcaggagtctcccacccgcagagtccttatgggagtggatgacagcatgcgagaagccctcggctaggcacagggggctggaggtggtggcagctgcgccgctgttccctgagtccagcaaaggaggccgcaaggctgtggggatttgttcagtttcctgctggcagtatgccccctactgaccagtgcgcagtgtttgcctcaatagcctcagaggcgttttggtggcagtgagggtggctgtgttggtttatttgcccagggctgcttaaaaggtcttggggctggagaatgatggattattgcaatagtcagagatctggagtaatatacgtgctataaaacaaaaaaggttttgatgaaaacgtatttttaaatagtcatttatttggtagcatattaaacgtcggatgtggttgcttttctgctaaaaagtcattttgaaaatagaaactcaaggaatgcaggaaacctgggtgtggttagggcaaggtctggaaagggccgttccgtatcctaagcaacgctaacaccttgttaaggcttccagcatagagaacaagcaggactggataaagcatatccgcgaagtcatccaggagcggacgatccacctgaagggagccctgaaggagcccattcacatccctaagaccgctcccgccacaagacagaagggaaggaggtgcgtgtctgggcgccactggaggtttgtggatgtgggagggaggggcgaggcggtgttagctcaccctgcttcaaaaatcctttctctcaaacattttgaggaatacattttttaaactgccatttgtggataacatcattcttagtaatgaaactgctttgtcagagataagagcctctattggcttagagtaaacgaagggctgtgtgcaaacctctcattgttttgcctttctcaccccgagcaccatacagggcacatgtctaactcatgcacatgaccttggataagttataaagcatcgagatgttgctgttttctcatttttaaaatggcaacgatcatatcaactatattttatggtgatgggaatccaacaggatgatatgttttaaacactcagcacagtgcctagcagaaagcctgtgctcggtgaagggtgccttaaccattgtccgcatcctggcagcagcaggcactcacgaaggctgatatgcacctcattaaacaaatcagttgcttctccagtgactgccagctcagcagcatcaggaactaaaagtttctttgcaccgccagggatggagaggatctggacagccaaggagacggcagcagccagcctgatacgatttccatcgcctcacggacgtctcagaacacgctggacagcgataaggtgagtcactgccggcactttgtgtgcggaggggaatgtggccagtctctggtcaaagcagccccctcctttctgttactcacagtttgtcatcaacattttcaagcagttgatacgtgccaggagtggtgccaggatcccgtggtggggcagagacttgggggattggggtgagaagacctgaaccctgaggattcaggagaaatcattcaactctttccatcctgccctttgccagtgccaagggtgttactggacattcgagggcagcatacttagactttttaatcttattcctaagcagaagaacctatcatttaaaataaaatcctacacagaacaccagcgtatgttttaatttaggatctttaagatggacagcacccttccagcgactaggagggacacaagatggaaataaagagtgttgcttacaggttctggggatcacacggcatccctggaggacagggagcatgtggggagagaggagtccttgggccaggccctttattgtgtccaggacattatccaaacaggtttggcacagggcgtctcaatgagtgggcttagagcaagcagacacgagtttcagaaggtcatgctgtgactaggaagttgtcactctggcatatctgcacagtccacatgaggtgcgagtgtcagcagggccagttaagcaggtcttatatggctatcccttagagaaatggtcaccagaaggaagttctgtgaagcagagatcaggacctaccacactgaaggcctgggagaagatgctcctgttatgagaaagtccagcttctctgggttcatagtgatgccaaggcaatgtaaaatagtaagaactcatggcagtgtagaagcggagctgctctgatggaaatgggggctgtggccctgagatgccctctcataaccatagtgtgcagcagaacatagaaaacctgccctggaattggcaacagtgatgaccactgtgagctagatctgatttttatcaaaaaagtttgtataggtgtatcttcttcagaagcagcctagagtatctcatgattttgtctgatacaatccaaaaatcccacaaagtaaattgctagtagaatttggaatcctgggtttacgtgatggacaaaagacaaaatgttctctgtcagccagtggggaacattgatcttaatgaagtcttctgttcctgccaagactagtgtgttctgttacattactagaatgctagactgaattctttttaaaaaaattgacagtaaatagggggtttatttatgagcccagaattgctgagcttctcattctccaatgcaagtcagacctcatttcatgagacctttgtccccatcatgagacccgggagtctgttctctgcacatcatttccgcagcccactcattggtaggaaggaacaatgccctgacctcaccgtccttgggaattgattcagacagatgacagagtccagtatttggaaggttatttccgtggcacatcttttagtcccagactggccttttctcacttggttttgtaggaggattcatgatacttaatgttctagtttcaaggacgggagtcagtagatttaaaatactgctctgctgcagtgattccattttcaatatcctagtttaagtgattagattttttttctcattatactttttgggttcactaaataatagatcctaggacttggagtggttagaatgacaagaccagagaataaaaagaatttctcattttattttgttcaaggccctatgtattggcattcagcaaatatttcttggcatgtagtaaaaagaaataagataaatgacatgttcaggcatctgatgcctgatagcatttctctccgagaccccacctatggccattgaggttaaagaaataaagtttgagcttggaaacactttgttagagtaatattgataaattttttattttattttactttttaataaagtaatcaaggggattatctggtgaatttccatgaggctgccacctgaaaggaaagttgaatcatgggtgctcaagtgtgtgggaaagtggcccgcattcagggcatttccagaccatttgagatcaccgtcaagccccaaattcccattcttaagataaactcctaggggtctgctctggatttcccctagacatgagttcaaaagtttattctttttttaaaaaaaaaaaagtaaattttttgaatgaaattgctaaagagctaagtggaaaagttagctttggagggttccttttttggaagttggtctaagaggcaaggataacttgtttcctcgggtagtttatggataaatgggtgcctgggagtctggaaatgacccctctatccaggaaggggctctggagtctccagttcattattccggacagagttgctggtgccacgacttatctcctgcgtgtggagaattccttggctggtacccacctcctctcagccccagcacagccctggcccctaaggcgcgtggctgattgggattccccagcggcttgaacagaaataagtctctatcctggagttaggagtagtgaaattagcacgacttcacatctgttatagcatattagggagggcttacgtgaactgggaatacagcaaattatatttgtatccaacgaaagaggaagaataaatcactaccagaacagtataggtttgccaaaaaaaaaaaaaaagcaaattttaccctagcagtccactagggtatgaaaatgttaagaaaactccctatgagatactctatctgtgaagatgattcaccagtttctcttgacctcatctgatgtgttgtccctaaacttcactcctgagctcagaaatccctgaagggtcggctgagcacgcggtggctcacgcctgtaatcccagcacttagggaggccaaggcgggcagatcacgaggtcaggagatcgagaccatcctggctaacatggtgaaaccccgtctctactaaaaatgtaaaaaattagtcgagcgtggtggtgggtgcctgtaagtcccagctactcgggaggctgaggcaggagaatggcatgaacccgggaggcagagcttgcagtgagccaagatcaggccactgcactcccacctgggcgacagagcgagactccatctcaaaaaaaaaaaaaaaaaaagaaatccctgaagggtctctcctgccagttccaccattgcctctccagccccgctcctgggaggctctttcttactgaggaccgcagcctgccacgcagcaacactcaccctggtattctcatggttaaccatcttgaaggaatgacactccagactcagtttcttaaacagacctggcgaattttcttaatgccacttgctgagagcatcggtccttagtaggctctaaagcacagaaaggatgaaatgtcgtgtcgtgagaacagaaccacagcgggtgtcttactccgttctggagacctgcatttgggattaaacggcgtatgagacttgccaataagtcagaatttggaatttggagaggacgtacccatgcggccttacaaacaagaaggtgcacgtttgctgcccacgtgtgcctgcgtttgtgtgtgctctgcttatgtgacgttttctcttagccatctccctccttatgcctctccagtagaacagttgagggtcattagatgactcaagaacacattttgaaaatcaaggactccatcctttccctagtcagtctgcaaaatgcactgtccctctgaactaggcttaaccagcaaccccatctccggtgacggtaattttcctgagtctcgaagttctttctgccctacgtagtttaagtttaagcagcctctgataacgcaggcagatggatctggcaagggaaatcacttaacgacattctgcctgttcgacttaatttatgatgtctgttattagttagttgttatcatggaatttggtttcatttcagaaactgggtcgggggatgtttttgactcggcctcttggagaattctgaaggcaaaagttatctgctagggctgttagtaattctcagatgaggcacacaaggtttagggagagtctgaaggagggaccctggagacgccctctttccagggagcactgtcagcagagcggggttagccaggccacggccatgagccacaggccccagcagcacgtttcctactttgaaaacatcagttttaaaatatgccttctttttgttccagaagtgaatttagtactgatccttgctgatctccatggtacttaacctgacacaatgatcttatgaaaatataatttggattccaaagaaatcaagcgctttccagattcttatctcatctgtcctgagtgcatctccctgcggtagggaggagagcgctgagccgggcctggggcactgcaggagatccaggccctctgcaaggcctcccagcagcagagggccacagccagacacggaacatgcatttaatcatctgtcattttccaggccttattatttcatgcaagagctgaatttggagctcagtatttttactaaagacacatctttaaaaattttttccctgtctcttccttattagtctgtgatttataatcattaaactaaaatccatattacaaagaaaatagaaaacatggaactcaaactgtattgtagaacaaagcatcttgaggccaacatggaaaaatggccgaggcgagatgaggtatcctgtggaaaagccggcccgagccagcagggcccaggtgtgagctgtctttcgaatcttaagccgtatgtttcttatttctaatgagtgagaaattcagttgagactgataacttcatgtggaacccccttcccaagcttataacatgaatatatggattcacatatttaaaaacataactggtttcagtcactctttttttaaaattcctgaggcaggatctcactttgtcgcccaggctggagtgcagtggtgtgatcagagctcactgtagtcttgaactcctaggctcaagtgatccttgcctggccccccaggtagctaggaccataagtgtacactactatgcctggctagttttttttttatttttgtagagacagtatcgaactgtgtttcccaggctggcctcaaactcctgacctcaagcaatcctcccacctcagcctctcaaaacgctgggattattgtcctgagccccactgcatccagccagtttcagttattcttaatgaagccttagcaccgtgttggagacatgaggttctatgtgttgttttttttctttctttctttcttttttttttttttgagatggagtcttgctctgtctcccaggctggagtacagtggcatgacctttgctcactgcaacctccgcctcccaggttcaagtgattctcctgcctcagcccctcttgtagctgagattataggcaagtaccaccacacccagctaatttctgtatttttagtagagatggggttttgccatgttggccaggctggtctcgaactcctgaccccaggtgatccacctgcctcggcctcccaaagtgctaggattacaggcgtgagccaccatgcccggccacggttccgtgtattttaaaatttagaaaagcaatcagctctttctgtcaagtgacgttctacactccaggaacttggtttgacttacataaattgcagcgtcgaggtagtatgtaaagtagttaatgccaatacattttgaaatatggcctaattcaccatcttgggtaagggtgtatatctatctaatgatgcttgcattcagcctcccgaggttgtcctgcagtcctgcgttctgcctctattcaccacatggaaggcgtagggctgctcggccaggcacagaggtgtcctacacccttccctctggctggagctgctcagagaggatgctctctgcctcctggccagctcagggctctgagtttcccaggacctcagataagtttgccccatgtaagcatgaaattgagtcatttaattcagaagccttttccacaggatggtgcttattttaacgtcctttataaagagcactcccaaccgcagttgaccttcctctgctcagagtgtacctggcagtggcatagcatatacaacacacctaagagcaggcaatcaaaagcgaggatgtacccaccagcaaacctctggcctctgcctcagcagctggtggtcttgggcaagtcacctcacctctctgaacctcagtttcctcatctgtaaatgggaatgatagtactgctcacatatatttagatcagtgactagcatgttctaagcactgaataaatattcagtttctgtgtctccgttatacagatggcttcctcctgcctcactcgggctattggccggcattgctgctgttgcaggttactgtcaatttcagcctccccttccttcatctgcacactcttggggctacagtggatttagctgttgattgtattgtacttgttaggatctggaagctgtcctaagaatgaaatgttttacttcagtgcctggcctgatgaattgtggtggctcaactgcaaaattctgtgtgtggaatgggcacaattactgcagaagggggagagtcttgcgtaaagcacctttccagctgttccgtctttcatcctagctgcatgcgtatccagtgacctaatattcaaagggtgggttcatttattctcagatatgtattggccacccactgtgtgccatccctatgataggcattcagcgcacaagaatgaatgaaggagacagagccccgctcccctggcgagctctgagtgatgggttccgtgtgacgtctgcttccttcttttactcatctttgttttctgtttttctaagtgatgtggctttttgtatatttttttagatgagttttttaagttctctcataaaaccacaaactgaatgtcatctttgatcatttcagttaccaaatcagaaaaacaaaatcccccaggcagaagtagaaagcctcagttctaagaaaagacagattttttttaagtttggttagaaatgttacaaattaagtgtttgtaaaatagtagagcactgaaaagtgctatttagtgtaaattttacacaacatgatcgaagttacagttggagatggtgataaagttatgtttcagactcgaagcaggtatttattctgattgctcttcctggtgagggcccagtcagctagttaacataagctggttgaggtcagctagttaacgttagatctcagatcattgtccctccatgaaagacaaaaagaggtatttcaaattaagcttcctcaataaaagattgctttggtcactcaggaaatacagccaacaggtttctttgggttaaatggtcctaagaagtttcttgctttccagagcctaggggagtgcactacgtgaggcaggtgtttttcaactgtttgcctcttccccgccctcgttcccttttccacttcatagccagaaagcgtttacctgccacgccacagggccgcctgtggggcctgcacggcacctccggcatttctcactgggatatgctaaaagcaagagtacaatgttggtccaggtgagcctctgtgaacccttgaagcctaatgcgagggagctgccacgtctctggtttgcctaccctttttagttgtatcttttaaatgcagccgtttttcatccagtatttcattccaattcatgtgtatgacaacacactcaagtcttccgagatcaatcttcacatcagaaaagcagtgtgtgagcatgtgagtagacagtagagggactggcatcctcaaacactgtcctcactccttcttttccagatacagtgttgagtatggtaagctgctggttttgaaaacgttttttctcaccgatttttttttctttaattgtggttaaaaaaaaaatgtaacgtaaagtttaccgtcttcaccatttttatgtcctcacaggtttctttctgtacccctagtgtatcggagcctatcacaatagtcctcctcttttaaactctaagtggcagattttagtgaacgcttcttcttggaatttgaccttatgtaaagcagcttgggtgttggcgtgagcacggagggcctgttgttcacgttagaacagctgctgatcagcccgagtctccgtgaagttgccctgtggagaagcttgggtgggtgagagcctggggcataatagcattgattagggaaattgttctggctgcctatagttacccttttttgtaaccattgctagcaatagcactgtactctctaattccctttaaccaagtaatcattttttggcctactctgtgtgaaaccttcacggaaccgcaagacccttttgtgaggtttctgaatgactgaactgtagtgggctgtaggctgtgacggttcacgggagttaatacactttgttctttaggggaaaatggcttttattaggccacattctccttttgcttttgaattgctctcagaaaattggtcagaacccacctgcaattgatctttaccacattagactcttgttcttgaagtagaattgtttgcagcgaagactgactgcatcacccaccacaccagtccgagagagccccctcttcctcaggcagagcttgccccagaactcatcgcagagcttggtaattcaaaccaggtattgccgccgtctatcgagagccatatgttcttgagccatacatgcctcattgttgtgtccagggcgggggtgttctgaggaacaaaggaagacgtgacaactcgcagtgtgagaagtccccagccacagctcttgttagttacagccattaactgcgttcgtgcaagacagtgatatgacatggtttctttggagaacatgaaaagtagaattctgttctatgtggtaattgttgaaggttcacatgcttgcaaccagagatgagtatttcattctctcgggtgaaacacagtaagttgtttattttcagtcattttggaaagaattcaggaaaggaaccgatttgattttgccaattgtccatatgtctgggcctaaagagggacttgggtgtagtctttggaggaggcacattggtggtgggtccctggcccctggtccaattaaggctgttttgttgtcttgcttgttagtcaccacattcatttttttaatagtgaaaagttgaaaggtttaaaaaaatctgtcttctgatatgaatctcgcaagtgttaatgtgagtcatggaaagtgagattttcacaaattgcaatcctaaattcaatgcatgaggtgggagcccatgatagaaacccattaaatatatagaagcaacgaagatactgtgagaacttgcacaaaatatggttagaaagaaaagggaatttttaaactagataaataaaatggtaactctttcaactgagggtagaaattctctgaaagccaagacctccgtcagacgtaacatacgagatagtggctgaatgttttctagttcggaatttaatttttcttaaaaagcagtaacgatttgcactgcttcctcaaaatagttatcacaagtcttttgtacacagaaaagttttttttttttaattagcaaacctggtttcaaagatgttttgcagcaagaagttaaaaatattcaaatgtgagcattgaggtgcatccccaggacagctcttctctgggctagaaaacacccatttaatcctcccctatggggcctctctttttgggtaaagccagttgatttgctgggagatgggaagatttttaaaataattgtagtgccctttgaaatattctgttgttggattttcttaacaagttcttaaaagcctttaaaaaggaattttaactttgtatatgattctttggcagaacatccttgatttttatttcttatgtgctgtcaagtacacagatgtttccaatagtttttgattactctttaagggcctaaaaaatcagtgccagaaataaagtctagcttaatcctccttcttcggcagcccctctctccccttcccacccttcccccacccgcagcccatggctttgagccgtctggaaaattaataagactctggagaatgaggcagccagagggcaggtgatgagacagtgcacttcccagcgtctgggagtgggggctgctagaagaatgtcagggaagcccagtgggtttctgctgggagcttctcacgtgcgctcagtgaagcagcgggtggcatcactggggagctctagccagacccagaggcctgggaagggcaggtccaaggggccatggcaatctgtaccctccttcggggcctgcagaccggtcctgtgttcccggaacaggaagcaccccagctctaagtcacgggactaaccactccatgagtgtggttctacaaggagagttcttttccaggctgggcctctgcctttgagcttttaacattagcatctttgactgttcagagacctgaaaaatttaacatgggttttccacggagaagtttgtaagattgagaaggggatttatgaaaattttccttgtggcctagcaaagctgattcactttgttgatactgtgcttcatggtagaagagtttggttttgttttggtctttgtggttgtctagtggacatgtgtttcttattctgaatatctgaactttctcttaaaagataggctcctacaacaggaggataatcaacagcacacagcatggcagaggctcccagaggtcctcagcacaagggggcagccccagaacacagcgggagtgtgagccatcggaggatgtgcgggctcctgggtctctgggtgtgggcttgtgctcagtggactcccaacaggaatgtttcccagcaggaggctgggccatttcctcctcccttctctcactcccacagccagccccatagcccgcagcacactcttgtgtccctgtagtttgtctgggctactgccctttagcaagaggtgacaggggagagctgagcgtctgcaggctaagcacaggcagagtgagctcctgaagccagtgaggaaaatccaggcttcgttttgggttttcaaatgcattgccttcatttttagagcatatgtatcttttctttttcatttcacaaatatttgaatgctagctggatgcggagcacagtgcgaggcaggctgaggaggagacccactcctaacagcttctgtaagtcacatgcctaccaccactggcactgggggactcagggtgactgtgcccagccccatctccgccctcccagtccagggatggaaagttcacagaagagtagggtgagcctgcttctggtgatgaaggcagacacacacacgtgtaactccagctgtggctcacttcagaattgaagtgccatggaggacaggcacgagagggacttctcggagccagtggggagcttagaatagaggggacgtgggggctttcagcaagagggatggtatgggctacttacaggcaggacccctcaggaggaggagggaggtgcttctggccactgggggggacctttgcctcctatgctaaggcctttgtgtgtgagggttttgcataagaggatgacgtgtttttagaaggtctcctgccagcagtgtttagatggcttggaaggagaacctggagtctgtgagggaggaagctcaggagcccctgcgggacccagtgaagtgattggtatgggagtgcagagaaaggaagtgatcggagagccgcgcaacatctgctcgacagcatttggagggaaaagagtggggttttttagcttgagtgacttgatggtgatactgttacccaaaagacaacaccggaagaaaaagagatttagggggtgggagggcatgatgagtcatgtcccagactctgcattgcggggacagggaagcatccagttgcccagcagggatcgaaagtagtctgcagttgggatgcttgctttgctcgggaggagtcagcttgagggtgtggttgaagagtccctgcagggggacagtggagaagcagcagagacagaacctgggacagtccagagaccaggagctgctctcgggattcttatgtagaaaaaacaatgaaaagattcttaggtaggagggatgttaatgagcgcatgagccctgtccccacggagtttactgtctaagggaacacacaccagggctcaggccatctgaagcagacagtcatgagaagaccatgcacttgttttaccggcagaggccatggggtgtgtgttgttagagagtttatggatgagctttgaaggaccggaagagtttcagtaggcctaggtgagagtgagcatggtaaaaggagagaaggagggaaaggaacgtcaggctggaggaacagaaggccagaaaatccaggacctctgggaaacgagccgatgtctgcagagcctgtggtgcctgctgcgtgttgaggcctgaagtgggggagcctagaaggaatctgagggcagagggcagagggcctcaggagccacaccaaggggagccctggacaagcaggaggaggcgcttgaaggattctgaagagaggcaggtgtgctttgcttcggtttcagggtcatagcccattgcctgttcagtcccgttcttgtggctgcctctttcctgacccaagggatgcttaaagagcccacatattccaaagcatggaacgcccaacactgggtcagaacagaaatttggaacagaactttatctcattttatcaccatatttcatgataatcccccagatagccttcaagcagagttttttttagtctgctgtaagttaaaaaatgagtgtatatataataccactttgtgaggaaggaaatagaatgtctcaggttcaagaaatttggaagctcttatgaaaaatcatattttcatacggagagtgcagtgatcacacaacctcggagcactcagctcactccggggcagggtggcaggaacccacctggaggacttcccagctgtacctgaaggcaccatggctcacactggctgacctgtcctctcttcctctgttccccccagctctctggtggctgtgagctgacagtggtgatccatgacttcaccgcttgcaacagcaacgagctgaccatccgacggggccagaccgtggaagttctggagcggccgcatgacaagcctgactggtgtctggtgcggacaactgaccgctccccagcggcagaaggcctggtcccctgtggttcactgtgcatcgcccactccagaagtagcatggaaatggagggcatcttcaaccacaaaggtaggaatcagtggggcatgggtggcagacccctactggaagtggccctggagcgctctgtctccgcgcctctcctgcctgttaatgtgcatgagcttccttgtcagctgtgccttcagcacatggtcactgactgtccgggcatttccagtccatcagcacctgaagaggaaatgaggatttcacccacgactcagaaataatgagtgatctcctcacttccagggcggtgtagtgagatatgacatcagtttagagaagaacactgattttggaacattccagttgcttccttcctttatcatctgtgccttcttctgtgtgtcatgatacctcctggaggccatcccctggctccagagggttagtcattccagggagctaatgaagctgcaagagaaaacagctactgagtagttctcctgattaattataggccaagccatgttccggatttctcaggacctaaatgtgagtttactgtcacttcggtaagaaacaggaagaattaggctgttgtttctccagaaatctgaagagaaaggcagaggattttcagactttggccaaaagccaaaggtgtccacttccatttctggtgaagctgcccatgcatttggaacagcggtgggcttcccctcgtggtgtctttgcatttagagatctgagccatgctggcttttagcctgttgccagaatgctttgcattcagtatattcagttgcatcaatataagtccttgaatttgagttgaaaataaagtacaacttttcctgaaattagtctgttctgcagaggggccctggtgaacttaagcatgcctcaaataacacttgttctgaaggatttcttccgcatgtgcctttcctgtggtgtgttcttacttcctggtgtttgcaattgcaggctagccaaggcgaaagaactaggcattcatcacacttggcttcgtccggaaaacttctggtggaggttgggtttttgaatgttgctacgttgtaccattttgtttttccctatgatactctccgatattcttgtacctggaaagtcactctgcccctcacaaaccctctaatgccctatttttaccaagaaggtgtttcttaatgagcaagacctgctgtgaacttatgccagccagtggttaggggctcagaactgtatccatttttttcttttttcccttatttaattatttatttatttattttattttattttattttattttattttattttattttattttattttattttttcctgtaatgcaaggaaactcataagattgttcctggccaggcacggtgactcacgcctctaatcccagcactttgggaagctgaggtgggtggcttacctgaggtcaaaagttcggaccagcctgaccaacatggtgaaaccccgtctctactaaaaataggaaaaattagctgggtgtggcggcagacgcctgtaatcccagctactcgagaggctgaggcaggaaaatcgcttggacccaggaggcagaggttgtagggagcagagatcgcaccattgcactccagcctgggcaacagagcaagactccatctgaaaaaaaaaaaaaaaaagattgtttgttcccttgcagtgttaggagctgcgcagcaacagacagcaggtgtgggtcagaagtaacatggaaacggagggcgtcttcaaccacaaggataggaagcggtagggcgtgggtgaggtcctgaccatgtccacgtccaggaaaccaggcagcttgaccagaatctctgtctaggagacagaggccatcatcaaaaagtcgggcaacaagggatgaggatttagacgtggagtccaacaaaagacataggaactgcaggagcaggaggcctctgtcccctgggaagcagagacccaggcttgcctctgctcagccccacagtcctcccccttctcctgccctgtgtgtgaagaggggtgctgcccccacgactggaaagacattggcatgtgccggcctgcccatgccagccatccacatgcctctgcccgtccactctctccttttgagcctcttttcagtataagagctgttcaggcttgaaggatatgcagcgagcgagttaaacatggcccctctttgcacaccatggcatgcatcattctggcagctgggtaagaccccctccagtatcagatgttcaggctgccttgcctcaccctcgcttcagaactcagggacggtatggaactggctttacagatttgcctcttgttgcttgctattaaagttagtttcttatatgtctctgactcttactgctctgaccttctaggcaggaggaaggagcaccttcattcagttctagtgtctctacattttcacaacctcagtgcctcagtaattttttcataacaccctgatccaactttcacatttttatgtcaaatgtaaaaaacatgcctattaaggtcaaatgactatttatttgcttgcgaataataagctgttttaaggattgcaatgagtctaattactcagatcagccaagaagggtccaggatcatgatgagccgtgctcaggttcacgtggtggttttgaagctgggctagacttggaagtctgtcggacactgagaatccatggaatttatgaagaccagatttcttttatcggctatatatccttaaaatgatttgggagaggataaaaatacagcttattttaaatgaacaagaaattcaattacacaatttgtttttcaaggagataattttgtgtctgaaacaagactctgctgtgaacatcattccattgagaaatgctatcttgtggccaggtgcggtggcacacacctgtcatcacagctgctcaagaggctgaggtgggaggatcgcttgaggccagcattttaaaaccagcctgggtatcatagcaagacccagtctctttaaaaaatgccatctgttttgtggacgaagtttgctttggaagcttgcatgtcccggtgtcctttgggccggccagccttcgtgtctgatggcgccttctgctcttgctctggctgtccttcctccgtctcagcatcttggtcatgaattaaacagacgccgggcatagcaggattgaataagggttcagcaaacccttgtgctccagcagtcttatttgtgtttgtcgtttatgctgtctgccgttacctcagaggctctggggctggggcctaggcctggaggctgtgtctgtgcccccagcgagtctcttctgcattctgggctgaggcccactcacctcccttcactctcttccactcgagtgtgtagtacgtgggctcactgttgaaatcggtgtcacgtcaccattgttgatggctcagtaaatccaagttctctttccttcccattgtctcaacttgtaaaacttgtcacttttatgtatttattgacagtcttggtcacaggaagtaaacagaaatgtcaagaatgtgtatatttccagtgaggccagttcaaaacatcctctttgccctacgctgccctgcttttttcaccttttccctttcttcccaaccaagagtcgccctacacaatggtccctggggatttagctccagtgtgatcggaaggaaaagtagccaggaaaaagcaaaatagtgttgtcacaaacctgggcaaatgagcgtctctcactctctgccggatgcatttctggagtgcctggcatgaatctttttgactgatagtgttttgagggtgggacaggagttcataccctgtcctggggagggccttccgtcaccctccccactcaggacatctggaaaaccaccccagggcctgtgtcccgcactactgctgcccagagcctttgccattcgaagttgaatctggaaggcccctctcagaccccatggaatttttttttttttttttttttttgctgaaataaggctttaaccaggagtttgagactacagtgagctatgatcaaaccactgcactccagcctggacaacagagtgagacctcatctctaaaaaataaataaataaataaaatgaaatgggctttaagaagagaccttttggtggcaagggaggagtgagtggtgagcttggaggatgcgttcttcctgtcaggaggcctgagatggggcgggcgcaggaggcctcccagggtcttgccagctctgacattctgagttcagagttcttagaaggctttatgagcaaaggccgattcaaaactgccgtttccttacaccaacccatcatgtgatgacaggtggcctttttgcttgtgctttcaaatatgtctagaagaaaacacccacttataaaaattaacctttaccactctaaaaggcattcacaattttaaagttttttctcctttggatagagaaaaagtatggttcagtacctgcattttatttcgaagaagttcagagtatgagtcatctgcagtgaatgagaaaattaaagggaaaaaaaacatgagaaataaaaccttttgcttgtgggtgacttgagcctctaaacccaggggctttaactcaggatgctacgttttactatggtaaaatctgtgccaaaaacagtcccccatagtttaccacaactccagtgggcactaccaagatcagctctcaggcttgaccagactggctgcagtagttaagagaagacgcagggactgtctttcgtaagtgtagtgatacatgattgctattaatcaaatggggcatttttttctaactcaagttaaaaatgagaaagagacatattttcattcggaactgtccgaaatgttgacttttctgtgggtccaccctgcttttctccaagctctccttgcttctctccaagctctctcccaagggttttcttgtccacccgaatagtttacttttccacttgactgtcttagcaactttttcaaatctgaagtattcagattccctctcccaccatctccccacttgttcacccaagaacatggctaacgcacgtgagggtctctccactgcccaccacagtttttaaaaactggtaaactccacataacaaaatgtatcatcttaaccattcttaagtctacagatcagtggcattaagtaccttcacattgttatgcagccgtcattaccattcacatctagaattcttttttccgtcttacagaactgaacctctgtgcccatggaacaaaaccctccgctctctcctcccagcccctggcactgcccctttcctttctgtctccatgagtttgactgttgtaggtgcctcatgtgagtagaaagtcatgtagtcttgtccttttgggactgtttatttcttgtagaagattccgtgttctgacttttgtcagaatttcctttctttttaaggctgaatagcatccccttgtatgcagatgccacattgagttcaacattcatctgctgatgggcacttgggttgcttctgccttttgactcttgtgaataatgctgctatgaacatggatgtacaagtaatctcttcaagtccctcctttcagtccttctgggtgtatacccagaaatgcaattgatggatcatatggtactgttgtctgaatgtttgcgtccttccaaaatccgtatgttgaaatctaaccgccaatgtgatggtattaagaggtggactgttgggtggtaattagatcatgagggcagagcccttgagaatgggattactacccttacaaaagaggcccagggagcccttttgtccttccgccatgtgagggcacagaaggcaccgtctttgaggagcaggccctctttaaatactaactctgccagcgcctggatctcagacttcccagcctcgaaaactgtcagcaataaatttctgtgctttataagttatccagtttaaggtattttattatagcagcaggaatggactaagacatatggtagttctacttttaattttttgaggctgcccactcagttttgttaactttatctcaataatatatttcaagtatgttctcttttcatttctaccgttactcgtatcacctgatcacctgacctcacttcttgccctttttcgtttcacctaaaacataaatgttaccatactctcttgcttaaatttctttggcgactttctcttggtcagagaataaaattcagcttcctcacatgtccaacaagacctttcgtctcatagacgcacatgtacacacacatgtgcacacacacgcacacctatacaccttctcttggagctgtacatcaggtaacataggggcttttttccctctcactcacccctacctaatagtccccgtctcatttcatcaaatacaaatacaaatcctcatgggaaaaataaatgtattcagtgagctcatggaagggaggagagagcagaataaatcttggtctagttagcaagtatttccacacagaggctcccatcaggtcagctgaaaagtccagttagatgaactccaaggaacgctgaagacccacaaggaactgtccaggaactcactgaaagcaccttaaacagattgtaacaggaatgatgattgcagatacactgttgaacttaaaaatgggatagaggaactgcagacaacacaggtgttttaaaccgtaggctcggtagagaaagcagcgagtctccgcagatggccggcactgagagccagcaagaagcggaggagatgggccttcagcagggggttgcggggggagctttaaactgagccctgtaaacatggcagaactgctcagtgggagactctcagcacagacggtcatggggaagtgagtgcagttcatttgtaatcttgttgtcgagttctgggttttttttgtttgtttcgtaactttaaaggtatgcactttatatagatttatttatttgctgggaccgttactcagagttcctagaaatgtacacagcttttttaccagggttactcctcagaatcacttgtcacttctttaaatgaatgaatgaatgtgccaggccctatgcctggaggttgggagcttcatctacatcacattctaacaggtgaccactggggtaagcactgtgtgactgcaaagccagggtgtgtttccatcaacacccagatgaccgtgcctatgtgcccctgttgtcctccctccaggactgcctcctcaccccacccctttctgcagctcctcatctaaacatctcgcctggtgaggtcacggcttagcctgttggccagtggccccaccaccatccttccccctgtgcagattggaggaggccaggtctctccccttagctcctatgtccccttcaccccccatggcacagatgagacattcacagagtttgcagatgatggaagagaagactccaggttgccaggtgtgtccactctcaggaacccccagcccaagcctcactgctcgtgttcccagccaaccccagcacgggggatacgccggtgctgtttccctgctcagaatacaaccagttaccagaaacgacctcacccctccaaccactttccaaggtgccaggacagagaagcccttcactggcccacccagggcagttgacagagggatgccctccttggaggggagcctcacctctacccacagggccgcggccttgtcctggattctcaccggggcagtcacgtcaggatggagaggtcccatgtcagccagttctttggtgggggtcatgtagtctgaaatgacctgccgatggtccaggctgagccagggaagccgagcctgggtgcctttttggtgcctactctgacttgagttggattcatgccacagacccaccttcttgagcaacaacacatatagccaccaacacaagagccagccacacactgagcagagaaagtccctgtcgcctcaccacccaaaaactccagctttgcagagaccaaggttcttctctacctttgcagaagcctctgtgaccaaacccggagcttgcccttctgaggcctctagcatttctccaggtgtttttcagaggacttggtttaaatttgttcaccccaaatgtggtctttcccggatcatgaaaggatctgccgcaaaggtgaatctgagtctcctcagagtcatatgagactgaaactgcttataacatttccgtgacctaataagtcttccaaaaatgtagggtattaagagtttagtgacattaaaaagtttagtcgaaaatatcgtgattcaggtatatttagacatttgattcatgccaaattgccactgttatcagaaaacacaccccaagcacattaatgcctagatatttcaaacccttttctgcccacacattcttaaaaataatatactgagaaatctatatacaggtttttttttaattagcttggaaaagagcagttgtattctgtttgaacagctgctaatgtcaattcctgtgggaagaaagaccaaagaacatggagttacaccaagaattttaaaacaaagacgctgtccctttcctgagcaccgtgcagccaagactgagagatcagtctgagacctgtgattaaggagtgttttctacatagcgtataattatggagccacacaagtgggccattactctgttgagtgcttcatgtttgaggtattttcgtgttccaactttacattaaagtgtttattaaaacaggaaaaatccacgagcaggtattgacactatccatattagatcatcacaaaattatatatatagcagagtcataaacaatgagaaacggtcttcccacacttgctttaaatggccatgacctagtgtttagggaaagcagtaaaatcagcgaggagctcgtgggaaaaatgagacgggccctgagggggtgactcatgggccaagcagggccacacaggtaccaggccgccacgtcctctcctgcctctcactctctggagactggacttcctttactgcctcctttctgacatttcctagacatcagactttgctacttagtacacaaacggggttcccttttaaatttgttcactctagttagcatttgcagaagctgtgaaaaattacagagagatgatgtgttgggtaagagatggtttaaaagtccagcttgctgtttttcattaagtgtcttgaaaatgagtaagtggcgttcctggaggggaacaatcatataattccgcagggtgggtctaaacttgttttctgatagtgtttagcagctcatggctctgagggcacctgataacacagcagccaggcgctgatgagaagtgtgtgccagacagacccgagtgtggcttggctcttgccttatgttcctttctctgttcagagaagcgtgagatgagattttgtgattatattgtactccttgggctgactttcccatgcacagaatgttttacacatcctgatagctgagctgaaaatgcaaagagaagggaaaatgccttaaattgttctggctaatttagaagcagcaggccttggaagtctttgtcctgtgtccctgaacaaatcttatgggagctctggtacctatgccagaaaatgcacataggcacaacacttttacatacacgttcacacaccccacccatatggagaacttttttctaaataagagaaagaaaaattttaagacttacaagttatgtttaggtattttacatggttcagaaaacaagacatgaagcggtataaactgagaagtcttgttcccacaaccccacgtgccaggtacacataaccatttttattcacctctagcttgtgcttccaatgtttgttaggcatatgtaaataagtgaatagataagcatttctccctccttttgctgacatgagtggtggcatgttttgctcctggcttttatcccttgaccccattccagtacctagagacctgcttcatttttttagatgtgtaatacttcatgtgtgcgtgtgccttagtgattaactcgtgcactgtgcagggacatcgggctgggatcagtttgttcactgatatatacagcgctgcgggagataccctcacatgtgtatcatttggtccatgtgcaggtgtgtctggaagatagaattctaggcgtagaattgataggttaaatgtatttatagggaaaaaatcaatataaaactttgcgtgtaatgatatttgcgtgcttttttttttaatttttttacccaaatagcaaaaaaaaaaaaaaaaaaattgtcctttttgaatgggcctctttaaatccattcatataaattatatcttgagtctctgtgtgacctgtctgggaggtgaggtttggatggatgttttcccacagaattacaagagcatgcaatgaaatatttatgtaaatcatctttcatcaacatttttgcgcttttattttagggattctccacataacaaataaatggcagtgatttccaaagagcaagtaacttcccttccctcagtatgtatataaaatagctttcatggtgccccatacgccttccatccttgcaaagttcttcgtgaatccaagctatgcagttgcaagagatacattcacaaggctgggctgttgatggctctcctagtgggccttggagtctctgtataatctccgctctttctgaaggattcagtttcttaccacaaacatttcacagtgaatttcgttttattttattttattttattttattttattttatttatttatttactgagacagagtcttgctctgtcacccaggctggagtgcagtggcatgatcccggctcaccgcaatctccgcctcccgagttcaagggattctcctgcctcagcctcccgagtagctgggacctcaggcacccgccaccctgactaatttttatattttaaatggaggcggagtttcactatgttggccaggcgggtcttgaactcctgacctcaggtgatccgccttcctcgacttcccaaagtgctgggattacaggcatgagccactgcgcctggcctgaattttgaataagacagtttttaaagctctcccaaatctaacttccttccttcctgacactgtggaagagttttgaaggggacagaaaaaggcatgggggtaggaggctaccctttgagctcttgcccctgtggccacctctcccaggagaacatcctcacgcccctttctggggttctgtgtggctcatgctgggctggctgcctggggcttctgagacgtgttcagggtctgccctgcttcatcgtggtctgaccagcagtggctggaacacctcagacttcaggcaattggtcattccacatcacagactattcagggggcatcatcttcccgaaacctttctagccaaacgtaggacagggcccccaaagtgtttattatttgaaggtcctttcaaacattcgagaggacagtaaacaggctcgtttgccttggctgcattgcacggcggctctggaattctttattatttttgtcaagaaatgaagccctgtgtgttcaatctcatctattctctccccaaccccttttcaggagtctgtagaatttgaatgctagaggggaagaatattaaagttctgttcttagatatagatgtgtttcctactgtctcaaaaacatttagatcatttcagtcctgtatcatggagaagattattaacagaagggggagaagggtgtattcatctgctggctgccatagcaaaatcccagagcctgggggattaaacaacagacatttattctctcacagttctgcaagccagaagaagtctagaaggagtcagcagggtcggcttcctctggggcctctgtccttggcttgcagatggccaccctcttgctgattctccatatagctgtctatctccctatttccttttctgtaagaacaccagtcaggttggatcagcacccaccctaagagcctcattttaatttaatcacctccttaaaagaccttgtttccaaatacagtcacattctgagatactggggatttgaacttcaacatggattttagggggacacacttcagcccatagcaagggggccattggagccttaagaaattaacagtagtaacagagagcatggggtgcggacttgccattgccagccacagtgctgttctctatgttccaccctcaagataccctcatgacaacgtagacatacaccattatcatccccattttagggtaggaaaagggaagcacagaaaaatcacgtaaccaaacatagcaggggacgtaaagtgagattttcaaagcagcagtcagacttaagatagccactgtacatactgctgtctgtgcacgttggaagaaacctttggtgcagggaggaagctgaagcccgtagagacaaactcagttgcccaaggccagacatcgtttatggaagagctaattctagaacctggtgtcctaagttcgctgcactctggctttgcccattcttgagaggccatgggccctccaacatttcgtctctatgaaaaagatcaagtttcagatttccagtttgaattgtgatctaataattccaaatgcattccactgcccagagaagtcatcttaatggaaatctttttttcatctttgggggccagatttctcctcttcctactcccctagttgattacagaactttactcacaatgagcatgttatgtatgagtgaataaatggaaaaagcaatcacaaaggaaaagccattttttctttatcagtttgcatccaggagtaaaagatttttgccccaaaactattattctgccccctttcctaaatcaaaatcagctgcttgttctcctttgctcttccttaaaggagctgaagaattcaacttcctgtcagctccccgccaccatcaaccctgtgaattttagccctatatctctcattctctgaagtttaagagaaatgggacatcaaaagcacatgttggcagtcaagagttagctacatggctcttaattttttgagcactgttgtttttgttacttttttgagaaacacgatttgtgaggttaccatatcacgttgcagttctgtaaataatccacaatgctggtgcaaacagagaatgtcacatagttaaagtgaaatgtaaaaaaggagtatttgaatgtttggtttgttaaagaaagagaaaaactcacatagtttgtgaaaagatagtaaataaagcaatgaaaaggagcctatcgaattcttggcacccacatgaagagtttgaatgcctccataaaggtgcttttgtggattggcaactgtgctagaaagcagcaggaactcctgtgctgaatggagccctaagaagcaggggtttcgtcatccctttccctccagagcaggaggtattatctatggggtaaagaaaccggagaaaacttcctctgaacaggagtatctttgtgcatggaacctgagagactcaatcctggtggtgcagctgtgcttgaagccagcactgtggacatattgtgcagagcggaaacgcatggggaagaaaacaagggccagggaggtggcgaaaggaaaacagtccagaattactactttaaaaaaatggtatgacatttcaggggcccagcatcctcagctgcagagctgtgtgctccttttaataattggggtttgaggactgacttcaaggtagaatactgaaattttatcagtattaatcaagtctcagaaaacactcctgatttttagaggaaattataatattcctaatcattatatcattcaagatctaatctcagaattcagctaatgttgttttatatatccagtattttgattttgattttaaggatcttttcattctatattaattgcttaattataaatatatgtttactcaaaaagcatcataatttcaatagaaagacttcaggtcctttggctcatcttaattttagccttaagtatatttctagtcttcatttttaaagcaccatttgtatattgatcctttttactgcttttgttttagactccttttggcagaaattacttgtctcattttttatgggcagattaataacagacacttgaaattgaagtccaaattttaaatatttgagaaataattgttacaagagaaggctacataaaaagtaaatttcgtgggcattaactttgaccatgaccatatgagctgcttttcaactaatctaaataaaaatactttaattttcacgaaaataagattgactattgtaattttgttcattcttttgtcccacaaaagtatgtggaaaaatacattttgtattgtgttccttcagtacatttttttcgataatcataaacccctttatttacagatctttaatttgtctgatacgtttctttttctacaaagatcttctctgactttacctacttttttctggtaactttttcatactctcagtttctttagctatttgcatttaaataacacaacactcagttttttttttatttttaaaaacaattatgaaataattttggacctacagaaaagtgacaaaaatagttcagagaatttctgtacaccctgtacccagctcccccaatagtaacatctcacatacggtgatgaaaatcgggcatgaacccgaatgcagtgctcttaactaagccctgggccttatcctggattttgctttcatgtcctctctctggcttaatagtcaattaagaatccacattgtatttatttaggttgatgcaaaagtaattgcagtttttgccatttcagtggcaaaaggcacaattacttttgcaccgacttaataatttcccccaatctgtagcagctcttcagtcttttttcttcttcatgaccttgacaattttaaggcatactggtcctttctgtcataagatgcctcccaatttgagtttatctaatagtaaataaagcagtgttttctcttaaatttagctcatgcatgttgggcaagaacagcactgatgctattgtgcccttctccgtgcatcacgtcaggggtacagggtatcctgagacgtctccctgtcggtgtgtggaccttggtcacctggctaaagtagtgtcgcaggacttttccttagttcagctaaagacagggtcctcatccatcccatggccacgaaaatttaggcttgcagatggtttgaaggctgagtacagcagggttttattgggtgaaaagggaaaaaaagggggaaagaaggatcctccacgaggccggactccctgctagagcacccgcagtttgaatcccaggttccacacaggaagaggagaagctgagctcctccccgctgcaaagggtgcagacttcccgaggctccaccacaatgtgcaggctggttggagtgtttccagggaccccctttcacctcactgtctcagtagcatctgcagcatttcccccactgtaaagttactgtttttctctttgtaattaataaataccttgtggggaaatatttttgaactgtgcaatactctgtttctcatcctacctttaccctctaattttggcatccctcagtagttcttgcctacaacactatagtgcttacctaatggtatttcatagtttcctcattccttctgaatttatcagttggaattcttctataagagctgtccctctgccattctttacttatatcagttggagtcgtggatacttattgtgtggatcataacccagtgctgtcattgttttcttcttagattgttccagctgtggctatcaggagccctgtctgtgaacttctgacgtgctcccaacttgttttagagcactcctttactttctggcactataggatgtaccaggctcatattgtattttgcctgccacagtcctggagtcagccatttctccaagaagccctcctggtccgttttgttggagaatggtcttagaaactaaggtttgggtgctaggtatgctcattgctgtgtgttgccatggcttcaggccctcttagcagatgtgtgtgtaccaacccatgcatacataaacatctgtattttctgtttcccctcctccatcctcccctgcccccatctccgtctcttcttgtattcatctgttttcacactgctgagactaggcaatttacaaaagaaagaggtttattggacttacagttccatgtgactggggaggcgtcacaatcttgatggaaggcaaggaggaacaagtcacatcttacatggatggcagcaggcaaagcaagagagagcttgtgtaggggaactcctctttgtaaaaccgtcaggtcttatgagacttattcactgtcacaagtacagcacgggaaaaacttgcccccatgattcaattacttcccaccaggtccctcccacaacacgtgggaattcaagatgagatttgggtggggacacagccaaaccgtatcattccacccctggtccctcccaaatctcatgtcatcacctttcaaaagcaatcatactttccaaacagtcccccaaagtcttatttcagcaataactcaaaagtccacagtcaaaagtctcatccaaaacaaggcaagtcccttccacctatgagcctgtaaaatcaaaagcaggttagttacttcctagatacgatgggggtatagatattgggtaaatacagccattccaaatggaagaaattggccaaaacaaaggggctacagaccccatgcaagtctgaaatccagcagagcagtcaaatcttaaaactcagaaatgatctcctttgactccatgtctcacatccaggtcacgctgataggtgggttcccatggtcttggacagctctgcctctgtggcttggcagggcaaagcctccctcctggttgctttcacggactggcattgtttgcagcttttccaggctcacggtgcaagctgtgtcagtgggtctgccattctgcgggtctggagggtggtggccctcttctcacagctccactaggctcctgtatgtgtgtgtatgactttacatcatactgaagtgtctgcaatctatcaacaaaggctttattctaaccttcttcctttcctcatttgtaacctctttctttgatagtaagacacttggatttcattctctggaatgtgattatttgttccatcctattctaaaagttctttttttccctctcctgtttggatattgaattttttactaattatgactgtgagactcagctccacccattctcactatagtagtttcagaattgctaacccatactcatggaagaaacttacagattttttttcctttggttttacagtatacaatcaaaaagctgtttttcaaagttaggttagttgttttcttccccacccacctcggggtgatgttgttcagctgggttcattggtttctgcgtatttatattccatttggagtatagtacccctcacacactcatgccctgatgagctgtgcctggggcagctgtaacaaagtaccacacactgcctggttcaaacaacagaaatttattttctggagactgagagttagagatcagggtgtcagcagagtaggtttctcctgaggcctctcttcttggcttgcagaggcaagaactttcttctgtgcatgtctgtgccctcatctcctcttcccgtgaggacaccaggcatattggatgaggaccaccccccccgccccaaggacctcattttaactctttcacctctttaaatttccgcctcaaagcacagtcgcattccaaggtccagggcttgggacatcagcataggaattggggaatacacagttcagcccgtaatcccaccatcctggtagattgtaatgatttggtttggggcgatgtgaaatatggccatgatgttaagagtcagtgcccaatttgcttgacatagatatcacccttttgttccttcccagcatctctagctttggtcctcagagacaaacgttatgtccttaaagcagcactatcttgatggatcttctgttctctctgtgacattttaaattgtgtgtccagccatcaaagtaaaatgtcaaaaattatcaaaaataccaaaaaacagaagttcttgttttccttcacaaactccgttaaatttctacattacacgtgttctcttccgccaagtgcctgtgacgtttgtctctgacccaccccattcgctccattttcacatctctctcctttctttgcaaaattcaactccatctgcactaaacctgtctcactgtttcattccttttcgaggtcctgttcattgacaattcaggcttctgacatcatttcctgaccccctttacttacttgctaatgttctcacacggcagatagactcattcagcagatcaaatgaggtttaagactcaaagctttaacctcattgtcccctttctcaagcctttcagtagcttccagtttcctttctggttacatcacattgtcgcttctgtaatttgttcccagttaaccaagtcacccacctgttttcacctccttctccttcccaccctcacggccatggttttgaaccagggtttcttcccacggtctgttgaggtcactaacccctgtgtcgtcttctcctgaaccgagtctgttcagattctcagaccagatccctggccatgccaccatggtagaaataggccttggcgtcaaaacttatttccagggaaattttgccagtgatttggacttccttcctttccttttgcctcgcctcctctcccatcggtcatttactcacctccgcatttccgctggttccgcgtttctgtctagtggctcaggttgtcgcccttcagggcatgcctttaattgagataatttctctttacttactgtataaaatgccctgtcccatctgacacgctctgcagtctctcacctacatgactggaaggagggaggggacccagaaggcgtcttccttcctcactccctcatctgtgcgatgctacacctctgacagatgtgaacttgagggtttttttttgtttttgtttgtttgtttgagatggagtctgtcacctaggctagagtgcaatggcacaatctcagctcactgcatcctccacctcctgggttcaagcgattctcctgcctcagcctcctgagtagctgggattataagcatgtgccgtcatgcctagctaatttttgtatttttaatagagatggggtttcaccatgttggccaggctagtctcgaactcctgacctcatgatccacctgcctcagcctcccaaagtgttgggattacaggcatgagccaccgcgcctggcccaaacttgagatttgaagtgatcagtccctagggaaatttcccatacatctttagccaaaattattgtactcatttttaagcttaatcctcttttctttcatagagaacttatattacacataaagtaattaaattccctgacagctcttttttagtttttaaattaatggcccatgttggcagtccgtattttggaaagggacaaagtcaactttttaataacggttgtagtaactgaaaccttagaatgtcaattaacttgatttcctttaggtcataatttttagtgctttttgctaacaaaagaggaggttatttatttggcaataaagttgtcttctcttacataaaatgtgctctgtgcagaactctgcctctcgctgggtcctggcataagtacaccatctggatctatcacgggaccgtttaaagggaaaaacaaccttacgctttgcttttggtgttttaagaagaatatgaagcctaacgtgggcccataaatgccagactcccctctgcagcagttggtgagagagccgttggagcgcctgagacagttttctctgggtgccctggatatagcatcttgatttttatagtagttaattgtcttaaactcagaaagaaactagaagtctgtgctgttttcacgttctttttcctttgaggattttaaaattttattatgcaacaaatgtggaggtggggacaaaaccaaaattttaacttttttttaactgaggaagtaaaaaaaggcaacattcttcttagcaaagccataaaaaacagcacaaataaaattgtttatactgtcaagttagataaagcagacatgagaaaaattattaatataaagaattcaagatagtacatgttttcttaaggttcaacaaagaacacttcctcaaagaaattgtaagcagctcagagccacactacaggttgagatatgtggcgaatattccaggtgacttttcgtcagaccaaggcaagggcatccaggtctagtgtggagggcaccgaggaacaggggagcgcacacacaccacagaagctggaagtcagacccgacagttcccacgcagtggacattctcctctgaagccattgtgtggtgtgggacaagggagcgaacatatggaaactttcaaagagagagtaagaatgtttctccgctaaggaaaagatccaatttccaaggaagacaagaaagaacttctaagatacgctttcctaaaaactccttatagttcgcatgcaagaatttacattttcagttctctggctgcttcctgtgaggaagaatgaagatatgtttttaataagtgaggagcggcattacagcacagtgatgtaaccagttggctattaggccgcattacatttctttttttttatcaagtcacatcaggaggtgctgtttggtgtgtgagtctcagggcggacctccctccagatgtacacaaagcccaagtcagggaagccattcagaacggcctgcgtggggagggcaactgtcacttcacatttcactgagtaaggaaattgcagctctggctagtgcaggcggggagagacatctggtttccagggtgcctgaagaatttccttgagctccaattagagtcagtgtggtagaatgaaatccaccgcgtctgggtattcccacttgtgaaacccaactgcagcgcgcgcgcgcgcgctcagacgccagcgagggagaggcgcgcgctgggccgggccgtgggctggcgccggccgctgagcaacacgctgccagtctgtgtgcctgtccctgtcgcgtcccagtctgtgtctgagtgtctgtttagctggtcgctgcttttgctgccaagcgggtggctctagctgctgtggagggagaggtaggataggggttctgcacctttagcctccagtcggctccagtcaccatgcccaacggattgaagccagtggacacgctggactcgctgtcctctgtcagttcagcctactgcagcggcgggcagccgggcacctgcaagtactggatcctcgacctaggtacacaagctctctgcagatgctcgggctggcgctgctttctctctgcctgctttctttccagtggctgcgcagtgattgacatgtgctttaaaacagaaatgttttgtgcttggaacctgaaacgtgttccgtggtgaccaccttgggagggggctgtgtctgggagatggtttatgggggggccactgggaatgtgaggagcaactgggaacagagcactgcacatccattgtgtgttgtaagacctttttaatatctggggactgctttttattatccctttttcttataaatggcatgtaaagagtgtaaagtaatctgtgctacaaattgccttatgattttagttggctttatgtctgtttcaggtttaattttgtttggaggttttcagactagagaaaacaacatgtcctaacatatttagactctggctctccatgagaactacagccatatgataagataatacaaagttagctggggagagggatgcttccaacgttgccattgtattcaagggagtgtctgtgccagattctggctttatctgcggaactagggaaaagacgtgaagatgtgattcctgcaaaggttatttgagaggtcggtaagcttcactttgaggaaaaggcaacaggatacaaaagagacaaggtgaggggagttgggtctgcagatgcccatggaatgctgccctgttccagaggccagctttgtttcagtaacctttgacagctctctgtccagaccatacagccgaaaaaaggagtctctcacagggtgccacctgcatgccagcaggaatgctctctaccagaatttgggtcttggcctgggtcactttcagtgtttgccttcactttcttgtcagccgttatccgcgtatatgcttcggaagtgggcggcaagacgcagagagccaaggggatttgctgagacttaacggggcacttccagttcattaagagctctatggagaagggtctttcggggtgcagggatcccccaaagaaagggggtagggtgtcggatcaaaaggggggcacagaaaatatgtattgggcatctgaaggggaagtggcgctgcttaactctacccatttgttcatggaatactaggaggtaagagttggctgcgtgaatgttgcatgtgtggttctcaacatcattttcaataatactccttgtatttttgttcacaaaacctttaaaaagtctttgaccctgggctctttttgtcatatttatgctaattgttttaccactcgaagatggtgacctccctgtctgcaggtgtgcaagctgggtaggtccctcggggaccctgtgcgctaggaattcctgcactgggtgggttaaagtagatgatgcatctgctctcctaatttaatgtagtaatttctgtgcagtgcaaagaacaactggtcacatgaaaagtctgatttgatgcctcagccgctagctagctctgaatcttgagtaaattaccttctctctctgaacttctctttctttgtctgcaaagtgggagtaacaatagagcacgcccctcaggatatcataaacatccccaaagtttagaacaaaatattttaatgaacaatttttctaaagagtaatggatcttaagacatagcattctttctgtagagggaatttttgaatcttagtggtatcttaattccttcagaattcttctcaagggacattattaaattcgctttttaaagtactagaggataattgtgctgttacattttttgtttctctctatatatttttgttggtaattcttaaactattaagaagctctaggtggtgttcttcaagctgtcacctcagaatttttaagctaggaaaaattcgtaagaaaaattgatgacccgtgtggaatttcctgaacaaaaaatgatcacttcaccataaaggatagataagaaaaagcgaaattcgtgcatatgcgtgtgtgtgtagaaagtgcctgcccatccttttctaacgcttatagtaatttcaagacaatttcctgaatgctgttatatcagagtgatgttttaatattctgattttacctattaaattgattatggggaaatacatatgcatcacattttaaaaggaagaatgattctgggtaatatccaagaaataaatcccaaagtaactttacagtgcccatgaaatcactgagtgtgattgcaaagcccgtcttacacctgcaagcagtctggggcttcatgtgttagagtactttgggaaaaggcagttttcctgcttcctgaagttcattggggcatccccctgtccaaatgtgaaccagtcttgcttggagtaatctgcacagaagcctgttttatgtgctgacattgccattgtcaataacttacacagacatgagccaggagagttttactgctaagcgattgttaagaaaataagagaaggtaaggtcaagaagaactgtaaatcttcttttatgacgtttccaatgggagagcctagttctacggataagagagtggaactattgggttggttatcattctgaaatcagtattcccttttataggacagatggaatctattccagtgctatacgtattcccctgactcaagctcaggaaaaacataatctggtgactctccttaacactgaacagactcttacacaaagtgaactgtgtgctttataattcttgaattctcttgaagtcttttttttttttttctttctgtttgggttaggaatatggattctcaccactgcaatttttgtttttataaattaaagggaaacattccaaagactaaatataggataaagaaatttctttgctgaagaaatacataatatgaacctattctgaaagtatccaagtggatgaacagtactgcctcaaattaaagctgtcagtacatggaatattcagtttcacatgaataaacaaaaaccacagaagtacttgtcacaatgttggattgtttcgactgtgaagactgattgtgtcacacaagttgctgtgcaaactaaattctatctcaaatcgttttttgccctttaagtatctttaagtgaatggtttaagacaggatgtgcagtataggatagtgggaatggtgtgttgctgtagaagccagtttgtccctgctcacccctacctgtgtgatcttataagttcttgataatctcgctgagctgcagtttcctcatgtgtttaaaacaaacaaacaaaagaagatagagaatgctcgctattatggttattatgctctccaaaatctacattgaaggttctatttcattttaagcaaactgcattttaaaaataattttgttcccttgcttccatgttaaacacgaaaaaagagtgttacacattgaatttgtatatatttttagccaagaagcaaagaaacttgaagttatttggtattatagccttttttagagtgaatataaaatcttgaaatattagaatgtttttgaagttaatattaaaattagactgaaacctcccccaaaaagtgcccaagaaacccacaggtcccaggttaggagccttcaggcaaagtggcttttcctagttttggaattcttttcttatttctagacaaggagcaggcaccctcctcgtttaactgtaatctgtctttggtatgtgctctttctaagtatatctcttcactagattttgggggaacacaaatttatagtttttcattctgaaaaatttcctccaggtgctcaaagttggcctcagggacacgtgagcaagtccataaacagagtgagtcggcctgggagctgggtaacaagccatggaattcatccatggagtcttcctcatttcctcttcctgtctccaaggagtggcagtgggggctgggcagccataaagatgctcctattaattttttgcaattctcatataaaaccatacaaatatgagcaaaccacataccccccgccaaatatctagtttctctgaaactatatgtgctaagtggaaaactcccagacagagcgagcagcagaagggaacatagcacccttaggcagccactaatcacgttggacacatcttctagtctgtttatatgtaaaatgatgcttcttttgttgatacttttaatatttgactataagaaaccatctcaatcatatccattgtccagtttctcagatgcgcagttgagaaaccttgctattgctacttcttgttaaaatcaacaattccttctgtagtgaaatggacctgtacctatcagcatgagaagactagaattattcttctgtctaaggatacagcctttgaaaaacttctgagacaaaatatattagccctaaggcaacttccccttcctcttttatccttgaaagctgatggattatggtaagaagtggcccaagggcacagaagcaggcgtgcagttgagtaaggaactcttccataataaaaaggggatgtgcttattatgacataggaactgaacatggaatgtttttccctttgtctctctccagttaaaaagaaagacagcacagtgcccaccacaggcactctgagccccagccccacgcaggggcggtctgcttatttcccactgtcgcctccggtctgtggccgtgcctttcatcacaccacgggcactgattcagccaaggacaagatccgtgctgttaattggtgttcttagcagaggcgttcctttcattccctttgtctccatctccgcgcttgctttgttcctgcctggaataactccagccctccctccctccctcgctcccttcctctatcctcactgtgatcactccgaggcttgacaggcagggaagagttcctcacaggaagacttaacaacaggaaggtgcgggacattcttagaaagccgccttctccccaggcactggcagcactggagagacagcgtttgaaccccatgtgggatacatggagaactccaaaagcagttgctccagccctcttttctttttgtctttggcctttattgttgtggtggttttagtatgtgataacccaaaaaagtgggagacagctctcaataaatgacaaaatggtgatttgaaaaataaaatgcagtgccattcagtgcatgtgggtgggcagggggaagagagggggacaagatgtcataaaatcaaattagttcaggtcttggtgttgcatcccgtaatgctttgtgtgcttgggagtagatggtacctgtggggtgcatgcacctgggggcgctttacctcctccagtctgtgcgacatgtcttcatcctgtttccaagtgcttattagctttagttgagcagcattttccttttgatgggggagttactcaaatataattgtaaaaggaattcctaattggttacagcttttgtttctttgtttttgaattaaccagggactgtataatataatgtactagatatttgctttgtggtttattggggggaaataatcttctggttcctcattctacatagctgtagctctttctaagctaatattccatcccttgaaactctgaaactttagctaacctttgctgtagacagtgtaaagtggctgggcgtggtggctcacacctgtaatcccaatactttgggaggccgaggtgggcagatcacttgaggccaggagttcaagaccaggctggccaacatggtgaaaacctgtctctactaaaatacaaaaatattagtcgggtgtggtggcgggcacctataattccagctgctcgggaggctaaggcaggagaatcacttgaacccaggaggcggaggtcacagtgagccaagatcaagccactgcactccagcctgggtgacacagcgagactgtcccataaataaataaataaagagaaatagtagttggcaggctgattgcagaatactccaaagccacgttttttccccttaatgctgttattaaaattagtatgttgtcatgtggctctgtgaaaacatgtataagttagcatggtttatagtaaattttcttgaatgtaggtaaaagatgtttccatgctagcattctgaatctggtataaattttttaaaataataataaatgtatacatgaatgaagagaaatcattcacctcctgaaataaatcagtcatatagtttaaaccactaattgcacaatttttaaaaccgttttgcctgggagagtctttttgtgccacctgcttcatttaaagacatgtttcaactttttaaaaaatctgcgtatagccccctgcccccaacgtctttggtatcctctttaacaaagcagccaaagtgatttcattttttttcaacaaatcataggaagacattagccaaaaataaatattcattatgaagaatacacttccatatgccttcttcatgtaagattagatctttcatttctaacactctgtgtttaatgtcaagaactattatgcccatgggttcaacattcatgtttcttaactgggtgagcacctctggaaggcagactcagatggacagaagggtgtgtgagcaccgtgggactgcttatttcccccagaattaactttctgtttccttacatgatggttgtctattcaggacaataataagtactttattgccttgggaataacttcccatatagagaaattaagaatcaagaacccattattttataacagggagaacttcggtatccctcagtcagcagtacacaaaataatagtctcatacgcatgctgaatttgttttgttttgttttgtttttaataatctttctttgtatgagtaatacgaatcttgggtaattttgtgaaaagaacagccatttgactttttgggaacacagaggatcagaaacatctgaaaaagccacacaactagaggagcattcagaagttcttgctttctgagcatttaaacagaccagagcccagagtgccgcagcaggctgtcgctccttgcctgcctggggcgggggctgggggaatatggggtcacatgctgcatcctcgccctcagcctccatcagagcgtgggttgtctcacagcaggcctagacgtggccttatgcctgttgttctgtcatgcaggagaggtgcagggaaccggatctcccctgacctctgctgtcagactgaaaagaggaccctggaacagtgccacattggggctcgatgcgggcagtggggccactccctggctggagaactttccccacgagggctgatgcgacatcacctttccaaggtccactacccccagccagtactaaagagccatgtggactgcgcgttaggagcggggcagaaagctgctgggcatggatgtcttcagctggcaggatgtgtgtgtgtctttctggtttcatttatatggaattttttttttttaagtgtctctctttcacccagcaaggctatctgcttttgttcttgtgtaaaagtcaggaatgagtccaagtcccctcccagtaatcactggtaagatagttccttggggattttttccttttgttatagcttagacttttggttacagaaaaagcatactgttcatcttcccaaaaaatatattttaggggctggcttacttaaaaagcagtgaaaatggccctatcatttcaagacagcaatatggcctagacattctcctctagtcaagtcagtatttgtccagagtagagaaagatcacattaaaaagtaagcctcggcctacagagttgggttaaaaaagacttttttacaacctagtgattttttatgacatcgtggtttttaacaatgtgtggccatctgccaggcgagccatcaatctgagtctgcctggttcaccccatctcacctctggaaggaaatgggagatgaggcaggcagaacagactgcttccacggccggtgggatgaaagacgccctctcggccccatctctgctgggaggcagtgtagtgggaagcagagaaagtcccatggaggcggcttccgttagcactggcatgttctgtttggtgacatcgacgcggccagcctcctatctctagggcttctcactctgggtggtgatgaggccattttctttcaagacgtgactcactaagactagcccaacaaccaccacttgattcctatgttggcctcttgttgctcggctgctggtcacaaggcagaacagctataggctcatcttttcctggaagccaacagcctagtgatcaactgtccaccagctgcagaccacgtgtttctaaagcattcctgagcctcaggccagccaggtcctgttccgttcaggacatgtataactccagtctctagccttgttttaattccttacgttgatccacactagcccatttttactgttatccacgatcagtaattggactctttcttcatttattttatttctgaggtgttttacactttcactttggcaatatgtgagatcctgtgcatctgattaaccaagcaaaggatcttaccatctgttttcatttacatttaatttcttcacgtttctttattggaaatttcagtggtgaaaataaaaagaaagacctttaaaatgaaatggtttcctgaccagaaatgctgatagattagcattccccttccaagaatcagcttgagaggaaaaatgatgctcaaagtcttgcatttgtctacatagctacattttccaatgcttatgtaatgttttcagtgttttcagaaacgacgctgagaataagagtgtaagagccagtgtgtacatgtgacttccgttggcttgttctgtttggtgagatcgacgcggccggcctcatatctctaggactcctcactcttgagtggtgatgaggccattctcttttcatgacatgactcatgaagactagcccaaaatggggagactgcagtgtgttctcattttcataattcacaaagaagagcagttgtttttcactgggttggttttaattgatgccagtgattacattgtgttctggcattcagggtcacctggaggtgtctgctggtgaaagctccccactgaatttgtgggaggggctgcgcagggaacggtggaagtgttggcccttctcaggcggcaaagaccatgtgttcttcattacagcatgagccgtggcagtgctgtgttgggcctctggttgaatcttgggattatttaagaaaaaaaaaacctggggaatttaactttctccttcatgttttctgtgttcaattcatatttgaaagcaaagacagagttcatatttttgcatttaggacccactgtgcaatatgtaaaatttgcttttaatagtcttttgccacattttcagtcattaccattctccagactcacgctcagtgcttctctggctgttgtaaagatttcccatgctgacatgacagcataacaaacagttgcagcccagaataaagccctggaacccaggtatgtgcagagaaggagagaacccctggggacgcagtgtccattctaaatctggtgtttcaacccctgatgaatctttcttttccagaggaacaaattaagactcactagtactcacagacagatgatacaccaaacatatgtaagagcaaggtaactggaatgaacacatagaagtcagccaagaaacctctccagatacttgctcacaaatagaatatagatttaagtttggagaaatgttttaaaaatacttgtatattccgaaccaccaaaagggtaactgtattactgggcaagtcagttgcttaagatttcccaagtaataccccagctttgtctcatcatcatcattttaattcaatatgcattgcccaggggatgattataatcactgtgtaagatgcagagaagatgcagtccctggaagttgcatccagaggattaacttacagattaactcagtttttatgtgatctgtaagagaatttctagtgcactgtggtcttttctttattcaaaaaaaaaaaggccaccttgattccaaaagcatggaattcaaatccagtttgaaagtgtagagatgacaatcatttactcagaaattttgctctagaacatttgaaccaacaccgtcaacagtcataagctaagaatttgattattctttttaagtaatttatagatctgattttcacatttgccttacagcctcccttgtatggtggaagaacttcctgaataaaaatgtgatttattgcatcaaattcttgacaagacagaagtttgagaaattgctataggccagttatacctgattacaccgggactgccctcttttcaaatagtctgatggagttattttcagacattagaagcagttgctgcaaagtgcctttgaattagctttcatcagcacatagcaataactgctaagtgaacatttctttaaatccttacaactagaattttaaactagccctttgcttcaagaacttgcctctgagttgtgctgtatcctggttagagtttttatcaagacatcatttcattgttcatttgacagatatttttgaacacctacaatggacagtaagatgggaatatctgtctttaacataagctagctaaaatcctttgggggagacagcgtggagaatttgcaatgcaagacagatgttcaccggaactctcctgctgttgagcagggcatccgtgggtggccctgtctcatcggaaacgccctggctgtcaatcggcagcagacccacatgtgtgcatgtttggctgacgttatgtggcatgagggctgccagtcacagcagaggcttggtgaccttgtggggtttgtgaccctggctgtccaaggaggcccggccttcacagccccagctcttcttcccactctgggcctggggcgcttgtccttagattcgtcgtctcgccgctctgcttcatcctgctttcttcctcagccttctgcagctttttcctacacatcagtgtgagtattccctcatactgtgttaggctataagtttccaaagacttttttcataccttttccccccagcagcctggtaaaggctagaggaatcactgtcattttacacatcaagaaactgaagcaaaaagggggtcattgactcataagaacccacacccagcaggtggcaggggtgttagtggaaccccggcccggtggccttgagtgtccactcatctgtaaagaccacaccaggcaaatacctattgaacacatgcatgtgccaggcagactttaaactccagatatacagcacacacaaggcagcaaaagccacttctcctggtgcttccatgctggtgagactgagaaatggaagacatgcagagatttgggtgaaaccttttcaaattcagaggctgaagtttttagtttggcttactactctgctcagcaatgcagttgttactctagaacactcagaagtctttaagacttttttaccattgtgaaaataaagagagggttaaagtgaaacatgatcctccttggtctgcgaccagcaggatatggtcctttccctcctttttttaaaaaaaactttttttttaaggtttttattaatcacagatgtcccaaatttacagactgggcctagaaaacagcctctcttgtcctggcagtccccgtgttttgtgtgttcacatggtgaaactctctcctgcgtggggctgaatgtcagcacttctgctttctcttctttctttaccttttttttctttttttatttaaaaagaaatctagcatggactttttttgaactcttatttcagcaaggaagccatctatgtaaggatttttccctcctcaaaataagaaggaatgaatttgaattgactttctcttggtgcttcaagcagatcacagatggctttctcatgcgcacagctgaacatctttttaagtgactgcgatgtgctgatagtatcttgtgctcaagtttactttgttctattttaaaaatagaaatagaattgaagtaattcatctagattgcttcattcatccttcatattaaaagtgatttttagtacatcctagacgccatgttaggcctgcagttacaaatctaattgtgatgaaacctaattctcattttctgggtactcacagttgatgtaaatacaatgtagtgagttctgtgctatcatggagtcctttatgcctcagccatcctacatttataaacacttaacagtttatgaagtttgtttgttcccattatttcatttaatcctattacaaccctgtgagatgtggaaactcacatgccagaatgtttgctgtgtagtgggagtgccaggttcactcaggccctttgacaagtccagcattctttctgacatcccttatggatcatccatctgggccttggatcagcgggtttccccaggctggaaagggggaagcacattcccaaaccaggcttagtgggaactgaaggcattcttgctgatgagaaagttagcgatggggtgaaaaagcaggactgagagttagttgacttttttttcttccaaggtgataggagttgagggaaaggcaagagatgagtaactatttctttgcataatagatgcatctttttttttttgagacagggtctcactcacccagactggagtgcggtggcacaattctggctcactgcaacctctgcctcctgggttcaagcgactctcctgcctcagcttcccgagtagctgggactacaggcatgcgacacgatgccaactaatttttgtaattttagtagaaacagggtttcatcatgttggccaggctggtctcgaactcctgacctcaagtgatccacctgcatcagcctcccaaagtgctgggattacaggcgtgagccaccgtgccctgcccagattgatctttcatggtatttctcaggtcagttctgtcctgagcccccaccccgacactgctttacatgacaggcagtgttcacgtacacttagtctggactctgccttctgagacagcaaagcagtaacacaagtgagagatgagtcgctagaagggttgccttatttgctttgaattatcatctttgaataaataattcacaaactcatgaacttgactaaaattagatgttacttgtgttcacttcaaaactgatcaggatataccagtaactcaggacatcaccattcatagtggttgacttatcagtcagtatgcataggctgagaaataatagcttgcagctggtttgttggctcacctgtttgtcatttattcagtgtatactcattaagctccaggtgtatgccacgctgcctgctggcagctgggtatgtagttagaaacaaccagacatggtgccctggagtctaaggtcatggttggcttcctgccttcacagttgcccagctaggaaaatgttgtgtccgaaattgttgggttcttggtctcactgacttcaagaatgaagccgtggatcttcgtggtgttacagtttttaaagatggtgtgtccggaggttgttccttctgatgttcagacgtgtttggagtttcttccttttggtgggttcgtgggctcactggcttcaggagtgaagctgcagaccttcgcggtgagtgttacagcgcttaaggtggcacgtctggagttgtttgtatctcttgtccagagttgttcattcgtcccggtgggttcgtggtctcgctggcctcaggagtgaagctgcagaccttcgcggtgagtgttatagctcataaaggcagtgcggacccaaagagtgagtagcagcaagatttattgcaaagataaagcttccacagtgtggaaggggacccaaatgggttgccgctgctggcttgggcagcctgcttttattcccttatctgaccccacccacatcctgctgattggtccattttgcagagagccgattcgccgattttacagagagctgattggtccattttgacagggtgctgattggtgcgtttacaatccctgagctagacacagagtgctgattggtgtatttacaatcctctagctagacgtaaaagttctccaagtccccactagattaactagacacagagcagcgattggtgcatttacaaaccttaagctagacacagggtgctgattggtgcatttacaaaccttgagctagacacagagtggattggtgtatttacaatcctttagctagacataaaagttctccaaggccccactagattagctagacacagagtgctgattggtgcatttacaaaccttgagctagacacagagtgctgattggtgtatttacaatcctttaactaaacataaatgttctccaactccccaccagattagctagatacagagtgctgattggtgcatccatgaaccctgagctagacacagagtgctgattggtacatttacaatcctccagctagacataaaagttctccaagtccccacccgactcaggagcccagctggctttgcctagtggatcctgcaccagggccacaggcggagctgcccgccagtcccgcactgcacacctgcactcctcagcccttgggcagtcgatgggaccgggcgctgcggaggctcaggctgcgtgggagcccaccgcagtggggcttgggcatggtgggctgcaggtcccaagccctgccccgcggggaggtggctgaggcctggcgagaattcaagcgcggtgcgggcgggctggctggcagtgctgggggacccggcacaccctctgcagctgctggcccaggtgctaagcccctcgctgcctggggccagtggcgctggctggccactcggagtgcagggcccgctgagcacacgcccacctggaactcttgcaggcgctagcctgcgagcaccgcacacagccccagttcccgcctgcacctctcccaccacacctctgtgcaagcagagggagccctccagcctcagccagctcagagaggggctcccacagtgcagcggtgggctgaagggctcctcaagcgtggccagagcagaagtggaggtggtgctgagaacgagtgagggccgccagcatgttgtcacctctcaatgtgatcatgagccgattacacagggctctgaccacagggctcgccttcagagggctgctcttgttatgggtttgagccatccacaatcaaatcctgagcaaaaaagtaaggacacagtgccaaaaggacaggagcatgcctgcacagtgtgggtgtctgggcagggggtctcatgctcctgtgttcacagccatcaggacctcttctggggaaaggcaactgtgtgcacaaaagtaatttaagatcttcccatggagacttcagaattctagagctctgtgtttatggtgtgatatatccttatcctgtgcccagtaactctggagaccttaattctactcaagataccattaggacatgggatttaatttaaaattcgcatcaaagtagctgatttagtgggcaaagtctatatttttcagatagctaaaaataatagatatgttatttcattctgttaatgatggtattaagtttaaagacttttaaagctttttaaactcctaatgtgtacattgtatcacaacccagcaaagagcatagacatgggctgttacattccattgatttaggccaaaggaatttctactgtgaaaagaaaaaaagttttttccccaccagagagagtcaaatagcatgaagaattgagcattcttgttaaagagaaggggtcattattgtccctctacatttgcagacttctgaaacaaaatttttctcaaggtaaaattttttaaattccacaaaatttttcttatagtttatgaccactgctaacatttttctaagtcataaatattccggcaaaatgaaagaatgtcacttccgtcattcaataagtaggaactcagggcaagaactgctgcttctcatcaatggcagttgtcacccagtcctttgcatttaatctgtggcaccgatgagctcccaccttgggcagccctgacctccccccccccccccgccccgccccccggtactaggagtgaccatttaggccatagccacatttttaatgcttaacctgccaggtaagcaggaaatctctttcgaaccagcttcccaaagtgcaaagaaccaaatcccttgcagctgagcccacagagagaagctggggaatgacgtatttaatttccttttcttcttgaaccatttttacaacaactagctcctttcccaggcaaggctaagtgtcctgggaatcatccttgtaacgccagctgggtgccacaaagcattattaattgactgtggttccttctctcatgcgtgcagaggccgctggatctgctgaacagtagggaggtctgtgtgcttcagggctgccctgcgtccctgcctgccctgcatgcccttttccgagagcacgcctgcttctctgtagccctgcaagtctgggtggacagagggaccaggtcagaatacttggtaggtgtcacttaggcttcataccactcctatgccaactccccccaagttctaacttacaggcccaaaaatgtctgtgaggttgatttattggctgaggtcctactagttgtgatgtgtaagtgttctgcttatgaatgttaagacctgtacttgatttcattttactaaaataagtgggcctgggtcttttttttttttttttcctccatcagtttatccaaggcacagcagagctccgtggtgacacctcaccacatctcaggcatccgggctgtctcccgacctccccacgggccacactcatagttccttgtcttgtgcagttgtgaatctatgtcaaacaaaagactgtccttaaaatatgagctgtgggtcagcttgctgtttctttagactgttgatttctgatgtttccatgtaatacttgtgtgcctactgtatgccaggcactgtgcagagccctggaagtacctcaggtcccagacagatgaggcccctgccttcctggagcttttatccattctcctgacccagtgcctaggttacctgtgcccacctccctcaaaggccagcttcagtgccatctccttcagggacccttccatggttcctcctcctgttgccccttctcaaccctaacagggtttgtacctcgcctatagtacaggataattttgtgatccaaataccactgtgtgctgagtcacatggatgaagaaactaggtgttcattatctctgtccagtgggaaatcgggggcttggctccaagtcacagcacagtaagtgactctgaaatctgccacctgctccacctgctgtgagcagtgcagggttctgctagcagttggtactttaaaaaatattcgttgaataaattgtcatctgacatatagattatccaaacctgccccttctctttgtccttcctgaggctaggaactgtgtctacctcatttgcattttatcttaaatcagcacctgagaaagtccctgggaatggatttcattcttttcctacctccttccagaccacaccgaaggaaagtgagactgatagggaaatgttttagtaactcttgtttaaaaatagagtaaatatatgagaaaatatatatacatataagtacacaaacataatatagacacacatacagaggggaaagggttatcattctttaacagatatcaatgggttctgaaccagagtttgcctctgagaaaaatctggattttgaagaatgaatgatcctgcctaaaacgcatcatctgtttctggaatcttcactaatctgtgtcttgggcgaaggaaggaacgggacagcagtgagacgggcgtgtgctgtctagtcccagcgtcggaagcacttggtgggaaaccgctgccaactctgctcctgtaatcacagggttcacctgcagcagggaatggcgtccagagccagagaggcagtgcagcccctacaggtatctgtgcaaaggagtagctcacaagattacttgacttgagaagatagcaagcacagtgaatgatcaccattgtcaccgttctgctttctaaagttggtcacttcattccatgccaccgtggtggagcccctgagccaagagctcaggaaggggcccagcagctttcacgctcactggtgtgcgagttgtacagtagacgtcacacaagtccatggattggctgagtgtctgctgtcacccaaatttcagatttttgaatacaaaaattagctgggtatggtggcagtcgtctgtagttccagctacttgggaggctgagacgggagactcttgaacccgggaggcagagattgcagtgagctgagattgtgccacagcactccagcctgggtgacagagcaagactccatctgaaaaacaaaacaaagaaaaattggattttttttcttttttctcttgaaatgtcatccactccagattgactatatttaatttttgagatccaatgagaagctggtttggatatattttctgtagagcattttggttatttgaggaaggcttcccctcctcacatttcttttcttttttttcttttttctttttttggggatgcagtttcgctctgtcgttccggctggagtgcgatggcgtgatcttggcccaccgcaagctccgcctcctgggttcacaccattctcctgcctcagcctcctgagtagctgggactacaggcgcccaccaccacacccggctaatttttttgtatttttagtagagatggggtttcaccatgttagccaggatagtctcgatctcctgacctcgtgatccacctgcctcggcctcccaaagtgctgggattacaggcgtgagccaccgcgcccggcccctcacatttctttttaaaatgtggtggcgtttttgttcattgttgctgatatttacttcagcacatgtggtaagtttctcaagactgtgagcaaagtcccggtgtgccgccgtggcctggccgtgaacaggaaagaggctgagggccgctcctccgagagccccaccagctctgccactttccagtcgccggctttgtcctggatgctggtctcccagaggctgctgctggtcagagtctcaccaggacaaatcactgtcattttatccgtaataattacacaattctgcttttgttcactggtagagaatcaaactaatgcacttctgcgacaggattagcttacagtaagcatgtcagttggcatagctaaaacttctcaaaatttcctttaaattcattcttctttcttggtttttgtcaagaaaatgggtgaaaatgattttaaaattctgtcctccaatgtccgcagtaccaatgtccacagtattttatgtgatgaatgacatcttaaatctggctgataacgatgctggtcttcaggattggtgacatgggtgattttggagaggacagtgcatcttgagaatgatcatctctagcagaactcaggtttgctacacatttgagaagagagtgcgtgtaaagcatcagcccctgtcatctcacaccccgtaggcaaagcccgctgacgaggcatccaggcccactggcttccctgcagcctgcgggataatggcatggtcttcacaccggagggtctgtgcgagtcagtgatactccctctctttctccctggcagactcgctctccgtctccagcaatgacgccagtccacccgcatccgtggcttccctccagccccacatgatcggggcccagagctcgccgggccccaagcggccgggcaacaccctgcgcaagtggctcaccagccccgtgcggcggctcagcagcggcaaggccgacgggcacgtgaagaagctggcgcacaagcacaagaagagccgcgaggtccgcaagagcgccgacgccggctcgcagaaggactccgacgacagtgcggccaccccgcaggacgagacggtcgaggaggtgaggctctgcccgctggttggggccggcgtggcggggcccgctgggcttttgctgcaagaatagttgctgatcttatgagtaaactggtttggttctgttttccgcacttactcagaaattaccattcaagtctctgcttagcagactgagatttagtggggacacttgaaagaaaattgaacccagtaagcacattcaggaccacgtgtggcttctgattaaaaacaaacaaacaaacaaaacagatcaccatgcgccccaggcccagtcagcccccaggcctgggccaggagggagaccagacttggcttctggaccctctcctccccactccaccatgaagcaaagccagaggctctgtgtagtctgcagaagatttgggcagtctctgagctgatcattgtggcagcattttgcagagaaagctcaaattggaaatttggaaggacttgtggagtgtttgcactttccaattgtttttccccaatatttattatacttacagcttgtcttgagtagaaaataaccagttaatttactttgttgacccagtagtaaacattgggttattcccatgtcaccaaaggtaagtgcatgtaggtcagccagagattttttatgtcctattgacaagggaggctttaaattacattgcaagaaacagaattccttcaggatgctggagatggccttcagcactggtggtgtcaatgaggggtcctcagagtttttaattaacttggatcgacccccgactcaagtctcacacaggttcgaaaaagaaaaggcagagagtggggatgagatttgtgttatttgatttatttggcagatagctgttttctgctgtttttttcctgggcatatttttgccatgagattttgttgcagtgtgggggttgggatgtattatgtacattcttgataaacctctgtcctcttaggaaaactaaaactgaaatttgtttctaaaagtgagaatagaggaaaagaatactcaaatccagtgcttaaaatgcatcttggattatattttttatgcccttattatttcagtgaacttttctatagcaagatacccaaagtgaaatcagctggaccaaaggaactaaatcaacatgagggttgtagctcaaatttttgagcctttttaaaaattggcttctcaaagatgagctgtgttcagagcctaacagatcacattggcagtccctttatatgacacatgacacattcagtggccattctgtcatccaagttgacaagcaaagctattgggtagcaggaagagaggaaaagttaccatcgaggtcgagaatagctttgttcctgatttctgccatcccagtctctgtccccaccttgcttctccaagtaacccttggtccacgtctgtgaactggcctggaatataatgagcaaatcttgactggatttcagagaggccggaacgagggcctgagcagcggtactctctccaaatcctcctcctcggggatgcagagctgtggagaagaggaaggcgaggagggggccgacgccgtgcccctgccgccacccatggccatccagcagcacagcctcctccagccagactcacaggatgacaaggtaaagggggatgagggctggggaatccatgcctgccgtgcaggggcagggcacgctcggtagctgcttcacaccagcctcatttcaggagacaggaggccccaagatgtggaaaagggcaatgcagtgctctttcaggcagcgtcagcctggttgtaccccaaaagtatgagtaacaaagccatttagaatagcagtaggccagcgggtgcagtttttcttacacatgtggctcaatgcatttttaatgatgcttcagtaattgccacttctaaagtaattttaaagtttcctaatgtattgactagaatccctgagagaacaatcagagatatcccatgcaggtctgtctgaaggcatcactaaatgaagagttggccatctcccctctgtgaggtttttgcatgcaggtttctggtttgagatgaggttacatcactgtccagttactttttccaacatgccagacattagtttgtaggatccctacgctagagtgcaggcatagttgtcaaagtgtaggaatcagttgaaagctctttgggtctacgcaggagcttcaagccatgaaagtcatttgttttcttgagttcttacgtagtctaaaattattttgtcagcccaattgtagagccctaaaaaataaaatagcagaaaggaaacctgctcagtgtggcttgcacatcctctagcattctggccctattgtgcccctcaaaatcatgctatgaagtcattactggtgatgctttttttttttttttggcagtaactaaattttctgagtaaaacagataactttatcaacatcttcccccatgcttccctttttccttccctgacttccttgtcagtacttgcacagtcacttgccagattaatcaccctctattttacgacatgggattggcctcagccggtgcttagcagctgtgaggccaagtcaaatcatgcactcctcttaacccaaggcagacctgtccaccaccccttgttggtggaaagctactccctcctccctttttaacacgagaccagcacactgtaagggtgctgtggggcctgcaatgatggctgtgagctgcaggactgagcacaggttggagtcctggagttttgtgtgcatctgaggttcaggctccccaccatgtgtaggggagaaggaacagggagcctgaggtgagaggaccacagccccctaccccacccagtacacaggctacctggctaggacatggggctgtgtgatttctgtgatatttcctaagctattttgtaatacgctaagccatgcctttttgaaaagcagaaaactggcatttcttaaatctgggtggttgtccaaacattgaggggctgggccttgttgacttactcacccataagggaggatttttctccatttaaagagtgacctgcactgtatccttctgtttgctagttactatgttacctcgttgagtattatcagtagcagttcttcatttacaaaaatctgtagtgattttcccacacagtatataatctcgtgactaattttttgttttgttctgttttctctttttgtaaactttcactgcagcattatgttgatttgtgttctgtgtctgttttggctcaatttccttacctttccgtttgaatttttttctttgttttcttcaccccatattccaaatgtcattagaccaaaccaacatttgttttgcaaagtgcatattttgacccacacgtgtaaaagccttgttgtgagtgtatgagcctgtatctgtctgctgtgagacacgcatggccaggacagcccgctgtgggtcgcatgcctcgccgctgtccttaatatgaagcaaggttcatattacgccccttctagttcccagttaattaacggctcaagtaatctgcaaacacgtcgtgtttgctaattactgaaactcgaacttagtagcccctcccccagatttcctgtcaacccctttacgccctcgattctagccataagtggcatctgatagcttgtgaggcctcagctcttctgtactctgcactaatcatggggaaatggatggcacagaaaatggtgagcttgtccccctccttccctgtctggtcaccgcaccccgttcctttcctcttcctcgtttcttttttttcttaatcccataaacacagtaaagccatttcttagtacctgttttgtttcctgattattccaggattctctcactagaccctaagcctctcattctgctgtaggtcagattctctattccttctccctagcccagagccttgccagcacttgcgaaagttacggttagaacgttcccttgcctagtcacctctttgaaaaaaacactgtgatgttacatgactgcgattcaaatcagacactgtctgcttcccacatgtatctcagacaggttttatttaatgtttcttgtcagaatattgtaaattcaaaaggatgactttaaataaatgtaaacaaagacaaacttgtggtctttttgtctggaattactttcacaagagatggagcttgcaggggaatttactgtctgaccagttactaatgtgagcccttgccccaccccctccttttcttaatttcttctgtaggcctcttctcggttattagtccgccccaccagctccgaaacaccgagtgcagccgagctcgtcagtgcaattgaggaactcgtgaaaagcaagatggtgaggcctcccagagaaagtctgacttttggaagctgctctgtgttgctacttgcagatggatttgcccttgtctttgtattgctctgggctgcagaatgtggctgtggcttatggcacatctcaggagtccccatgaccaccctcgggttcactgatttgaaggactcagagaactcaggaaagccattattcccacatttgcagtgtattcccatgaaaggacacagatcaaaataggcaagggaagaactgcatagggcaggtctcagggagtgcctggttcaagctgccagccatgctctcccagtggagtcaggcagacagaggattgccaaccacagcagctcacccgagccttggtgttgagtgtctgtttgggctcagacgcatatggctgactgctctgtgtggctgaccttaggtagtctcctgcccctccagagatcaagacactgtcacattgctagcatagactatttgccttggtcccaggcccccaggtaaacagacattctcatcaagcagaacattccaaggacttacaagttccctcctagaagctgggggcaaacctcactgcacataccctgcctgcagtcactgcaaatgtggtcagctccagtctgtctgaagatgtgccagggtcagtggtacccacagttagactctccgttttgttttgcaacccctgagatctttcatttgggttcacaatgtgtgagagagaagggtttacattattatataagggcttcattttcttagtgatctctttgttgccagttggccaacgtgggttcatttgataaaagccccaaattaaatgttggttctttgaagttaagacaggcatgtgttgcttctaactgattcaaatcaattaatttctgtttttgtagttttcctaactgggaagtggaaaaaccaccaatggtaacaactttttagactggtatatcctactatccctataaagacaacgtcttttaaaagcagctcctcccaaagtaaaagccctcagtctgtctcagcaatccattctccagaggtaaccactgcgaatagttctgatacgtttccctccagacgttttccttgctggtgcaaacatatatatgtgtgtgcgttttctttccaaatggattcattcaatttttaagactctaataattaacacatcttaaggatcttctcacgtcagtacatacagattacctctttcctttatttaataactgtatagtattcctctacatggattctgtgataataataccactgagcacttattctaagccaggcgctgttctaagtgctgagcatgtattaatttatatacttcccacaacaaccctatgaggttgttatgcactattgttatcccattttacagataaggaaattgaggcacacagaacatttaaaaacttgactagccactaagggtcagagacaagattatgctataatttatttaaatatattcctaatacatacttgtttcccatatttctctgaacatccattacatgtttgtgattatatttgtcaggtgaattttcaacactggaattgctaaatcagagtatacttctttaaagttagaagtttctcttcctgcatttgggcattaactaggtaccagatatatcattcccatttcttccttcatccacagacaacctctaatgaaactggttgactgagtcaaatgggaattatataaagaaaaatttggactgacgtgtcaccctgccatagctagaaatttctccccaggtaatcgtgtggtgttccggagaagacccagtgaactttgaacaggaagcttgctagggtgtggtagataactcacgaattcggactccactggttaagattttggaatcaggcctggtgtggtggttcatgcctgtaatcctagcactttaggaggccaaggcaggcatattgcttgagcccaggagttcgagaccagcctgggaaacacgagaccgcatctctacaaaaaaatacaaaaatcagctgggtgtggtagcatgcaccggtagtcccagctatcgggaggctgaggtgggaggatcacctgagcccaggaggttgaggctgcagtgagctgagattgtaccactgcactcagcctgagtgacagagtgagaccctatatcaaaaaaataaaaaaaggagcttggaaccatgccagtatgtactgagttcagctacatccttggtatctctttaaaagacaagttgataaaactgtctaaatgaagggtgcttaaattgtatccagtgagtttttaagcatccttaaacttttttttaaaagccatttatacacgtcagttaaatgaccattaaaatcattcttaccaaatagccgaaatggtttcccagggaacgctgtgaggcagatctggccactattctgcagctgtttaaattgtattgcattttatgtggtctgtgattcatttgtaattaattcacgtggacttccaaatggagaggtggtctgtggcatggtcagttttgactcttactgtgttaatctcctttttcaattctgaagaattaaactttctcggtttactcagtgaaactgagttgtttctgctcacttcagtgggcataaagctgttggcataggaaaggcataggttttggagtcagatagacttgggttcacagtctcattacggtgagttccaccaggcaagtccttcagcctcggagactgtctttcagctacacatgggagctctcaaccaggtttcatccacatgggtgttcactggtgccttcccctcccttgggagaaccatgtttgtactttatgtgataggttcatcccttcttcattctgccagggaatgcgatctaaattctcccctctttttctggttcaagagaagcatcaccctgtgttggtttcctgtcactaatgctctaacgtcacatgggaactagtttttgtcagaaaacactaatgcatcattgtaatatcctaaacttatactgactctgcagtagatccttaagcatccacatgtgttttcttgtgggtgatttctgaggctgtcgcacactcataattggatttgaacactgcattgtttattcttcagaaactctgtatgtgtttattgggttagggaggagaggagagaagatgttcagcagttacacagtatgatgtttaaggaactgaacctacctaaacctaaaacctgaggatttgactcgaaaaatgaaagcccccctgaaaactgttccctggattcattcgtctggcttacctccacgttcttgatgcagctggttattttaaaggctgtgcatttttcctgcatgtcggcaatagagtaatagttccctgccgccacagtgattgtgtgaacttgactttggggttttcttctcttcactaatcaaaatataaagggagaaacaagaaagaatgaaaataaatgaaatcacatctaactcaagatgttagaaaaacaacaaaataaaccaaagaaaagcagaaggaatgaatttatacagataaaagcagaaattaatgagctggaaaacggtagcataataaaaccaaaaatttattctttaaatataggcattaggtaaccatgtcaagaaaacagaaaacacaaattcccaaaattaagaaattataagagaggaaaaaactgaggaaattcaagcaatcataagacattattttgttcatctctttgatagtaaatttaaaatgaaacctgaatgaaatgggcagttttctaagaaaatgtaatttatcaaaattaatctcataagaggtagaatatttctgtagacctatcttcatgtaagaaagagaggagaaggacacaaaaaacaaccaaacccagagagtttcacaaataattcatccaaaatctgtgaagtcccagtggctgcagttttgagacagccttaggctggtgacagccttctcacacacatttgtggaagaggcaaatgggccacatgaaggcgataaggacgtctagccacaactgcaccgcttcagggtgtgtgcaccctctcggcagcccatcttgtcaggaaagatcagatctaggacaggcagccgaggggcctggggactccattgttgcaggtcgagaaagctggaagacaggtccccatggacactgatgaagtccgtgactttacctccctgccgtctgcagcatcaggggcatctggagcctttctctttcttttctttgttttttctcactgttcaaatgaacagaattcaatctaacaggcttcagctgtccaggtgggggatggggggtacagaacatcctcccttcgctctcaaaaacagatgtgatctgatgagcgtgaaacaagctctgctactcacagcaaaatgtttgcttccagtaaagctcaatggctatttatttaaaagagtgcatttatttttcagatcaaactctgttccttaactaacttaatgtcctgtttttcaaaaataagatcagcagttggtgtgttttttatagctccatgggttttaacaagattgcttgtacagtacatgctttgtgtcctcaaagctctgcttaacaatgaaatcagattcagtctgttactgttaagaggagaaaatagaacaagtgttagagattttagtttattaataccaaatgttttaagtgaggtattgtttttgcattttgtattgtgctgttcaaacctagaataaattcatcacatttttttccagttcaatcatatctatatatccagtttgttgctttgggaatgttaaaagaactataaatcttatgtgttctgtgaatccaggtaaaacaacgagattaatatttaccaaattgaaagcaatcagtcaccagtcattgtcacattaatccaaggagagaagtcaccaatattcaacttacagatttgctgaacacttgcaaagatttgcatgaggttctactggggatacagcaatgaaaacaatcacctatagaaaccaaaagccagtgggggaaagaatgtattgcagaagtaattaagacaagcacgattactattttgtatagagggatagaatggaagttgctagatggagattaattttaccagagtgatttgtatgcattgaagtatgagtcaaagctctagtaggataatcaggaaacaaaccaagtttgttggattgctgatgttgctacatagtccaccaacagggaatgcaggtaccatgtccaggtgccacactggcctgacccacgcacatcccagcagctcatttggcaggaatataaccagtaagaaaattgctagatattaaatatgtgtgatatgtccaaaaatgggtgcagtactctgacataagcaagtataacatttctacttgtttgataacaagaaatagaatatattaatgtatgtaaattcactatccttttcattccaacttttttctccacctcctttgactctatttttttattaatagttgggttttttgtgttattaaatgctataatttcacaaacaaagattttataatttcacaaatacattttctgtattttctgactttgggtattttcttgtcttagttttagccaatcatgggctgtgggcagtaagtgttgttgattatgtcaatttcttccaggcactggaggatcgccccagctcactccttgttgaccagggagatagtagcagcccttccttcaacccttcggataattcccttctctcttcctcctcgcccattgatgagatggaagaaaggaaatccagctctttaaagagaagacagtaagacagaaatgttttcattcttattgttctctgggttccgtcctgtctttgttgccttcaaaaatgtgactgagattcagctctgaattaccgagatgagaagctccagggcctctcattaagtaactgcacgtatgtaaaagactcaggacctaataagggcacagtattccatagctgcagtttcttgttttatttgtatatgatacttcataagtaagaatgatgcaagacaaaaatgtcttctgccacatgtggtgagaaactcctagactttttattgtacatgtgattgtgaaagaaaaagtaatataaaattagaaccagtccccaaaacttgaatattctttgaacatactttactggtttctcaatgccagtaaagcagcatatggtgaaaagagtcctgaaaaatgttacaaaaggtttaaacttgcctttggagaaggaaaaaaaaaaaacgtaagctacgaaacggcagagactgggtgttttattcagcactgtatcccagcacctccgatggtgttgggcacatgagaggtgccaggttgatgttggttgaatgaatgactgaacaacacatggatgaaccttttcaggccaattgaggttgtttgctatactgatcaaatggttgtcttctgttatctgagtggccttaaacggttactgaatgtaacaaacagaaatacttgtgagtgatgtgattagacacaaggtttaaacatctgatttaaaagtttttcttgtatagccagtgaaggttaaaatgacttaatcattttttaaaagccacttcctttactatcatggctttgtcagaaagttatgtctaagcttcattgttgtccctgtatgtgatcagaatccagaagggtgaattcaccctgattgccctcatgcactgtgcctaggtgtcttttgacctccagagctctcgtgggtcacccacttgaacctgtaagtgatttgggactctccagaatttaacacctaaatgtacaaatttgatacattactattcagtcctggaaggagtccatcttgaccaggagcaaaggtacaaaaaaattcatttagaaaacagtttgcatgataaacaatattttttctctccagctacgttttgcaagaactagtggagacagagcgtgactatgtgcgggaccttggctatgtggttgaggtgtgtattgccagaaatttagtatcttcgtatcagttccaagagttgtcaaaagtagtatcgttttagacagttgaacacctctcaaaagctttaaaaacatttttgacccaaaataaaaagtgaccaacgatgtatttccgaaaaattaagtttagccaattgtctttaccatctgtattcagttgtaaatgcttctttttcgcatagtgtatcttgacataatcttttttaacagttgaaatttacaattattataaataatttgatattattattaaatgatactaagtaagtatactgtagttagtagacaggaatcttgccttaattgtatcactacagaaatgaagaccttactggttgaaaaagtcagtgtggcccagctgtgggttcggttccatcctgaatccacccaggttcagagcctgtactgtggctgcaccaggtcatttacttgatagttttgtacagaacacattgccatttccattgaccagaagttgccaagcactgtagccatagcaaaccactgccttttgtactggatcgagagccatctctaggctaatccctgccagtcaattcggggattagtgagattaagaaactcaactcatcaaaaagctatttttgtggtataaaattttatgtgtattctttcatctttgcagatttgtacaggacaatactttttggttacacatcccattaaaagtaccagctattaaagtcaattgcataacacaaaagatttaacatgcttgatttatctgcagtcattgttcacaatgagataagcaacctgagtacttaagaggttcttgtacagacttaaatagaaattttaagccacattttagcagcatattcaatcaactgttgtttaaaaatcagtttataaaaagaatattgttaaacccttatttaaccgattacacaaataatccaaaaagaaaagaaaatctttctgtttctaagagataaatgctgaaaacaggagatatgattctgaccaaatatttaatatttacaaactgtttaatgaaaccatttacatttatttaaacttctttaattccttagaagatttttgatctgtgaatgctgaacagtccagggaaataaaattacagcaatgaatgtaataggtatattccaagtatcagttaaggatacttttcatatcggttttttttgtttgtttttagacaaagaactggttacaagacagtgcatgtgtccattttgccctctgtgactattaatcaataagccactagttgattcagacatattccatgaaatacacttatcataactgtttaattgtagggctacatggcacttatgaaagaagatggtgttcctgatgacatgaaaggaaaagacaaaattgtgttcggcaacatccatcagatttacgactggcacagagagtacgtaaacatgcattgtgcccgatggtgtgcaaagcagccacacttgctaaaccaaggcaggccaggccaaagggaatttattctgttcatcgtattacctgtgtagcctcctggagggagctggtgcaaaggagatattgatgtacccaggagttctgcagtagcatttggtggcacggagagagtcttgtctcttcttcgtgctggtccatgtcgagagtctgtggaagggagtagctggaagcaccagcgtggagccagctgccggagctgctggcctggtcctgaccccgagccctcggcctccctgctgtacacttccattcttcatctgcacacccacattataatgtgggttttttgtgaagagtgactgagttaatacttttacctcgtgggttttttgtgaagagtgactgagttaatacttttacagagtacttagaacaacatctgcatagaataagcttcaagtatttctaactagaattgcagccatctttagaataaatacaagttatcattagaggaccttgaagacactcatttgtccaattattttatgttatttttattttttagagacagggtcttgctctgtcaccaaactggagtgtaatagtgcgatcatagctcactgcagccttgaactcctgggttcaagtaatcctcccgcctcagcatctctcagcatctctagtagctgggcctacaggcacgcagcaccatgtgcagctaacttttttggttttcgtagacaaacacgggcttgctgtgttgcctaagctggtcttgaactcctgggctcaagcagtcttcccacctcagcctcccaaagtgctgggattacaggcatgagccaccacgcctggcccaattcaattttaatggaaaaagtagacacgattgcccatgaaattcaactctgatcccactacattccccacacctatcctaatcaggaggcaatccatctgggggctggtgctacgtagctcaccttggctaccagagcttgtcaacatacctgtccctttagatcactttgcttaaactttaaaaatccttaatcatctgaggattgcttaatgctggccactggtcttccagtggaatgttccagatgcactgtctgctccggttacctggccgggccttctgctctcctgtcttgatgcaactgctcctccctctgctcagggtggagcacgatgtcatcacctccaaagctctggcctctctctgaagctgagctccatacttgcttctccattaggcctgggtgttccccatcagactccttctcttctgcagaagcagatgggaatatgctcttttaaactatgagatactggacagacatgaggaggaactaccgtgtcacgtatcaagtagtgttgttatttctgtgcttctccctcctaacagaatgtaaaacctttgaacccaggtcagagaggtctttattttcatatcccctgtgatgtctaatttatttggatttacagataaatgatcggtaaactttagaaacagcactccagtttatagctctgtgctgtagacttactgaacaactacagtgaaaccaattcaaaaagggatattttgtattatgatttagtctcctacttccaaggctagtttttaaggctgtgaagggaagctgaaaatgacacagtgtttctgggatgaccagacagacactgtatccagagatgctgtctgcgcagcggggatagtaaaccccttagtacaacattaattggcatggtggtttatgagttaatgtaataccaaatattaacataaataaaaatatatttaagtgataactaagctggacatatatcttaaaagacaactacagcccagaaaacaatgaacattgttgtcctacagctattttgtcactgtgatgatacctaattttaatcttaaagggagctgatgtttataacctagaagttgattttgataacatttgagaaaacttcataaagctggcacaggtaacatatttagttttgtatatctgctgtccaatttgagtctctaaaaattatcttagaatgaatatgaaattcgcaggtataaagaccaagttttcagaaataaaaaatgtccaagtactttgaaacatctatttttcactcattattcagcctaggatattagcacttgtgtccttgaacagagatgagaatgtttgttatccaaagaccaggaaggtcaccagccaagggatatacagtcgtgcctcatcttctgtgcctttgtattcctttatgctttgtagcttaacaaaaggttttccttgtacttgttaagtttccatatatttgttaaatatatacttcacacttcacagttgctcatgtcagaacagactattgaaaatgtaaacctggccaggcacggtggctcacgcctgtaatcccagcacattgggaggctgaggcaggcggatcacttgaggtcaggagtttgagaccagcctggccaacatggtgaaaccttgtatctgctaaaaatgccaaaaaattagctaggcatagtggtgcacgcctataaccccagctacttgggaggctgaggcaggagaattgcttgaacccaggaggcggaggttgcagtgaaccaagatcacaccactgcactccagcctaggtgatagagtgacactctctcaaaaaaaaaaaagaaaaaaagaaaaagaaaaaatgtaaacctaaatctaaaattagaaggccacactggaaatagttctaatattttctcctttctttccagcttttttttaggagagttagagaagtgccttgaagatccagaaaaactaggatccctttttgttaaacacgtaagcacaatagcattgcttatatcctgttctgatggtgtcatccttagtcactggtttgtcagattaaaggagaactcacttatactttatgtaagtgcgtatgtttaagataaaatcaaactgcatggtgttaatgagttggaattaaaatcccttcttcaacatgagttacctgctttcccagtcacctggctgaagctggctatttggctagcaacagtacaggttggtgagagaagaccagagccaggcctgaacagtatctggggtgtctgtgaacaggcaggtattgttgagtggagatgtaactgtacctgcagtgggtttaacataacagccaaatagtgtggatatcgaaaataagcgtattaacattaaagttttttgttttttgggaaaaatcatgatatatttttagaagttagtgacaggagtttttgcatttttgccagtctctttaatgtcttgctaagtaaaagacagctggatttttatatctgcttctgcatccaactcattgctgtgttttttggttcaagtatccaaacaaatccatcttcacacacatatagttagaaaaggatgagtattttaatagccttttcagataattacatagttttcttagacactataccaaaaacttgacagctgatcatttcttaaaggttagttgcaatacggaatctgaaaacctacccatgaacttctcccttgctgtgacattaaatacattgaactattgggcttcgaggctcctgcagccatgcgcggtcctgtgacatcaggcatcagtccactggaagataccaggtcacagacttaggcagatcttccagaggttgacacgtttcattacacagtatccaaaaatccagtttttgaacttgaccacccatctctttgaagtctttaagtgttgtgaagttcagagtggcagatacatatttccaaaattttaattttttgcttgaaagctgtaattttcactaacaaacactgccagttgtttgccttgaaatgacaggcttattttgttcatgttcaagaaaatgtctagcagatacccaagagtaaataattatagtttgtgtcaatcattcttccaagtaaaaatggtggtccataaaaaaaagtggttagttccactcacaactcggttacataagtgctttttcttgagacatttatcaagtgcaattaaagtgttatgtggacatcatcttgtcacaagaatgttaaaaacgtgtatactccctggttgagttttaataaaaagaataatgtttactcatccaggacattcttaagtgaaaccagttttgttttgttttttactataaatttgtggcagtgaagagtttttgccaaggtgccagcaatttcacccaccattggttttgcacatcagcacagatgtcagcacaacaaaaaggacaactgacatcttagtggtatttagaaaatagttgtgaccaaatggagccactgaaaggactcagggggccctgggggtctgcacactgtactttgaggatcactgatttatggaaaggctcattgtctacattttttttcttctgcctttaggatttgagattaaagagcttcttctctactaaaaccaaccaggcttactaggactgttggcagggtttggagtgatggcagtaattctttgtttaatattaagaagggtgttgcggccaggtgtggtggctcatgcctgtaatcccaacactttgggcagccaaggcaggagggttgctgaggctagttttgagaccaggctgggtgaaaaagcaggactccatccctacaaaaaaaaaaaaaaaaaaattaaaaattagccgggcatggtgatgcacatctgtaatcctagctactcagaggctgaggtaggaggatcgcttgagcccggaagtttaaggcttccgtgagccatgatcacaccactgccctcctgcctgggcaacagagtgagaccttatctctttaaaaaacaacaacaaaaaaatgttcttttgctacctatggtgtttgttggtatttggtactgtaaagtgaagggtttggtgtgtatggagagtgatgggggaaggactggttttggagccacaccgtagaatgctgatctacatcctgaatctggaatttactcccgagagccttagctgtgcagcttggttttaagatgagtgcctttatgaatgtgctgaaatgtgcgggtactcgtgtattctaatcgaatttcccattgttataacccaactgtttgccttttttattcctaggagagaaggttgcacatgtacatagcttattgtcaaaataaaccaaagtctgagcacattgtctcagaatacattgataccttttttgaggtaagacctaagatacaaacagaaagtatttctgaatcttttgttccaacttatttctaaaaatgaaagtatcattggtttcccaggagactaatttccaaagaaaattagcctgagtgataagacttctgaacctttctttctttcctgtaaatcagagaaatgagtatgaatttagtctgtggtcatacccctggcattcagaagactgcagtcattgttaaaaataagagtttttaataagtgttacacttaagtctcattacaaagtcagaataattattatctaaacttatagcctaaaaataatatatatatttatatgaataaaataatgcaattgaaaaaatgcctttaaacaagcataaaagactgctttgaaaaacaactcaggtgaaagtgtaaaacttggaaattctgtgaactagcaaagctctagttagtctagtgctttttttcctcgttacttttactgccagtgttgtagtctttctgacaattacaaagactaaaaaattgccctttaatgaacagcccatacgatcttttctctctcttaaaactgtaggacttaaagcagcgtcttggccacaggttacagctcacagatctgttgatcaaaccagtgcagagaatcatgaagtatcagctgttactgaaggtgaggaggtggcgggacaaactctggtgtcaggagtgagtttgctgagaaaataagactcagttggggaaagaaggatttggtaggacaggggaatcatctgtgtaacaggtatattatttctgataagttaaaccttaaaaatttaaatcagctgttaactgaaggtgaggtggcgggacagactctggtgtcaggagtgagtttgctgaaaaaataagactcagtgggggaaagaaggatttggtaggacgggaatcatctgtgtaacaagtatattatttctgataagttaatccttaaaaatttaagaaaacacttcaaacaattttctcaattttttatttacatcgagttcagaatgaaaatatcagtaaaagtgaattttttttcccccaccacagaccttggaatgctaatgatttttcttctgctctatcaactttaattattttctaatcttcttggaaccttggataaaagtaaatttggaatccttttgtattcctctctgttggcttaacactagcccttgattgagttaaattcttaagcataaccgaaggcagagtcacgtgtttttctgtgataaaagagacttcaagtgtattgatattccttcgtgtacaacgcctaggacctggatctagagagggacaaagagcttgtcttggattaaacaggaacaattggatagatctggtctgactctgtgtactgcagcttgaaatctacgtaggaatgcctttttgttgtgttactgagagaataatatgataaagtagaactaaggcaccagacaggtgtggtggtacacacctgtagacccggctacttgggaggctgaggcaggaggatagcttgaggccaggagttggaggctgcagtgagcttatgattgctcctttgaatagccactacactccagcctggacaacatagtgagagcttgtctatttaaaaaaaaaaattctttcagaactaaagtgctgaaccccaatgtctggccagtgtgagtggccaaaaaggttagcttgtgtgcattgtctcattcctgtagtcccagctactcaggaggccaaagcaagaggatcacttgaggccaggagttcaagaccagcttgagtaacatagtgagaccctgtctcttaaaaaaaaaaataaaaggtcagctgctgttgtctttgtcaccattatcatgtcctctccatttcccttgcaggacttcctcaagtattccaaaaaggccagcctggatacatcagaattagaggtacatgcatcagcggctgtgggcacccaaatccccaccagcctcttttcctaatccccaagtgtctcctaacagtggtctggccctgggagggggtcaaagcagtggatgacagagtctctccagtgcatctccataagccctgcacactagagggtggggaggaagaacagaacttcatcaggtcagagggtgagcacgtcagattttccctagaggaacttgagctttcactcttctctctcccctcccacagagagctgtggaagtcatgtgcatagtacccaggcggtgcaacgacatgatgaacgtggggcggctgcaaggattcgacgtaatgcggctcttgttttttaagagagctcctctgccttcatctctttcttttgtcttggattatttctctccacatagagaaagctgatccttttcacttggttttctggcttctctcactttacctcaatctgattgatattttatttcctttttttttttttttttttttttggtgcgtttggtttgcttttttgggacttgcctgtgctcaaagcccagtgtctcatggcagaaacaagcaggaccgggctttgtctcttgggcccagtactgtaagagctgagtttcctttcctcagcacttaagaccatggttagctatggatgtagtaggacctcggaggtccccactctctcatctctgggacttgatacttcctcattagtttaagatatgtttgcatgagttgctagactattcatattacatattagctattacatatcctcaagatgaattcagaaccagaatcttcttttaaaaatttgactacggagttaaggaggcaggagaagtttttattttcttgcctactgttttgctagagaattagcattgaaagttctggtgctatggttctctctgacgcacacacagaggccgttggagggcttctgaaaactcctgtgcatgcctgatgagttcctgctggcgacccagggaccacactttgagaaccactgttctagtataaaccagacatttaaaactccacttttaatctgtgactgtaattgaggcgccagaggtctatacaaatgttggcaagaattttatttagataattattctgtttagagccaagaacagtaaaagaaaaaaaaaattaaactccataaattaataaaagaaaaatacattattccataggaggaaatctaaagaaaacagcttcagataacttagaaggcaatgttttcttctccccttccttttccccctttatttcttgttttaggggaaaatcgttgcccagggtaaactgctcttgcaggacacattcttggtcacagaccaagatgcaggacttctgcctcgctgcagagagaggcgcatcttcctctttgagcagatcgtcatattcagcgaaccacttgataaaaagaagggcttctccatgccgggattcctgtttaagaacagtatcaaggtaacgtgtgtctctgtgtgatttctctgtgccagcgcatgtacccgtcacaccgatacactgtttccttttaatgatgacataccctgatgcttcgtttaagtatttgagaattttctagtatatttcagagccttgaattcaccccatttctctttttactgtctgtgttcttgagtggctgatgtcttgtacacacctctgtgtaaccacagccattcattcttaccatgatgagaactggtcatgggtagtgtttatgcacccccttctctaggaccgaggaaaactggtttaaatttgatagcacggatttgggggattgctctatgatcagagaaaaagttcactcggtgtcttcttctcttcctccactcaccaaggaggtactgagcactcagcaacaggcgtgagggctccaggaatggcccagctggatgccctccctgccctgatgtagcttatcctctaataggaaaggaagacagagggacaaagaaaataattgccaatggccctcaagtctgtaaaagggacaaaccaagggtgaggtagagaagagcagagggcaggcctgaggtcccagcagatgactcctgggagatacatgcccccgccagggtcctcctggctctgcagctgtgcagaccctgaggtcagaagggagatgtacttccctttggtagggcctcctgccctacgccatcagggacagggaactctcagaccgtgcacacctgcgggcctcacagcacacaggcagaacattgcgtcctcccccatccgactctccgttcaggcttttgttggctgtccccagcagcctccatttgcctaaacctggggtgggtctgtccgtgggcacaggtgccaggctgggggcctctgcccaccagcacctaggagggctctggagccaaacagctggagaaggaggccgcctctgcatgaggctgggctgcgggccctcgcacctcccaccacccgcctgcccctccagactccgccttttgaggcccctcaccctgaggccatgtcaggcacagaccctctgggctcaccactacacttgagcctcccatcccctgaactgtgcgcccatcccctggacggcagccatcatctgaactgtgcacccatgccctgaactgtgcacccatacgctgaactgcacccatacgctgagccgcacccatcccttggactgcagccatcatctgaactacacccatcccctgcactgcacccatcccctgagaaccacccatcccctgcactgcacctatcccctgagaactgcactcatccatcccgggcactgcactcatccatcccctgcactgcacccatcccctgagaactgcctacccattcttctcacaagtcttttggcagaaaatcactccagcactgtaggaatttcgtatatattttttacatatttttataaaattatttgacatattttaatcatgatatcacatacaattttataacataggttttagtgatatttgagatttgtttaatggtgtcatttactccctgggaagtaagtaaggataaatactgaggcatcatagaggggtttgggaaacaggtaatcccagacgcatatttctagttaattgttcaggctgttagttcaaactattagtttaacagccttgtattccccatgtacctgagttaagaggcattaaaaagcttcagatgttttctgaggcagtaaaaatggcagttcaactgaaaagtgcttgtttcaggattgagttaggatgaacttcactttgcacttggccagtggggatcaatgtgctttaattttttgttgtggtaaaatacacataacataaatgttccatctttaattacctagctccatgggattaagaacattcatgttttgcagccatcaccatcatctgtcttcacaactcttcatcttgcagagctaaagccctgtacccattaaacagtaactccccacttccccacccccaagcccctggcaacctccactctacttcctatccccacatttgactactctaaggacttcctgtaagtggaatcataacaatagttgtattttgagactggcatatttcacttaacataacgtcttcaaggttcatccatgtcgtattgtgtgtcggaatttctttcctcattaaggctgaaaaactgtccacatagcccacattttctttgtccattcatcggtcagtggacacatggtttgcttcctttccacctgttagctattatgaataatgtttttttttttttaaggtgagttgcctttgcctggaggaaaatgtggaaaatgatccctgtaaatttgctctgacatcgaggacgggtgacgtggtagagaccttcattttgcattcatctagtccaagtgtccggcaaacttggatccatgaaatcaaccaaattttagaaaaccagcgcaattttttaaatggtaatgtgtgttctgttactagatgtgtgctttctttcctcgtgtactcacttgtatttatcttccctctcccattcatatccatagtaatgacagaacttagcactcaccactcttcaggcactgcctagatattgctttatttcatcttcacaaccaccctgtgtggccagtactattattattcctgctttacagatgagaaagctggggcactgagcggctgagtaatttgcttcgagtcccacaagttgttgagggcagagtcaggacacagagtggccatctggctcttggtctgtgcccctcgcagctacactgtcccacacataacatgtacgagggcccagtcctaggaagaggagtttgcgagaacacgagatggcattggccagagacattcacgagggccttgcacacccacacctcctttccccattaaaaaaataagagatggggccaagcatggtggctcaagcctataatcccagcactttgggaggccaagttgggcagatcacctgaggtcaggagtttgagaccagcctgaccaacatggagaaaccctgtctctactaaaaatacaaaaaaattagccgggcgtggtggcgcatgcctgtaatcccagctactcaggaggctgaggcaggagaatcacttgaacccaggaggcggagatcgtggtgagctgagatcgcaccattgcactacagcctgggcaacaagagtgaaactctgtctcaaaaaaaaaaaaagagacggttcagtacttccctgcttccgtgacttgagggattgcagagatgctgcagaacacagcgggcgtggccacactacccttccattgcctcttaatgtatttgatctctttgcaaatgttggcttcaacactggcttttaatttggtgatcagcaaagaactttgagaattcagtccgaagctatgtgcccatgtcatctgtgtcttctgggttctttgcttcatgttcgtattcacggtctgcatctatgcctgctcaagctcaataggatgttgtaatgttctctgtcacaagaaagccacctctacaccttgcgtgatgttcaagagccaggaacataggcactcagtgaaaaatctcaagcctcatggcatttttagccaagtgttatgtgctgcctgggtgttaactccaagtttccatcctgcttgcaagctgataatcatttacatctgcagctaggggtgggcgcttgaggatagggaggcacagttcctcaggtgcgaagaggttcaatgtggtgttcttatgtggtgcattgagttccaatccatagcttggaattgagaatgctctaaattttcatcattgtctttaaaatagaatgaactgcccccagattgcacgcatggtctgtgatgtcagagtttacttgacacccactcagttgagtaactagtaatacctatcccagaggattaaaggagatcgctcatgggctgggagcttgggaccctttcacctgcttcttgcacaccccttagtcctggaagaggctgtggccagcacagagtttgtagactgcctctggctcctcaacgcttgctcacacatgcctggggctggggctggggggctgcatctgcttgtcgtatttttcaaaggctttaacacttcaagagtttgtgcatgtttccatacatgttattttggcctgatttctgtgtttttctacaatgaagatgtaagaaaactcaggcacccaagtcaagagatgggacagcctcccgctccaggggcctctagtagctccttagcttccctcagggctgtgttcagcctgcagagcagaggtggtctatgaaaccgcctccacggcagccccagggtttctttttcaccccaggactctggtttaggaaagacctttgcggaagccagttggtagctggaggagttctagtcaaatctgttgccttggtcttcctgtggacactggcccttagtccgggatgtgctgaggaatgcggccccttccacccgctgcactcagccggcatcccaataccttggcaagcaggggcctcttctagctctcctgatgggtggggttgctctgcgcccctgcacggggtctgccccatgacccatcccagggtgggccctgttcctccctcaccccgcggcgtgctccttggcgccctgacccagtctctcccgctgtcttgtcttacagccttgacatcgccaatcgagtaccagaggaaccacagcgggggcggcggcggcggcggcagcgggggcagcggcgggggtgggggcagcggcggcggcggggcccccagtggcggcagcggccacagtggcggccccagcagctgcggcggcgcccccagcacgagcaggagccggccctcccggatcccccagcctgtccgacaccacccccccgtgctggtctcctctgcagcctcgagccaggcagaggcagacaagatgtcaggtacgtccacccccgggccctccctgcctccccctggcgcggcccccgaggccggccccagcgcgcccagcaggcggccccccggcgcggacgccgaggggtccgagcgagaagcggagccgatccccaagatgaaggtgctggagagccccaggaaaggcgccgcgaacgcctcggggtcgagcccagacgcccccgccaaggacgcgcgcgctagcctgggcaccctgccgcttgggaagccccgggccggggccgcttcgccgctgaactcgccgctctccagcgcggtcccttctctcggcaaggagcccttcccccccagcagccccctgcagaaggggggctccttctggagctccatccccgcctcccccgccagccgacccggctccttcaccttcccgggggacagcgactccctccagcggcagacaccccgccacgcggcccctggcaaggatactgaccgcatgagcacgtgctcctcggccagcgagcagtccgtgcagtccacccagagcaacggggtaagcgcgtcggggggcccgcgccctcccgcccccctgcctctgtcccgccagctctaaacgccaccgcggctgttctcactaactcggctgcccagcgctctccgccgcccgttgcggcctctacctgggaccaggctaaccctcctgcgggccggcccacggcgctactaactactccttgctttgttcgtgtcttctaataagagcaagccgatcattaaccttctcaacgcagcgtcttttggtttcttccatttccaaccagcagaatatcttcttggaactttcttttttaacctctgccttcctcacgcacctattttttggagggttccttttccctgctctctacctcctgtttaaattgaaacctgtacactttaagctttttgctcatcgcttggttttgctcttttatgccttaaattatctttgcggcatttttgactcatctgctggggaagaccattccctcaagaaaacttccaacagcaactcaaagcaaactaagatgaaaaaatggggggaaagaatctgtccactgggaacgctttacgtcaccgtgttgctctggaagacagagactgctctgggcacctggcgaggcggctctgcagtgcaggctggggccggtccctgcggcctgctgggctctggcctcgtttggcccatcactcatgctgccgtctcaagcacaagggttgctgtggtgggttttccctctgtttcctgcttcctcactgtcctacccacctgtttcctacagggcagatggcctggcccgtaacactttcctgaaggcatgcgtgagtgaatagaactgttctaatgagtgtatgtttgaacgctttataaatttttaaatacatttctctaaaagggtctgtgtctctctttatattaaaaaaaaaatctagcttttgcatgtctttctctttcctctggacttattaatgccttaattggtttgacttggtcttatcctttcctactattttttgttatgtattttgttaaactttaattggggaagaaattaacaaatgggtcttgatacatttatttacagttgaagtggccgggtaggcatccgctgtcatggccaccgtactgtgtcctccagagcaaggtggcctttcagttaggttggacgtgctaggtaggcaggtatgctaggcgggtgagcatagatttgagtccagtgtggggtggtggggagatgcagtcaacccagtgacgggctatacccgtcagcacttagttggatactcagtatccaggtgtggccttatagctgtgaccctcgctgaatctgccagttagcatctagagctcatcatagcctggacacattcccattcagtacgagaggagatttcagagtctgtgtttcaaaattaacacttcaactgctccaagacaggagccaatgccagtcttctctggacattcatgagaagacatgaaaaatggccacaccctggctccatcctgaatgctgtctctgaggccaaggcgcaatctgcaagtggcacgtgttcccgcgagctttaggttgggaaagttgcttttgctttctctctttctcttcctacttgttctcatgtggcagggaacctggaaagggaacttgctgaacaggatttcagacaagtcaagatgccttacagaaatgccctaaaggcctaggaagactccagagctccaaaatggggctttaaaaatgccctctaggctgggcatgatgtctcacacctgtaatcccagcgctttgggaggccgagacgggcagatcacaaggtcaggagttcgaggccagcatggtgaaaccccatctctactaaaaataaaattagctgagcatttaaaattaggtgagctggcacgcacctatagtcccagctacttgggaggctgaggcaggagaatcgcttgaacccaggaggcagtggttgcagtgagccgagatcgtgccattgcactccagcctggatgacagagggagactccgtctcaaaaagcccccacgtatttgcacttctgtccccctggagatctgcaaaggcctccttcctccttgatcacttctgtcaagctgtctgtggtcacagtcaagcagctgtgcccagcccacagcccggctccctcttccccctttagatgagcagcttctgcaaagctctgctgacagcaggagtgacatggatgtggatcaacccaaaccatggctgcaccagtccttcctgcagctcagtggtctggccttttggcctgctttattgagcagcaataaaagtgcatgcacactggagtcactccagccctgcctttcttgcacaggccaggtggccagtgccagctcactgaccttccactctgagagactgataaccacgcccactggtgggttggtggtgagaattaagcaggatagacttgaaatgcctagtacataggagatgcccagaaaatactaatagttaggattgtagtagcaaaatactctaattatgagattgtagcctggtatattaccaaaagcagctgtgctgcagaagttgttttttgtttacatattcttggaaatttagctttgtaatctcagtactcttgggcattgccatataagtcagaatactaaagtccatgctaaaagtataatgcataaatgagtatgcacaagccaaagccttccctgtacagcacgcttttttgctgaagagccacaggcaaacagtgggcacccacagggacaagaacaggaagcagactcctccacggcagagacaaagaacaggagctgggcagcaccgccatgtttttaagtatgcaccacaggtctagattcatagccctggcacctggaattcccagtggctggcttgttggctttctcaggcttgacctcatggaggagggccagaggtctcttccctctggtccttttggccagctacagcagtccgccacctgctccagcgtgtactgatactggctcagtagaccagggctgagaggcggtagagcagggttatctgacaaattgcatctgcactgacccaggatctgcccagggcgtcggagagcccagcagaagctagcacctttggagccttgggaacccatgaacatcccgacagtaccctcagtggaagcctttgagcacaagttcacgggaacgaggcaccagatgccgtttctcacatcctaacttgatagaggggacttgggcaagatgcagcttcaggcgttggcaggggatctgcatttcttctccacccagaaccataggccacgcgctagatgagagtgggacaaacactgccgtttgtgtttcttctcaggagctaacaccactctgtgtgtggcctgggtagggccttaagaaatctctgtcttgctgttgcaatcctgcctcactgaccgagtcactcaccatatgttgagttcctgctgcatgtcagccctgtgactgaagagatcgggtcccacaggggcagcggtataagggtgggggtacgcatcccacaccagaatccgttcccaaagcttgagtcacagcacctggggcgagtggcactgggatgctttgtgatatgttcccatggcagcagagccttggggacacttgagtcatgcaagttcataagagggacacctagcaagttcgtattgctggagacagagtcgctctccgtatgagcagaatagtgatcgatttacgttcaggggttccatgttcttctttttgaagagacgaagtagaaatgattaggcatgtcagcaacttagcatgattctagagtatgcattcccaatgaacattctatctggaagatttagggacttctctgttatctaatctgtcagtgaaatgaagattaattttgcatcaattaattctaatacctttttttaactgataatgagattcacagtgatgtggctatgtttgcttaggagtaacctaacgtggcgtcagcaggaggactaagatgttcccgtgagggtgcaaggaagaccacagtggaacgagcttccaaaaccaaagagtcattattgcagtgaattttttaagagcgtccctaaattgctttctagagaaattacattttcagttattgaaatagatgcacacagttagccagagggtaaaggaaatgttgaaaatttctcggtgcttgcctggtgagccctgcacggggtcatggtgccatggggcacactgacaagggatttcatgtgatcaggtctcgtttcagttcctccctgcctttctctgtcttcatctgtccctctgcagagtgaaagcagcagcagtagcaacatctccaccatgttggtgacacacgattacacggcagtgaaggaggatgagatcaacgtctaccaaggagaggtcgttcaaattctggccagcaaccagcagaacatgtttctggtgttccgagccgccactgaccagtgccccgcagctgagggctggattccaggctttgtcctgggccacaccagtgcagtcatcgtggagaacccggacgggactctcaagtgagtgcttgacagtaacggcgtcctggcaggcagcagagggagggggcacagcacccgtgaggcacacgacctcagacggggtaagcatgtggaagggagatctgcgctggtatgttagaacaggctcagctctgagcacgtgggaagatgggtggccttccatctcacacactcagactcacagggtctttgaataatctgcatttagaaatagtctgttctagcacattgttgaggaatcccatttgacatttttgtgttagtcataactcaagaaagtgttgtttgtttgtttgtttgtttgtttaagaaacctaaggggaaaatatcccctatctttgtttctttgacatacattcttaggccgcatattagtcagggtccttcagaggagcaggaccagtagggagcgtgcggagatgttggcatagacacaggcacacctcaggttgttttgtgctttgctttaatgtgctttgaagacattgccttttttacacgagttttgtggcaaccctatgtcaagcaagtctctcggtgccatttgtccaacaacgtatgctcacactctgtatttgtgtcacattttggtgattctcaaatatttcatgcattttgttattgtatttgttacggtgatatgtagttagtgatgtctgatgttaccattataattgttttgaggaacaatgaactgcacacatacaagatgccaaacataataaacgtgtgttctaactgctccaccaactgtccattcccccatgtgtctccctctcctcaggcctgcctgagacacaacaatatcgaaattagaccagttaataactctacagtggcccctaaatgttcaagtggaagagtcacatgtctctcactttaaatcaaaagccagaagcttagtgaggaaggcatgccaaaagtggatataggccgaaagctaagcgcctctcgcaccgaacagttagctaaattgtaaatgcaaaggaaataaaagtgctaccccactaaacacacaaatagtaagaaggcaaaacagcctttgctgagacagagaaagtttgagtggtctggatagaagatcaaaccagccacaaccttgccttaagccaaagcccaacccagaacaaggctccatctctctccagttctataaaggctgagagagatgaggaagctgcagaagaaaagttgcaaactagcaaactagttgattcatgaagtttaaggaaagctaatcctgtaaaataaaagggttaggggctaatgcagctggtggctttaagttgaacccagtcgcatttatttacccttctgaaaatcctggggtccttaagaaccatgctaattatcatcacaccttatataccaaaaggttaattcagttaagaaacatgaagccggttttgctgcactgagtattattttactgaatttgatggcagtttttacaactcttcatccccctggaatgcctgctgtggtagaggcatctactctgcctgtgctctagaaatggaacaacaaagcctggctgacagcacatctgtacaccatgtatttacaacacggtttactgagtattttaaggccagtgtcaacacgtactgctcagaaaacaaaaattctttcaaaatattactgttctttgaaaatgcacctggtcacccaagagctccgatggagatgtgcaaggagattcgtgttgttttcttgcctgctaagacaatatccatgctacagcccacggatcaaggagtaatttggactttcaagtcttatttaagaaatacattttgggctgggcatggtggctgacacccatcatcccagcactttgggaagccaaggcgggtggatcacctgaggtcaggagttcgagaccagcctgacaagtatggtgaaacccaggctctattaaaaatacaaaaattcgctgggcatggtggcatgtgtctgtggtcccagctacttgggaggctgagacaggagaattgcttgaaccctggaggcggaggttgcatagagcctagatcatgccactgcactccagcctgggcagcagagtgagactctgtctcaaaaaaaggaaaagaaatacataaatacattttgtaatgccatagctaccataggcagtgatgcctccagtggatctgggcaaagtaaattgaaaaccttgtggagaggattcaccattccagatgtcatgaagaacactcatgaatcatgggagaaggtcagaatgttaacattaattaacagtggtttggaagaagttgatttcaaccctcatggatgactttgaaggttttaagacttcagtgaaggaaataactcagatgtggcagaaacagcaagaaaaataggatcagaaatggagcctgaaaatgtggctgaagagctgcaatctcctcatcaaacttgaacagatgtggagctgcttcttaggggtgcgcagagaaagtggtctcttgagatggaatctactcctggtgaaaaggctatgaacactgttgaaatattggcaaagaatttagaatattacataaacttagttgacagtgcaacagcagggtttgaaaggattgattccaatttccaaagaagttctactctgggtataatgctatcagtgtcacatgctgcagggaagtcttttgtaacaaggggagtggtggcaaatttcttgttgtcttactttaagaaattgccccagccaggccaggcgtagtggctcatgcctgtaatcccagaacgtttggaggctgaggcgggtggatcataaggtcagagttcacaaccagcctggccaacatagtgaaaccccgtctctactagaaaaaaaaaaaaaaaaaaaaaaaaaaaaggccaggcgtggtggctcacgcctgtaatcccagcagtttgggaggccaagacgggtggatcacgaggtcaagagatcgagaccatcctggctaacagtgaaaccccatctctactaaaaatacaaaaaaaaatagctgagcgtagtggcaggcgcctgtagtcccagttacttgggaggctgaggcaggagaatagcttgaacccacaaggtggagcttgcagtgagccgagttcgcgccactgcactccagcctgggtgactgagcaagactccgtctcagagaaagaaattgccacacccactccagccttcagcaactaccaccttgatcagtcagcagccatcagcatcaagacaagaccctccactagcaaaaacagtacaattcactgatggtgcggatgatagcattttttttagcaaataaactgtttttaattaaggtatgtacattttttagacataatactattgcacacataatagactctagtatagtataaacttaacttttatatgcactaagaaaccaaaacttgatgtggctcactttgttgtggtagtctggaaccaagtccccaggacctctaaaaggtatgcctgtctagaagtggatttatgatgagaaattgcctcacatagttagggagactggcaagtccaaatctgcatgtggaccagcaggcttcagaccccggagagcacgtggtgcaggctgagcctgaagacagtctgctagagaacgccctcttgcttgggagaccagactttttgtgttcccttaaggccttcggctcattggatgagggccattcaccttagaaagggcacatgcctttactggacccatcaaaatgttcatcttattcagaaacaccctcacaggaatacccagaataatgtttgaacaaatatctaggcgtcctgtgacccagtcaagttacacataaaatcagttatcacaggcacctttatattttcatcctcaaactttaagagattgttggttttatctcctggttcttaaaaaaaaggaacattttctctaacagaggtcacagttcgtagaggatttcccatccccctgcacacacatacgttgaatattcagcttttctttaacgcttccaggcagcacttggtgaatgttggaaaggcataatacccacagtgtgttcatttcccctaggaagtcaacatcttggcacacagcactccgtttaaggaaaaaatctgagaaaaaagataaagacggcaaaagggaaggcaagttagagaacggttatcggaagtcacgggaaggactcagcaacaaggtatctgtgaaggtgtgttcgggggtcttcaggagtccgtgtcatcccagcatgagagaaaggatcagggagggcagagactctgcagacctgaagctgggcttgcttatgacctccctcccacccaccagccccgtgccctgcgtgtcctgtagggtcttgttaggggcactatgctggccagcacagggatgggtgcgtcctacaaggaaccaggtagacccctgcacacttccgcaggtgcacatgtggcttctaaagaatatggttaggtttgcaaatgaagcacagagactaggttctcagaagcagcgaaggtgcagagaagctatggctcaggcttccttcagtgttcctgccttaaagccaaggggaagtggctagatgtgggggtgcatatgggctctctggctgtgacagatccccttggggacaacttcagtcagctttagtcctataatcggattgcctgacacctgcggtgggggttgcctggagaaaaagaaggtatctcctgaaagggactctgagcgccaggggccagggcgttggcggctctgcattaggaacgcatctgaggaccagctggactcagcctgtagcatgagaaaaacacacatctaagcagtgtttttgtgtttgtgggtaggaagaaaaagacccacccaaattagtgtgacatgaaacttttgagtgcagtgaaaatgtggtctgttttgattgatgcccaggcaagtcagtttctgcaaatctttcaacaataattgtagccctggaatgaaaggaatacaccttaaagtagctcatttcagttaatgcttgtttgctgtttccatttcagcttctcaatcccaactacatttatgacggtgagttctgttctttttcttctagtcctagagatgattctagacctgtggggcatgtttcagagcacttgagtgtggcctctggaaatgagttttccgtggcgctctaggcgtgcatagcaggttaggtcctatcaatctgtcggggacatgtgggtgggtgtggaggaggagccagggctgatgggcctttaccgactcctttcccatgcagttcccccagaattcgtcattccattgagtgaggtcacgtgtgagacaggggagaccgttgttcttagatgtcgagtctgtggccgccccaaagcctcaattacctggaagggccctgaacacaacaccttgaacaacgatggtcactacagcatctcctacaggtgagggaggcccactcctggtgggtttcgctggctgggagcaccatcttgtcacttggcaactggaaattcctccttcacggatggatttctttggctgccttcggcactccacttcttccgtgagagcccatttcacgcctgggtgtacagctcctcatcagcacttgagctcctgccttcccttgatcctgaaggaggaggccagcgctgatggccacgtgctcagcttttctgatgcgcagtgtgttcccatctgtgccgcagtgacctgggagaggccacgctgaagattgtgggcgtgaccacggaagatgacggcatctacacgtgcatcgctgtcaatgacatgggttcagcctcatcgtcggccagcctgagggtcctaggtaagcaccgtgcaacgaggattctacgtgacccagtggggcacgtctttcaggagtctccttaagtcctgagtctgcccttacactccaagtggcctgaaagatagaacaataagtcatttgtggggcttcaaaagacagttgtaagtagcagaccagagtgtctgggatgtcacaggagagtgacctctcggcaccttatgtaaagtcgggggagacaccggagctcctgttgctgggaggaggatgggggcctgcctggtgaaggcctctggctgcccaccatggggcaccagggccccccacgaccagcttctgagttggagcagggtgctttccgtgctcctagtactcaaaacactcatatccagctacccagctgaatctggatctggtctaggttggtctcatgtagaatgtgcatgggaaaagcaggaaaggagatgtgggtgagtcccgggcctgcgcaggccctgtgcctgtctgagaccctaacagcaacccttctgggtgaatgcacgccctcctcaccccatccaggaggagccaggcccagggcggctcagtagcttgtccagagcatctggctaggaggcatctgccatggggcctgcttgctccagtgtgaagagcttgttctttctcctcagctaaaccacaagctccctggggcagaaccaatatcttaggctctttcaaaacgtcctgtagttgcctgatgtagatagctgctgagaaaggtgtggactgttctctgctgccatcttgcagaaggccggccatgcagtactgggctgcaccacaaatggaggtgcctccagaggacaaataaaactccaaatgaaagataaattgagtcctggagcaccccgtctgtagacaataagcagaatttgtcttagaacttttgtcccagatatcttaatttcctgtttttaacaacattaaatcagaagacatgttctgattttttggatcatggaacaagaaatctaaaactctagaatttggcagtaaacaataaaaggtaaagattttctaatttgtaaataacacagaaattacacaggtgattttttttttttaatcactggcaaaagctaaaggactttagaaaggtatactattcagctgggcgtagtggctcacacctgtaatcccagcgctttgggaggccgaggtgggtggatcaccaggtcaggagatcgagaccatcgtggctaacacagtgaaaccctgtctctgctaaaaataacaaaaaattagccggcgtggtggcaagcgcctgtagtcccagctactcttgaggctgaggcaggagaatcacttgaacccaggaggcagaggttgcagtgagccgagatcatgccactgcactccagcctgggtgacagagcgagactctgtctcaaaaaaaaaaaaaaaaaaagactattcataccctggaaatgcaaatgggaaaataatccaagtgtgtagttacttctatcacacaaattcagctgcacccctaaaggtcttcagaagaattatcttatgtggactattccaagatgatcttaaccatttccaaattgttctctgagagaagccactttgtttgcaggcatcagtaattttgtgttttgttttaaatctacccttggctccactcctgtctgcctgaggctattcctgcacccacaagctgtctggggtgtgcgccctcattctctccagccctggctgccttgcagagccccagttctcagatgctcaggaaacaaagccttattctcagtccagctctggctcaaggcaggtagctggtcagagtctgggctatgagaggggagtcctgaggctggaggcattggccctgcaccctgaggacaggtgcaggcccccaaactgtgtccgagagaatcatccaaagagagccctgtcatcccaccagccagggccgaggcttctgttgatgagaaaagggggccaggtgcagtggctcatgcctgtaatcccagcactttgggaggccgaggcaggtagccatggcttgagcccaggagttagagaccagcaacatggcaaaacaccatctctacaaaaatacaaaaaattagctgggtgtggtggtgtgcgcgtgtggtcccaactactctggaggctgaggtggggggatcacttgccacctgggatgttgaaattgcagtgagtcgagattgcaccactgcgctccatcctgggtgacagagcaagactctgcctcaaaaaaaaaaaaaaaaaaaaaaaaacacacagggaaaaagaaaggtgtgttttagaggagccagggagcacctgcccactatgatgctctgtctctgggtctggttggtggtcacagagtcgccatttatgtttggtccacttttctgtatatatgtaatgctcgaataaaaatgtttatttaaaaaaaagaaaaaaaaaacaccaagccctttcagttaaaaaaagaagaaaaaatatttttatgtaaataatagtccaatatttcttaatgtgagttggtagatgcttcaaatctgcctagtgaaataattttatttttattaatgcttctctctcagtactccttcacctgcaaggtcagaattaaccttaccatttataaagcactttaaaggggtgcaaatgtgccagcattaacaaaaaaagactgcagaacaaaacgtagcctttggtttaagtgattgacgtgaaattattgcttctcgtgtgtccttcagtgaagatttgaggctttgtgtgtgccaggcattcttctggtttctgggaggctgcagaggtggatcagacacgggttcacttgtagtcatgtagcggtcagcagtactcctgtgacaacagtgctagctggcagcacatggcatccaccaggactgcccactgctatgtgaggagatgatttccagccatgagtgagtcagggaaggcacatggaggaggtggccaccaccccagggagcccaattagacaagtcagcttggattggacatggtttaaggaaacgcattcccagtgacaacctggggagaggtgaggaagcccacgtgaagatagggatgggcagatgctcggcctgggctggactgcaggtcaggtgagcgggccgaaagaggggagaggaaactaagtggggagaggaggctggatgagtggggtcgggagggccaggctcccgtggaggcctagaatcacagtggcagctgtgcttcccaggggctgcctggcagcaggaccacgtggggctcccccacttagtgcttcttttcacaggaagactcttgaaaggatgctttctgttcctgtggacatgtacacagggttcattactcacaggtgatttacagttggcacttttataataaaatcctctttgtagtgtatttatgattcattaaccatgtaaaaccctgtggacgttaagtaaatactgtggactcttgatctctcacggctgtgaaaggaggcgtggggaggagagagcaacttagcctcgaggtggtgcggccaggtgaacggggaggaccatctgtagcagtgctgtccaatagaagcaaaaagaggccacatatgcaagtttagatttttctagtaaacacattttaaaaataaaagtaaaagcagtttttactaacatgtatttaatttaatgaaatacatccaaagtattagatttcaacatgaaatcaatatttgaaaaatcattagtgaactattttgcattcttccttcacactaagccccagtgtctgtgtgtcctttatgcagccaccacatctccactcgcatgagccgtgtggcaggtgcccggtggccacgcgcagctgctgtgagggacagtgcgtggcgatagccttcttacccaagaagctccacgggaaacaagctcaggcaggtgctgttcttcttgcaggtccagggatggatgggatcatggtgacctggaaagacaactttgactccttctacagtgaagtggctgagcttggcaggtatgatgcacaacccagaacgccttccgaaagagcagagcgtggggaagacataccagagagtgcagggataaagctaagcagtgttatcttgccagcaattggaagctgtgtgtcttgcatttgaatcgtaactctcattgcctttagacgctaaacactggggaagtaaggaagccattttccactcgggttccagcagagagggccgaatgccaccagtcacccctcaatggggagaaattgcttccctctgtgaatgtggaatagtggtagctctgtgccgtccttgggagagttcaggagtctttcaaacgcttcttgtagttcttaatcctcttgtgcccttcacgtttcatttgtgcatggagacttcaaggagtgacagtaaaattagatgcacaaactaagagagaggtttccccatcaaaggggttctttctcttcatgaggggcagccgagtcaggggtggcccagcagtgccatcagacagcccggcttctcttggctctgcctccagggccacacagcacacacattcaggtgttgtgtcccatgtggcaggaagagcaaggtcagaggagcatgacagctgtcctttgtcccttggtaagaactcccccagaaactccagccagcagcaccctctggcattcattcctgaggtcataactagtcacatggctcctgttgctgtctctgtcagctgtctgtggctgcataaaaagtcacaccagcacatgctgtcttaggacagtggtgacatgtgccttcttccagtgcagtgggcagatgggaccattattctgttggcctctcctggcctggtcagctggtgcaccatgccccatgcgtgtcagaggcgttgtctgggacactggcctctttccacatcgactttcaccctgggctcccccacgtgagggcagtggcatcccagaacagcaggagcaggagcgtcaaggcctctgaaggcccagcctcagaacgaccaacgtcctccacatcctgtgggccagagccagccccaggcagccctgattcaaggggacgaatagcccccgcctccgagtgacagaagtagcaaaaccgtggcctttaaccacacagtctgcccgccacaggcgcatctctggtcctcacatgtgcagaatgcactcacccacctcaggcccccagcccaggcccccacctgaggtccaaggcctcgtccagatcgcgttgagttgtggccagtccccaggagtgggtcatcaggggcagctccagggtcctcgtgcctgccccacacacccccacaggggcgaggctgaggcagtgaccacagcagacgcacctttcaaacgtgcagggaaaggtggctgacgggaggcgtgagcagccatcccagcttctgctcgtcgtgggaagcagaagggagtcgcccggcaaggccaaggctcagaggtcttcctctgtcacttccaccacacgcagtgctgggaaagcagccaccgacgtgaggagaccaaggctgcctgggaggaaggaccagcagaaccgcgtggctgcggggacaagggcagatttgggggacagccatggcaccacagcccctccgtggagtggccgggagagcagggcctctggacagggctgggccaccacacagccagtccatttaggataacagagtctttctcggtgccagacctcagcagcctctgcaaatggtccccctgacatattttacaggggcagattctctgtcgttaagaaatgtgatcagaaaggaaccaagcgagcagtggccactaagtttgtgaacaagaagttgatgaagcgcgaccaggtcacccatgagcttggcatcctgcagagcctccagcaccccctgcttgtcggcctcctcgacacctttgagacccccaccagctacatcctggtcttagaaatgtgcgtacacacctggccttccctctgcccagccctctgcctccacctcagggggttttgttgttcctgtttgttctctaagaaggatagaaattgggtttgtagaatttacagaactaaaaaacatcttcactgtcagagcccgcagttttcaagccttccagtaatggcagaaagcagtgtggtcttccacagggcggttgcctgatgaagggcagtcactgctgggatggaacacctgatatgctcagccaacccggagatgcaccccccccaccccttttctgaaggtcccatgaggccaggctgtctctggtgctgaacccaagcccccattagtggttggaggctgacctgataccccaagcctgtgcagggccagctcaccccggatcagcggggtgcccctcaggcctcctgccaagtgaaggccagttggatgggagggtaagacgcacctccccgcagaatgtcctccgaagagggggcgcgggcacaccaaccagagctgcccctctggtccccgttgtacttactgggctcctgtgtaagatcagaaaataatttagtcacgtcaagaaaagagtttgaaacctgtgtcccacaggagcggttctcatctaggggtgggttctcgtggaaatgtcaggagagctcaggctgggggtgagtccggcagggagcggccggaggccagggatgccacccaacctcctgcaaggcagggacaacccccatggattcatccaccccaaacatctgtgcatttagctttgaaaaatgtcgattcctcctttttagggggagtcattttatacatttacttgcatttacagctgcttttccatggggaagggtaaaaccttttgtcaccatttgggaagtttgcatagcttcttcagtgggaaggataggattagcagggcgcccccatggggtcatgtaggggcagactcaagctcggggcccctcgccggcaggaactccctccaggccctgtacctgatgttgtagttattgtcatttttttcttaaagaaactataaatgcctccccatacccttcctagggcaaggctgccacagcgtcccacatggccccacatgcagccttaccagcttcctcgggccgcccatgtgccatgggtgacagtgggtgtctcaggaaggcctcccacccatggctgcacagctagaacctcccccagcacatggggacgtgcttccagcccgtctttcaagaatagaaaacacatctcatggcagaagggcagacggtggggcgcagtgaggctgagcagtgtgtatggagaggaggtccactggcctcgcctggcctcagtccccgccctccctctcatcggctcatttctcaccctggtgtccttaaaagtcacactggctttggagggttgtcgtggggccgagatggggcgatgtgtgtggaagagccgagccgacatccaagccgaggcctggcctgggagcctcaggacccgggaggtctcctttctggctccagacgctggtgaccaatggccactgctcaccttccctggggagttttaacaaaactgtggcttgagtgcttgtcacaaatctcctaaaggccttcgtttctggactgacatttcagtgctttcagctgtcatttctgggaaacaaaatggtttggcctcaccatcctgttaataggatccgttttcatgacagattactcctgttctcaccggcgactccccattgctagacaggcagctgatcttcctacagatttctgttttgcaaagagagcagcataggccggtgttgagagaggtgggggccagaccacctcagtccaatcctggcttctccactctggagctgtgggaccttgggaacgtttcatgctttctctgtcctgagtttcctcgtgtatcaaatgggtacactaaggcccacttcacagagagtcataaggattaaatgagttgttagaaggcattgagcccctggcacttggcagtgctgggtaagtgtttttttagtatgaacagtagtttcagaggaggaagtcttctgagtccaacactgagcactcagtgtgtcacctcctgcccagcctgtggttacatgatctcggtgagtcttcccgtggcccattctacaggtgaggaaactacagctccgagaagcatgagctacttgccttccttcagcagataccgcaggatgcctgctgcacctggcactgccggcagccgggccacgccatcccccgcaacaggcgggtttggacccttgactgtgccgctctaccaccggcttccctcttaagatggagacaccctgtaccccactcgcatcttcccaacagagctttacaaaatccccctccttgtctagtcacgccttagaggcacggccctgagatcccgatgacacattcataacaggtgacaggtccgacatgtttacttcttactagcccaaagaggtcttcaaagcaaatcgcatcataacagtcacccgctcctgcctctttagggctgaccagggtcgcctcctggactgcgtggtgcgatggggaagcctcactgaagggaagatcagggcgcacctgggggaggttctggaagctgtccggtacctgcacaactgcaggatagcacacctggacctaaaggttggtgaggccccgggcaggtgaaggggggtctgagcacaccggcttggccatgcgggacacagagccccctctgaagccaggccaggagcccccaagtgactagggacaaaaagggtgggtggggcagcgcagacactgattgctaatctctctctctaagcgtttgcgttcagtgatgcacacggtcaggagcacactgggtaaaacgccggagccctcccagccttccacgactttcagaaagtccccatgagttttgcccggtgggtgtggcgggtgcagtggtagcttaggcgggaaagagagcattccccttggtgctgggagggaaaatgaacacccagcttcataaagcagcctggtttcattaggctacttggcacttagatctccaaagagagctgccctgtgtggatctgggtcccagctccgctgtgtcatctcttcctcctcaccctcggctgccagctgagtggtccggcctgctttgcacatgcatggcttgtcctagttgacatcctagattccttccacctcaccatagagtcccgcccatcatcacgagtaagcttaagattggatggtctgaaaatgacagttgtattctgatttccagcctgagaatatcctggtggatgagagtttagccaagccaaccatcaaactggctgactttggagatgctgttcagctcaacacgacctactacatccaccagttactggggaaccctgaattcgcagcccctgaaatcatcctcgggaaccctgtctccctgacctcggatacgtggagtgttggagtgctcacatacgtacttcttagtggcgtgtcccccttcctggatgacagtgtggaagagacctgcctgaacatttgccgcttagactttagcttcccagatgactactttaaaggagtgagccagaaggccaaggagttcgtgtgcttcctcctgcaggaggaccccgccaagcgtccctcggctgcgctggccctccaggagcagtggctgcaggccggcaacggcagaagcacgggcgtcctcgacacgtccagactgacttccttcattgagcggcgcaaacaccagaatgatgttcgacctatccgtagcattaaaaactttctgcagagcaggcttctgcctagagtttgacctatccagaagttctttctcattctctttcacctgccaatcagctgttaatctgaattttcaagagaaaacaagcaaacataactgatcagctgccggtatgttcatcgtgtgaaattgcattccaagtgagctgtgctcagcagtgcttggacacagagctgcaagctgcgctggggtggaggaccgtcacttacactctgcccaaggcagaggtcgcattgctgtatcacagtattttattcaggtttctgcaaaaaaataaaaagataacttttttaaacaaacatgaatagaattttgcaaatttaacgttttcaagatttattcaaggaaacaaaatgcctatgttcaaccactggtgttaatgaacaaagatactgtgcgtctctggggaagacgcacctaggtggcggccactcccatggccttgtctaggactcagagaccactcggctctgagcttccaggcgcctcgtctgtgtgcatctcacgcccgacgtggcttctgaaacgtgcattcaacctcaaacttttgcataaaatagaatgaatcgttttgctctgatgaaatgtaggccttacttgtatataagactgttcctgccttcggtctgtcattttcccacctgcctcccctacccaccccccacccaccacctggggcttcctctgggggtccgagggtcttcccatcacatgaagacatcaggttgggtcctgccccactgcccctccccctgttcctgccccaagccgtcaatcagattgtggagcagtacacagtcagatgaaaatactgtaaatgcactcattgggggttttttggttttacttcatatcatgtgcaatgttgtggctttaacattttatgcaactatttatgaagacctctgttgtacctgtaataaatatatagaaaaagca

SEQ ID NO: 1607 - DNA, 90193 bp, Homo sapiens
gagagcgcccaggagcgctaccggctgagggtggggaagcgcagggccaagcgcgcgaagcaggttgtgggggaccgggtcgagtggaagtacccgccggagaggaaggccggctggctgtggcgcccagagacggtggagtccgaggaggaggagaaggaggcctgcagaaggaagagcaggcccttagaagtccagcagcagcaactccggcggcccacagtcagattcagcacctgcctcagatctccacgtctgtctcagctgcccctctcctgctgcctctcaggcaccagtgccattaacgagctggcgaagatgggcgacccggatctcctggaagtgttggcggaggaaggtaggaccgcgccaagaggcgtcaagggagagccaggctggctgcctgcacccctccacccgcggcgcagaggccccgggggacgttggcggccctgcggcctgagtcctagggaggttcgctgcgtggcgtgctcagcgcgaaaccgggactgcggggcagagtcccccgcctggggtgagtggggttggtttcggcgccccacagatttctctgctgctcctgcgcgccagggacctgcgacctgtgacccctatggttccggaacaccctccttgctcccctgcaggcctgggaaccgccgagtaattcagggctgctaggctagcgctgcagtgcttgggtctccgaacccagccaatggaaacgaaggctttcccaaaaaaagcagcagtatagagtgcaagacagctatcccacgtgtaaggagctggtccttgagtcttattacctcactctctctgcccgttacttatcatgctttgagatgcttgttaattgtaggagtagcagatcctaaaatctatcagtttgagatactgagagccataggcacttggaaaagctgctgctgctgctgctgctgttgcttttcaacagctttcattaagccctttagttccgttgagaaatatttatccattgtttgccaaagcctttacaccacctgtattccgtggacctattttaatacatgtattttccttaaaatgcacatactattttgctgctatctccaggaccccagttccttcaatgatattttattttcatgtcttgtttagtgttggatttaaacacagaaacagttttccaaagtgacaaaagatctgatcattactattcagtcttcaaaggcaccgggaaataccgtgtgttactgcatcctcctcgttcccttttttaagcagctttattgagatataatctatatactgtaaaattcacctatttgacgtgtaaagttggattttttttagtgtatttacagagttttgtaactatcatcataatctaattttagaacactttcatcaccccaaatagaaacctcttaggcagtcacttcccatcctccccacttcctaccagtaatctctttattgtctctatagatttgcctattcaagaccattcgaataaatagaatcatacaacatgtggtctgttgtaactggcttctttctcgtagattaacgtttttgaagttaatccatactgcagcttttatcagtgcatcattcttattaattgccaaatactattccgttgtagagatatagcatacctatccattcatcgatggtaggatttgtgttatttccactttcttttgcttctatgaataatgctgctatgaacattgatgtatcagttttcatatgaacatatgcttttattttcctcgggtatatatctaggagtggaattgctggattatgtggtagctttatattgaacattttaagaaactgccaaactgttttccaggcatctgcatgttaccttcccatcaataatgtatgagggttccaatttctgtacatactcactaacacttgttattgtcttttttattatagccatcctagtggttgtaaagtggtatctcagtgtgattttgattctattgtgatttgattctactgactaatgtagcaagtattttcatatacttattagttattcacgtttttggagaagtgtctattcagatcatttgcctgtttacaaaaatttagttgtatttttcattattgagttgcaagaattctttatatattctgaatacaagtcccttattagatatatgatttacaaatatttcctcccattctgagtgttatcattctatgttcttaatggtgtcagttgaagcataccccccttattttttttttttttttattttttgagacagggtctggctctattgcccaggctgtaatgcaggggcatcatctctgcttactgaaacctctgactcccaggctcaagcgatcctgccacctcagcctctggagtgtcttggactatgggtgctgcaccacgacctccccagctaattattattttttttatgaagatggggtttcaccctgttgcccaagttggtcttgaactccacagctcagctgatccacctgacttggcccctcaaattgctgggattacagatgtgagccacaatgcccagtcacactcccccattttaaaaaagggcctttgtaatctatttatgcttacatgtgatccaaattgtgcctctgattagggtggaggtgagagaaatagatattgatgaggaataccgtatatttgatggctgggactaattactgcattctgcccaaattcctgtatctagatatattcaaagaaccagaacccaagcatcagggaagtgtggcattgatgagatcagggcctaaagagcagcatagttcaggccactcatatgactcgtatatttttagatgtttcttagcatgtcagttcttttgctggtttagttttactgcccattattgagacctgtgttcttattaggtatcttagcctacttttttttattgctataacagaataccacagcctgggtaatttataaagaaaatatttcgcttttggttctggagtctggaaagtccaagagcatggtattggcatctgacaaggacctttgtgctgcctcttaacatgttggaaggtcaagggagcacattagaccaagagataaatgtgtccaaacttatcctttcattaggaacccaattctaatgtaactgttgcactcccatgagaatggcatgaattcattcatgaggatggagccctcatgacgtaatcacctcttcaaggctctacctcctaataccattacaatgacagttaaatttcaccatgagttttggagggatatttaaaccatagcactaagatgtatgaaaagttcattgttatgagagtttttttttttttttaatgaacattccagtggatttttagaactctgcttccagatatattttctcttggatttaaatgacactgttggctgggtgtgttggctcacgcctgtaatcccagcactctgggaggccgaggcaggtggatcattaggtcaagagatcgaaaccatcctggccaacatggtgaaaccccatctctactaaaaatacaaaaattagctgggtgtggtgacatgcacctgtagtcccagctactcgggagactgaagtgggagaatcccttgaacctgggaggcgtacgttgcagtaagccaagattgcgccactacactctagcctggtgacagagtgagactccgtctcaaataaataaataaataaaataaaaataaaataaacgacactgttatgaaaacaaaagtgttggctgaagaaggctgaaaaattcaagttccagagcatcaatttttaatagctactttcatttctatgttttaaaatataagaagactttttagactaaatttacccatataggtaagccttgattttgtatgtgctttctaaatcacctttaaatactgaatatgagagttaatttataaaattgattgtaagagagacaacataacattttgccttttagacttaatagatctaagatttattacatcttctctacttttttcacaattaaacacatgaggaatcagtgatctccaattggctaatttcctactatcttctaattttaaaaatgaaattctaatggcagaagttaatagagcacttaattagttacataaacaaacattgccagtaaaatgtcattgctggaatttaacttttttttttttttttgaggtcttactctgttgcccaggctggagtgcagtggtgtgatcatagctcaccatagcctcaagaaatgtttatgctttagctgatttatgatacagttggtattggaaaagacagtttgagactttagcattggaaaaggcagattaaaacttgaacgttaggttgtttgcatctttacggctatgttaagcattgtgtccaactaagccatccgtctttagtaatgttaatatttgattagaaatattttattttatactgctagtaagagtgtaaactgagaagaccagttggtaagtacaagtgctatttttgggctgtggatttgctggagtgtgtattcttagtcatgtgctttcagtgaaaactcaagactcagtctttaggctggctttacttttggcaagtatttgatgattctccacagtgattggtaccaaatctttcatatccctggaatctagcccgcagggagagtatagtgctatccattcattttagaggaagttggaggaatagaaagaagctgacagagttgttggcttcaaatcctgcctcttcagtcaggcctcagttttgacagaggttttggtgattatgcatagtcacagcatctttatactccatgagggagtatgaaagtgtctgagtctatggtctgtgtgaacatctaattgcaagggtgcatacatgtgagagagctagcgagcagtaagtgtgcaggggtgagagggagcatggtgtgtgtggaagtaaatctatcctcttgaatgtcccgatgtttcacaaaaggatgcagttgacaaaatgtgtctctgttggttctctggagctgacagtcttgtggagggatgtgtatttgagctaggtgtccagagagggctgcattcaaggtggtatgggagcaggtgggaggccaatccaggggacagttgaggtttcaggcaaggcctgaaaggaggaggtctaggctgatataatgtgaaaaataagcaagagttagaaagggaagaaacagtgttagttctagagaaagaaagctgtaattttaaaggttaaagtgtgaaaggagagctagtaataataggaggtaatctgggggattcatattgtcccttttccacattctcaaataaatgcatcgcatcaaattttaatagcagcttgaaaatattttttcacctacttgttttatgttaaatggaacaaaaataattaggaaaaagaggggctagtgtttgcagtttttcaactttctttttgtaaaaatagaattgtaaaactctttaaacctagcttaaggtttgcagttgcttgattgttctgtgattggaactatattttgtttgatgcattgttctttggcataatagtgactgtttttgtccttaaaaaaaagcctctctaagtcaatgttaactatcatatcttgagacacaaggcttgtatttcttagaatcctattctttatctattcactgtaaagccattctaaattggtctccttttcattcacagatctaacgagagatgatcaggatcaggatcaactgagttttgagctatgtgtttaggcagtaatcatgggtaaaacccattgatgataatactgcatgatgtttaatatttttcaagcatttccctttagatttgtatcttttacatgagaaagcctgcactcagaaagttaagtggtatagctatagttggttagttttcatgttttgcttagagtaaaacattttaagagcagatcctgcaacacaaagatctgaatacagaaggagttatttcgattttattctgacattctgaaacttagcccaaggaatttacagcagttttgaagcttaacagtagaatagaataataacaacaatatcaacaagaataacacctgcttacctcctatatgccaagtacatgcattatctatttagtgcttacacaaacattatgagatagacataccacttatgacagctgagagctttgaatttatgtcatactcttgcaatggatgctaggaaatgttttgtttgcttgagtacattactacaccatataattgaggttctattagcaaagaaggaggaggaggaggaaagatatttgtcagtagcctgtagcctctgctgtattagtcacccaccattaagtctttcctattttattaaaggacatcttctcaaatttctcatgcttaggagtcttctatttcatcttaacatagttttatgaaaataggtatattttctaaaacaaagtaaatttagtgataagagtgcattgttctactttaaaaaaaatctctttgatctctggcctgataaaatataggtattctcgtatctgcattacattcactctgttgtgatgtgttgtgttttggttgaagtgtatgaaaaaaatctggcctcttagagatctatagttgaaaagggaggataattttagaaagtttttgaataattatggatattcttctctgatttgcccccaaattcaacgaataataggttctttaaagttagatataatgtagaatttgaaaccattgaaatgaacttttatttcactgctgcattaaaatctattggtctgtccttcactttaaatgtatctttttctcatgcatggttttgtaacatcatgtattgcttatttggaaaacaattatctactgagttatacagatcttccaaatgctgacatatttcattttaaaataccaaaacgtaatgctaacatcatcactgatcttatcaggaatgccttgggaatctgttaagcacacagtgacggtcataagtttacaaaaattatttcatttgcaactcaaattttgtcattggcaataaatactgtcaggtgttttccatgaagtgatagattcatgtcattaatgtttgaggtaatatctgacaaatagtcaggtctgtatgactctatatgttttcccatcatactttcaactaaaatggtgttttatgaaaaatttagctactttaccttgcaatgtaaagtactttttcatgaggcaaccatggtactttggaatgcagcatcagcgcttcatgcattcttcctgtttctttatagattattaaaaatttgtgtgttcagggtcaagattttataaacttcataagctttactgtttatcaaggacatttttaagttaaactacatttttgtttctttttgtactgagagtgcatgatggtggagaatataatgactactaatatagtctggtgccatagccttgattcacatgatggcaccagcagttttatcccattgtttttgcatcaccagtgcaaacgtcaacagaatgaaaaagacaaatatggttttaatattattataaaactttaaatacaaaataaaatgtataaatttgacacatacaaaaagtaaaataaattgtatcttgatgggggatggcagacagtactttaaaattgctgatataggatttgaattatcacctagaaggagaagttgtatgggtgtgttttgtatgggtgtgttatgtatgtgtgtgagtactgttgtctctcagtatccacaggcattggtttcaggataccccactggtaccaaaatccaaggatgctcaagtcccttatataaaatgccatagtatttgcatataacctatgcacatccttgtgcatgctttaaatcattgctagattacttataatatgtaatacaaaggaaatgccatgtaaatatttgttatacctctttgcacagtgcctggtgcatggcaagttatcattatattttggcttttcatttgcagccacagtgaaaaacttggctcccttgtcagctcgctcattcaatttttcaataaatgtttatcagccgtctttcatttgccaatcagtgtgctaaaagaacaaaatcaaaaattgtgctcacttttcagaaacttatcttcttttgcggataaaaagatagtaattaaaatgcacaaatattcgtgtaaaattgaaaccctgacaagtgcaaatagagatatatcagatgctttgaactagccagatatgtgaaagaaggcttccctggggagagagtgactttcaagctgatatctgaaggatgtgaagaattacccagggcaaggtggggagagagagagtgtgttattcccttttgtgctgttataacagaatactacagactgggtaatttataaacaatagaagtttatttggtccatgttctggaagctgggaagtccaaggttggggaccacgtctggtgagccccttcttgctgtgtcataacatggtggaaggcatcacttggtgagagagcatgcacacatgagatggcctaactttctttcataacaaatccattcttgctattacaaatctattcctgtgataacagtgctaattcatttatgaaggcagagcactcatgacctaatcacctcttaaagggcctacctctcaacattgttgcattgcagattgtttctgacacataaactttgggagacaaattcaatccatagcagagagcattccttacagaggaataattgtgtgttaaggcccctcaaagagggagaatggaactgaaagaaggtataaggatctgaaaggagactagtgggccagacttaagagcgtgaaagggtgaggttggagaggttggttggttttagttaattttaaagaattttattgtttgccaaaggcaaaaaactcatatcaagaatgaccccatcttatactagcaaagctatgacccataaatctgctttttaaaataaaataaaattataaataaaataaagctttcttacaaaccagtgtttattttcacatacagcctcgttttaaccaatgtacagatcaaaactcaaaatattcctctgcagaaaactttggactttattccctagctgacctataatggttgaatttctgtcaagtataaatttatgtatataatgggcttaattatttaagagaataactgagggatttgtgtgatctttgaaaaggaattggactgtcatacttgggttgtgaaaaagctatacaaatggtagattttttaaatttttttttgacttatacaattgctttattttattattttttacttataagaacaagcatttatttctcacagttctgggtgctatgaagtctaagatcatggtactgaactcagtgtctggtaagggcttgtttcctggctcattaatgccatcttcttactgtgtcttcacatgatggaagagggaaagcagctctctggaatctctttaataagggctctaatcccattcataagagctctgcaccatgagcacattcagactacagcacctgaaatacttagtgttttttggctttgtagacacatcattctgatttctgcttttatcttcacactgccttcttctgtgcctctgttccctcttcttttcttaggaggacatccatcattggatttagggcccaccttaaatccagtataacttcatctctagatcattaactaattacatctgtaaagactacatttccaaattaggtttcagtctgaggtttgagatggacatgaattttggtgtaggagagacattagtcaacccctacaataggtcaatatcaagtttccatataataaagtgtcttgttctgggctctctgttcagtttcattcgccagtttttctatcgtatttctaaaattatggtcactaacttgaacttaaagtgctaacattttatgtggttcccattgtgatattttctccaaaaaaaatatataggaagtttttgacttaaatatatcttagggctttttcaagttggaaccactagaaaataagaatttcagttctgtatttaacttttttagtgtcataaacttacttgaacatgtattttagtgcaaacgactaaatgcattaccattacggagctatctgtatgtcgggaaagtactctggcctgtgtagaaactggtagtgttctatatacaagctgtctggtttgatttcaggaaaataaggtgagagaatatgaaatctcatgtggtgagaactaaaacatatgaatggacaccctattgggtatttaactctcagtggttttgtggttataggttgataaccacattgatcagagttaagtttatttctcagtaattgagattgtattttacacatcagtattttatgcttttcctgttataggcagttttaggtaagacttcttttggagtctgttttaaacaatttagctccgaatcatcttgtatcttttcttctagtattttttctttgaattttttaattcattcaattcctattttttccttacacagacttttgaatatgttctgatcagtggctaatttaacatgtttttctctttcttatttaatttaggggaaaaagtcaataagcatatagactactctttccaaatgagtgaggtaagttaaatatatatgcattaacttccttataagtcagaataaaaaatcaagataaggttaactaagcctttgtacttatttacttataatacattctattatgccctctaatttattcattttttaagtagctaaagcaagttccatgttccatgcagatttaatattggatcttttctagatgttataagggaacaaatagatctttgatttgttttgaggctccctgtgaaataaactcagatatgctgatcattgatatgcaagatactagtatttggcttaacattttgctataatataatgttagtgtagtctgtgatagcttattattttacagttattagtatgattagtgcttatctatgactatactggagttcaacctgaattgcataaacacattaaatagaataataaataaattaaatactacttgtaaaaatacagaattcttttaaccaaaggacttcttatataaattttaagaaccatacaaacaatttatattgcttctatactgaatataagcatgttaaaggcatttcaatgaaatcatttttctgatagactctagttgataaagaatcccatgcatagctctcacagaggtagacgtccttgagtggtttcaggatgtcctgccagatataaacaggatttaaaaagaatttccaggaatgattgaaatttctgcttggaaaacacgtccttctagaataggttggctatttgctagttggctggataagctcattaagattcctagaagttacagggttcctttaaaagttcagtgacccactagtcagaatggctattgttaaaaaaatcaagaaataacagatgctggtgaggctgtggagaagaaggaatgcttatacactgttggtgggagtgtacattagttcaggcattgtggaagatggtgtggcaattcctcaaagacctaaagatagaaataccattcgacccagcaatcccattactgggtatatgcccaaaggaatacaaatcattcttttttaaagacccatgcatgtatatgttcattgtagcactattcacaatagcaaagacatggaatcaacctaaatgcccatcaatgatagattggataaagaaaatgtgatacatatatatcataaaatactatggagccataaaaatgacaagatcatgtccttggcagaaacatggatggagttggaggcccattacctttagcaaactaatacaagaacagaaaaccaaataccccatgttctcacttataagttggagataaattatcagaacacacagatacatagagggaaacatcacacgctggggccttttggaggatggagggtgggaggagggagaggatcaggaaaaacaactagtgggtattaggcttaatacctggatgatgaaataatctgtacaacaagcccacatgacataagtttatgtatgcaacaaacctgcacttgtatctctggacttaaactaaaagttaacaaagaaaagttcagcgacctaaatgctgagagaaacagaatatgagaaccagagggaactatgaagatcatataggacagtgattttatagtgtagtttgcagatcaatatacaaacaagaataagaattatatgaagaatttcttaaaactgtagactcttgggcccaggctgtctcaaaataaaataaaataaaataaaataaaataaaataaataaaaggaaagtagagcaaaacaaccccaaagcaagtagaagaaggaaataataataaaagcaattgaaaaccagaaagtattagaaaaaatcattgaaaccaaaagctgtggaaagatacataaaattgacaaacctttagccagactggcagaaagggagttgcgctgggacatatgtaaccaatatcgggaataaagcaggacatatcaatatggaatttgtagataccaaaaagataataaaggaatactactaacaactctacacacataaatttgacaactaagatgaaacggaccaattcttcaagaagcacaaactactataatccactcaacgttaaaacaataatttgaatagccctgtagctactaagtaaactgaatgtgtaatttttaaattcccctgaaagacctcttcaggcttaaatggtctcattggagaattctaccaaatgtttaaagaagaattaacattaattttatacaatctcttccagaaaatagaagaaaaacagatgcttctcaattcatgtcggatccctacgtaactttgataccaaaagagacagacagtttaaaaaaaaatgaaaacaaaaaacctaaaagttggatccctcatgtacatagatacaaaaatccttagtaaaatattagcaaataaaattcagtaatataaaaataattatgcaacatggccaggtagggtttactctattgatggaaggctccattcatttttgtgtgcgtgtggaaagggacagagtcttgctctgtcacccaggctggagtgcagtggcacgatcttggctcactgcaacctccacctcccaggtttaagtgattccccttcctctcctgagtagctggaactacaggtgtatgccatcacacctggctaatatttataattttagtagagatgggggcttcaccacgttggtcaggctggtctcgaactcctgacctcaagtgatccgcctaccttggcctccctaggtgctgagattacaggcttgagctactgtgcctggtctccattcattttttgaaaaacaattggtatacttcaccaaaggctaaagaataaaaatcatgtgatttttatcagaaaaaatattgtcaaaatttaacttccatttattaaaaataaacacaaactctcagaaaaccaagaatagagaggaactattttaacctgataaggagcatccacacaacacttacactaacagtatatttaataataaaagactgaacactttcttcgtaagatcagaatgtcctcacttacccttctcattaaatatagtactgacagttcttgcaataagacaaaaaaataaaataaaaggtattcagatcagaaagggacaaataaaattctccccatttccaggtgacatgacgatgtacatagaaaatcccaagaaatctacaaaattaaagacaaaaacaaaatttcctagaactgagtttaagaaggttgtaaaaaataagaaaattatatagaaattagttatatttctatatactggtaatgagaatgtggaaacccaaattggtatataagttaaaatatctgtatgacatttcatagacataggcaagattattcagaaaattttatggaaatacaaaggaagtagaagagataaaatgattgtgaaaaaaagaagaaagtgggagaaaaccctctatgttattttaagacttgttctttagctgcagtctaatgaagactgtgtgatatttggagaaggataggcatgtagattaatgaaacagaatagagatcccagaaatagcctcacacaagtacagccaaatgattttggacaaatgtgcaaaagcagttcaatggaacaaacaggctggagcatttgtatattcataggcaaacttatgaacttaacctaattttataacttatacaaaattaattcaacattgatcatggactaaatgtaaaatgtaaaactatacaattttttgaagaaaaaatggatcaaactgtttggaaattagatcttggtgaagggtttgtagttatgtcatatctgcaaacaaaaacattattaatgaaaagcattgataaattggagtttatcaaatgtaagaattattgttccctgaaagatcctgttatgatgatgaacagacaggctacagactgggataaatatttgcatattctgtatcagacaaagtacttgtatctatgatttataaagaacccataaaatttaaatattttacaagaaaaaatgcccagttagaaagtgggcaaaatacatattgagatctttcactaaagaggaaatatgatggcaaataagcatatgaaaagatcttcaatatcaccagccactaagaaatgcaaaataagatcaaagtgagatgtcagtatatgcctattagaagagctaaaatataaaatagtgacaatacaacttactagttaggatgcagagaaactagatctctcacacaatgctgggggaaacataaaatgatacagtcactctggaaaactgttgggcagtttcttaaaaatctaaattatgattttcatgtaagttgggtaatcatactcttgggcatttatccagcagaaatgtaaacatatattcatacgcaaaacctaaacacagatattcacagcagctttatttgtagtagccgaaagtggaaacaacctaagtgtcctacagcaggtgaatggttaaacaaagtgtggcacagccttatcatgtaaaactacccatcagtaaaaaggaacaaactattaataaacacaacttggatagatctccaggacattgtgctaagtggaaaaaaatcttaaaggaacacatatgttatgattccatttttatgacacttctgaaatgacagtatacagatggagaacaaattagtgatttctaagggacatggatgttgaggggaaggaaaatggacataaatttaaaagggtagcatgaggaagatccttgtggatggaatagctctataccttgacagggctggctcttacccaattgtacacacgtgacaaaatgacctccaactatacagagacattgtactcatgtcagcttcctgattatgatattttactgtggttatgtaagatggaaataaccattggaggagactgggtaggggttacatgggatctgtgtgtattattttggcaaattcctgtgaagctatagttattgcaaaataaaaagttaaaaaaagtgaatacaacttatttcactttcctcaatgctaaattatattttttctgacactcaaatgcaataaaaacaggctctacacattgcagtcaatttttttcaccccatctatgggcaggaggcaggcaattttcaaaaaaaataagtattatagcatattcattcaactattggattgaggcagaactagaatcaatggatttttatccagtaacaaatttatagatatgatgaatgtttttaggcttttacaagacagaagtataagaattgtaggttcattatttcaaaattattttatgtttgaaaaggtcttctgtgctttcatgattgcttaaatattaaaaagctattctagttttacctctgatttacaattagtatgagtccatcattggacattgttacagtcttgttggaaatcagaaaatgcatgtgaattaaacatgcatgacatgattaatatatttattacatgatcactagaaagtaacaaacattaattttaaaaagtcaacatttatggagaacttcccatgtattatttaatctcactgtatggactttatggtttggagaggttaacttgctcaagtttacaaatgtaatcagttttacatatgtatttaatggggtttatataattgaagaaaaaggttatgaggcaaactgaaactatataaattgttttattgttatgtctcctatgttttggagctgggattctgaacacaggtaatctgattctaaagctccttattcactgtataatatttctttaagaatgctgttttaagaattgtgtctagaagtacatcaaggattctcgttttgcctaagactattcttagtaagaaatgagacaatgacatactcagcaaaatgaagaagtaatctaagttattttattttacattctgcaaagtgaagatataaccccatcttttgattggaaatcagagcaaagatttttcctaaaaggagagattgtaaaatgactagcctggttgcttttgaatatatggttttcttctatgcttctgtaagcaaaacaactaacatttctctaggataattggaaaaacttatcaggagtcaatataaatgaaactataataaatttgtttattgtcttagcagaaatgtagctgcacagcatatttttagaggctactatttcagaattgagtgatcaagatactcattcacttcatttgctatctgttgtatttagacgagctagtggaattcattcaaggtccacaagtagatataatcacatataagtggattctaattataactgtattttaggcctgtatttactcacagattctcagtcttcccacaacttttcccaccggtttcagtattactttagtacaatagattgcattatcttgtaatttatattaaatatagtggtatgaaaattgtacattttcaaaattatctttcattctcttttaaagaacacagagaaattactgcttttgtggcacattctgttactttacttttgtagcattaggtatatttccaaggtgctctttgagtatgttgtaaatatgtctgttacacattttatctgctattttgaaaactgatttgcccagcattatttgggcataatgagatactgattgtgatttttccaagaacaaggtaagtgaattacaatctggacatgaatttccgatcatttctgttggttgatgtctctccatagtattatattgtacctgtcactagagactgctgagaagtcattgggtgttatctcaggtctgtgtcctgtggtgtgtggaccatcgtgtaacctaaggaattgggaatccaccatatacagagggaggcatccctattgtgttaattataagtggtttgtgtgtatttttatacatgtatggctttttttgaagaggttataaattcaaattattaagaatcctgatggtgtattttccaaggtattccctttaatgatttcaaacaaatgttgaagggcgtaaaatagccaattaattctgcctttcctgttggtcctcttcaggatgcagcatcataaaaagattagacctccttgttatttctcagtaatgtagtagttcttaaccacttcttgtatctgatttcttttatgatttgataaagctacctcccaaatactaattctctctgaagctcactctctttcctcactgcacagacaaacacaccctgccccacaggcacatttacagatacatagcacacatacatgaacacacatgcacatgcatacacatatatgcccacagttttgcatatgatttaatgtggttccagattaagtgtttctgcatagagattacagagttgttactgaaacttaaaagcaccctttgctccacctgcactattaataatagcattatatcttcccctggtactgttagcagagcctgagcagcagagagaccagctttctcatcaatgaagaaacaatggtaagcagcgaccagtactatcctttcttgcatggacacaaatggggcatctttttgtagtctgcaatgatgatactcttttccagttcagttatttgacatgctctcatacatggtatttgagaatatattactttagaaaaaaaaaatcagtttctttaggtggggggaaaacacatcagacatatcagtgagaatgacgcactgagtataacactttgcttggattttattttttctatgagaaaatgaagggtctaagaggtgtaatgacttgaccaaagttattgatatgtttaaggggttgatgcttgactacactcaagtttctgaggcttacttagttcagtattctttctccactgcatcactcttcttgtctttaagtacatgcctgaggataatcatgaaaaagtacaattcatttaaaaatcaaacttaaatatcaattaaaaggttggtaaggggacctgaaacttttcattagttgcctagcaagtaaaaaatgccttttgggaagatggggaaatagagttatattcctatactgataattttagcaaggatgatagtttgcttttcactagagtactaatctttagtgttttggaatgaggattgtgatattgatcaaattaaaacaattgaaatgttttgttttctttttaaatttatttttacttttttttttttactacataaagcattttacatgattccaaagttgaaatccacagatcaaataacatttagatgagcctaaagcttatacaattttgatatcactctttaagaaacatatggaaaaatattttcctttaaaacatttacgaaaatattttaccacgagaacacattgctggagtccttcctaaacccttggaaggggtagatgcaagtaagatgccctgaagattagactttattagcttgaaggtaaatctgtcttagcttgaaggtaaatctgtcttaggttgaaaatatgaaacaaagtgttttcagagaaatctttcttctttgtcctctcagtctttttgtataatagttagcatttttgtttggtttatttttccaatgctattacaaatgttgctaaaatgaatacccttgggaattagtcttataatattttggtcattttatttttctgcatggaattcatttatcagagaataaaggtatatatagtaatttgtaattttcccatatattgccaaattcccctgccttttgtgtttgtaacaaacctgtgaaagtggctgtttccccacaaccctatcagcagtgtgttgttatgcttttagattcttgcctgtctcatggtactgagatagataatggctattgggaggtatttcacttggcacagtatcttagtatcatttaaaattgcatttctcacaacatgtgtgagatattcatctttttctacattgagtggtcatttaaatttattttgctatgtcactctgttcatatatcttgtccatttcctgtcaggttttgtttttttttttactcttgatttttttggagctctttatatatatttattgttatctccttgcctgtacagaagttgcagatactttcctcaaatatgttaaatacatataatttaatttttaaattctaagtgactttaaaatgatgtatgatatttgattcactatgttgacattgtctttgattaaacagtaagttgttaaacagtagacttctttttaaaaatatactttattttaatatagttttagattttattataaatctatttattataaataaaatctaaacagagtttcttataccccacactgattttctcctattattagaatcttacattagtatggtacatttgtaacaattaatgaacctatattggtgcattattatcaaataaagttcatgctttatccagatttccttagttttcccctaagatccttttcctattccaatatctcattgaggatgcagcattgcacttagtagtcatgtctcctcaggctcctcttggttgggacagtttcatgtacttcttttgatttttatatccttcacagctttgaggagtactggtcaggtattttgtagaatgtccttaaattgggactttcctgatttttttttttatgattagacttggattatatgtttttggaggaagataatagaagtgtcgttatcttcatgtcatatcaagggtatattctatcaacatgacttaatcacccttaatgttttaaccttgattacctggcttgaagtaatgtttagcagatttattcactgtaaagttactcttttttttttctccctttccatactgcaatcttcagatgaaagtcactatttgcagcctacacaaaaggattgggattatgctctccctccttataggtgaatccattatttggaattgttttgtgtgtcggggagatctttcttcctttctttttgtcagtgtgtacttatggatatttattttatactttatgttataaaccaaatactactttattttcttgctcaaattgttctagctttggctattggaagtggtgttttgttttttgttttgttttgttttgttttgttttgggacagcatcttgctctgttgcccaggctggagtccagtggcatgatcatagttcactgcagccttagattccttggcccaagtaatcctctcaccttggcctccctgagattacaggagtacaccaccacatccagctaattattatcattattattattattttggaaattgggtctcactgtgttggtcaggctgctctcaaatttctgggctcaagcagtcctcccttctcagcttcctgagtggttggaattacaagacataagccacatcacttggctggaagcttttcagttgactcctgtgtttccttggtatacccctattattgtgtttagttttgttttgagtattttccttctttctgactagatgctccaaattcattttgtacatttcctgcctcagtcctagaatcaactgtgtacccagggaagtttggttttttttaaatatatcatagaaatatcacaaaagaaaaatctgtataaattagggtcctgttaggcctactcagtgtaggataatttgagaaggacttcttaaaaagactttttacaaagatggggtgtaagggaatctcagcatatataggtgtagtaatcttgaatttattaaaatccatagaactgaagggaatagggtaaggagaacttactggaacccagaaggaagaactcatatactatagacattatcaagaggctcaatgatctttggtgaggggacacaatcttcctgaattcaaccttaggaaggaaaacactatctattctttccaatcattcgtgagaagcaagaggtcaagggagctctttggttacctgcacaggacaaaaagcagggtagagaggagtggagagggaatgtgctgggataatccaacgtaatatcactggatatgtttttgggtaaaaaaatggagtcttgcggttcctactgtgattattatgacagaaactctatatcaattattttataaatatttaataatgcaatttaaaattctatttgaaacaaaatagtgaaaagtgaatgagtacctaaatgattacagagattgtcagtatagaaatgtcactaaagccactaaatgaaatacagaaagatggaaactattatgcttaagagaacctatcttagagtgactactgtaggggattggacagaatagtttggtaagtatttagagtttagtaagcaaagaatgggaattgaaaagacacactaaaggttgcttaaataacgacagatatgcaattaacagattttgaaggagtatgggccttgatcacctcaaggatgatattccaaatatttaataactgatatggcacaggcacaaaccaatcagaaggagtctttgagtaaaatgacaagaagcaattagtgtcatattagcacagtatttataattgatctgtgcatgtatttagatattatcaccttatgattcagtcattaattcagtctcctagtgatttcatccagtttcatggctttaaatacaattgatatgccatctcaattctcaaatttgagtttcaagtgtagtcctttctcctcaacttcacttttaaatatccaaatgctttctcagcatatgcatatggatgtctaaaagctatctcaagattaatatgtccaaaatgtaattctttatcttcccctgcaaaaaaactgcttgtctgaagtctttcgcatctcaacaacatgcattatattcttttcgttgctcacatcagaaatttatgaaaaaagttttcatcttcattggttctacattaaatacaataaaatgcacccattttaagtgtgtagtttgatgagttttaacaaactataatttatgtagaaaatttccattacctcaaaaatttccctttagcggttttcctcctaccatattctagcaaccgctgatttgtttttctttctaatgtaatatataaatggaattttacagtatacactattttgtatatggcttcttgctgcttttgctcgtcacaatgtttctaagactcatgcaaaactccaaatattactaataaattcattctttctgaatatatctgtactagagatattattgtttattttattgctcagtaatatttcattgtatggatatactgaaatttatttgtccactcatccattgatggatatttggatagttttcagtttcaagaccattatgaataaggctattatgaacattcatgtaagaagtgtttttagagatgtatgttttcattaatcttgggtaatttcctaggagtagaatttctgggtcatgtggaaaatataggtgtaactttatgtaaaactgtcacactatttttaaaagtggttgtaccattttttattcctgccagcaatgtacgagagttctttttgctgtacatcttcaccaacatttgatattgatattgatattgatagctttttaatttcagtaattctagtggataggtagtagtatcttgtgatttcaattctcatttcttttttaaataatgatgttgcccatcttttcatgggcatattggactttcatagatactcttttatgaactgttcaaatcttttctgcattttaaaaaaatgagttgattatctttgtattgacttgtaagagttgtttatgtattctggatgcgagaccattgtcaaccttacttattgtgaacattttcttccagtttgttgcttgccttttcgtttacatagtgtttttagaaaagcacatttagaagtatataaattcaatttctcatattttatcttttatcatccattctttttatgttctatttaagaaatatttgcctacaccaaagtaggggagattttctaagattttcttcagttttatagttttagtttttatgtttaggtctgtgatccatggaagtcataatgtggccctgcatggtcctttagtgtgggagtctttcatttttcttaacaattctttaatgaatttagggaaaacatctgagaaaaatagtaacctgtgaatctcatgaaagataccaagaaaataaaaacactgagatgaaaaatttcaggccatcagaataatataggttaaaatatattttatgtaatgaccaacatttgtcttgtatcttttgtattttaaaacaacagcaatactaactcctctgtctatatatagaagacattagtttacagggcaggaattttccctccaatagtcaccagttgcttagacttcttcagcctattccaggaagagactagtttaagtaattgtattggattatttatccatgcattacactataaaatacactcaattcttgctcatttatgctataggtttggttttctttcaaatatagttgagtatcccagatatttttaggtaattgaccctgtattttaaataatgaccatgtaattgaagattggagataactgagcatttgaataactgaatgactttttatgtattctattatattgcatgctcattaaattaaaaaaaaaacctgggtaaactttccatactacacatcatatcagtataaatgtggtaattttaatttcttttcctgatatatacaggcatacttaacaaaatatctattttactttatatttttattattttcatgttttcctttattattattatttttctcttctcttccttaattacatcctttgcagggacatggatgtagctggaggccattatccttagcaaactaacacaaaaacagaaaaccaaatactgcatgttctcactgataagtgggagataaatgatgagaacacatggactcatagaaggaaataacaaatgggatcttttggagggtggaggatgggaggagggagagaagcaggaaaaataacgactgggtactatgcttaataactgggtgatgaaataatctgtacaaccaatccccatgacacatatttccttatgtaacaaatctgcacttcctgcacatgtactcctgaacttaaaaaaaagtagaaataaataaaataaaatataaatccacaaatatttattatttttagtcactatttaaagaatttaggaaaatttacttgagtctccttattttctttacctgtttattgctttcttcccatttttcttctttttttccttgctaatttgtatcctccagtttgaaatatcacacacacacacacacacacacacttataaaatgatcataccaagggttagtttgtctttgtcttttttttggaatctttactgtaattctgggcaggaagtgctaattctttattggttgcttcacagcctgcaaagcgattcaatttgttcctgaggcggcggcttatggtaaaaccagtgctgaatgatgctgcttatgctctgaatggctgcagtggtagccttagttatttttcttctaatgaatactttgatttgggggaacattgtcactaattcctagtccccaggcaactgaagtttaagaatagtgattcttaatttgttctggatttggattaaatctatagatcctcttcctaaaatgtatgcacattctcacacatacacgtaattcatacagtttcagtggtttatgaactctcatcaggaatgcagggttttattttgttttgttttcacacagagtcttactctgtcgcccaggctggagtgcagtggtgcaattacagctcactgcagcctcaacctccctggatcaggtaatcctcccacctcagccttctgagtaactgggaccacaggggcacaccaccatgctcagctaatttttgtatttttaggagagatgagtggtttcaccatgttgtccaggctggtcttgaactcctgagctcaagcaatcatctctcctcggactctcaaagtgctgggattacaggcataaaccaccacacccagctggtaattcaggtgtttgaaccacagaataagtacatcctttacagagaagccactcagatgtttacataattacaaatagatattctaaggacaaatcaaatataaacataaacaaatgcacacacatgctacaaaatatatttatattatgttttgagcaaaacaaaagcatgatgtatgttagtaacattcagttatatgtgacagaattatcagatttttctgcctcaaccttaactgatttttattagtagtcctgagacatgtctctcatgctgacttacaaggctcccagtgatttttttcccatatttaaaacagatttacagtgtatcatcagggtgtgatataatgatagaaatttgtgttttcctagctagcctttggctttcagaaggacagtatgtatacctatttttgactgagcactccggaaaatcactggaattactattctcttagctactttgtctgttttcttgctgtcgaatactctgaatatgagttttgttaattcatacgtgcacatgttctgttaccagaactgttctttgtgtacccagatttagcttatgtaaacaatacaagtacctgtaaatatattagtttttgaaaacaaagcaaaaaacaacaaaaaacccctctatcatacaaaatatgactgtcacagacttagagaaagaggactatttttttcttttaatttttgagctttgattttatttagtctaagtagtatattatttctgcctcagttgccttccaagaattttggtgaatttcataagatgctaacgctgtgatgatttataagagtgccaatgatttgtttgggttttttctttcttttcaagttttagtgatttataatcaaagtatagtgtgatagcagtttgatttttctcaggttcttttactttcttttaggaaataggagatgattatgcatcctttggctgaggtgaagagaactcagacataacatttgagttactgtatcttggcacttaatctctaggttccctagatttttttttttttttttaattcttagttcccttttccacacatttcttcctgtgcattgggagctagttttttttctgagacacatcagctttgcatcagctatgtaaatgcacttactttgttcatagaccacagatcaaacatgagacttatggcttatttgcatataactgatcctcatccattcccttttctgggaggcctgtctcacctgacttgggtaaaaaaatcccatagggtacaataaaggaaactcatgaattaatagaaacactagttgtgaaaattaaaaccatatagttactcattcgcaggtgagctaaagcaattggaaaactatctaattgacagccactgtattatctatttgcataattctaagtgtaataatacatgtaggctagcaggaatattaagtattagatataaactttaaataaaaccaaatcagtcaaacatgaaatctctttcttctgaagctctctcatgtttttgctgtttttaaagtgaaggaactaatgaactaactacacaacacgtgaaagttgaacttgttaagtgtaattattatactgagataattcatgcaaatttaaaaaaggattgatttttgctcacctgggaaattgatgttgaagggcgagttgcatgaaacctaacttgtgatgccagctaataagctacctgctttataatatttaactgcaccttgattttattttaatccttacaaagttgaattaggaagtgacaattttataaaaacatagaataaacattaatcataagtttattttcttatagtgagactccattaattggtctgtaattaattatacccccaaagttgtgtgtagccatgaattatttagtggactaagtgatatcttgtttgatgaagggaacaagtcagtctctgaatgtgcattttgagatcaatttatacatatattcatttcatattttggtatgtttgcagcatttttgttgtatgtgcatgtagttaacatgcttatcttcctcctgagtcattattgcttaatcttttatatggaatttcactttataaaacaaagcataatctgttgctgaaaactctggttatttgtcttgatttgactaaattataaataattccttttgtgcttttgccatttcagaataaaactataatttacaattgtgtcatttatgtctcctgcagtttcaaaaaaatcagcaaagcaaagattctatcttcttccgagatgggattaggcaaattgattttgtgctttcctacgttgatgatgtaaagaaagacgcagagttaaaggcggtaagtgcattataacagaagtgggaataataaaaagaagcacattttataatttcacatggatatctggattgaattatgttgtaaaagtgagaggccctgaagtgttactgaaaactgaaactgaatgagataactgtaaagtaggcagcctaagaatagacatgtaaagtcaatgttatctttttggatattttgcatactaacttatttttcttcttcttccaagtaactgattctttttatagctcactttagatattaaatgtaacatccaaaatttgaggtatgtgtctgaatataataattaccttttgtatgatattttcattttggaaatgtatgactaatccattgctccaggtatagcttttatattgtactctattcctgattctattttatttgtattacacatcactttatgagcttatttattcatgtttttacttgtttgctgtctccaacactataaattaagtttatgaggccaagcactttgtcttgttcaccgttatgtacccaaatcctagaacaatggttggactataatggatactcaataaatactcaatatttgaaatcataaattaatccatttttatacacatatatgtgtgtgtgcatacacacacatttacttatgtacttacaacataaatgtcatataaaataaaaataaaaaatgaagatattattcccacaagactccatacatatacaggtctgtcccttttttccacccactgcctggaaagccttctaccaggcctctgaaattcatgacccatcatcattttcatctcttctccgaacattcccttcaaacctctttgaggttttttgctttccgtagcagtcctctcaagtgatgtttacttttctttatacaacatttccctagagatggggtaaatgctgcttgccttccttgtatcttgttgattatactgtgttctccttcacttgtccctgaaattcctgagatttaaatctcatcagatttattattatcctgcattgtttttgtcatttatctttctctgcatcttctattcctcaacaattttacctcctggatcactgtccgtctttccagcaatcttttaaaatcattgataatatcaattcatacttagatgattattttgacactctggcctctctgttccttgaactcccttttccaataatcttagcttctactcagccattcactcacctagaacttgtcactactaataactgcaactctttataatttcgttttacatgtacaactgtctgattatacctcaaatctttctgatccacattcttcctctttcaacctcaccaggaccagataagatgcaatcgtcttactgctttttgctgctcttattcccctctcactctttattcagcttatgtctcgtggtcaacaattttaattactctgttacatatcccgccaagtcccttgcccctctcccagttgtacttgacaaaataacaactttagttaaacccaaccctacctactaaatgccagcacacatgcagaaaggaaaacttacaatttactgactgactttaccttgtatttgtgcccatggaccttaactgggtccttatgctgtgtggcaatcatactttccttccatattctgttttctcccactttcttagatgactgttttataatgctttttctttcctcacacctccaacacctcctcctgtcttcaagcttagctgatcatatttttctgtttcattgagaaaactgaagcaagaagagaaaacctataaatttctaccatcacatctgtccatccaccaggagttttgcctgtgtaagctatcttactttctgttaccatagacaaactatttatccttctacctaaagccaactgctccacttgtgccctgcattctctttcttcttgcctactattcaggagtgccaaagacaaccctcaggtttaggggttcattagaaggaatcacaggactcagtatatagtcatgcttatggagacgttttattacagtgaaatgataaaaagcaaaacgagcaagggaaaaagcttatgggacaaagtctggaggaaaccaggagtaagcttgtgagaattccctctcagtagaatcacaggatatacacttactttttccagcaacaatgtatgaaaacacatgtgaaatatctattgggcaagcccattagagtgccctaggtttttattaggggctggttaccttgtcaccttctgcctagcacataccaaaatttcatactcccagaaggaaagcagatattcagcataaataacactgtttgtaaaaacagtataggcaaaatgagccactcttatcagttctgggagtggagggaactcttcagaaaagcaagtcccagacactaggaccaacctttctaaagttgcaggcaggcctttctaaggatagcaatttaatccctgctttattaactcttttctgtatacctattttgggatattgctctgaaaattagttcctctttctcctaaattatatttgatattctttactgggccattttcttccatgaataactaggctgttaatttttctatattaaaaaggtatgaataaaaaccctctttttgttccagttttcctattagctactatttctctattttttttcttttcaattatatattaaacctattcctttcaagcctttatcccaaccactctgcccatctccttgtataaaatccaatggtcaagcctcagccctcatcttacttgacctattagcaatatttaacacagttgatccttcccttttctattgtgtatgttcttcatgtggcttccaggactccacattatcttagtttttttcttatttcactagttgctccttctcagtctttacttctcctaaatcacttattattaaagtacctcagggcacagtccttaatcctcacctttccttatcttacactgatgtatttgatgattctgtcttacagttttaaaatcatatattttatgattttatatacattaatcatacaatcccagaattcatttttccagtccacatttctcttccaactgtgcataactaaatgactgttctgtatctcataccttcaataaggtactggcataacaacagacacacaggccaatgaaatagaatagagaatccagatttaaatctatgaatttaaaacaagttcatctttgacaaaggggccaagtgcatacaatggagaaaagataggcttttcaataaatgatgctgatgaaactggataactatatgtggaagaatgataccagatccatagttcttaccatacaaaagatcaaatcaaagtggcttaaagctttgactctaagacctgaaactatgaaactaccagaagaaaacactaaggaaatgctccaggacattggtgcagacagacttcttgtgtaagaccaggcaattaaaggaaaaatagaccactgggattaaatcaagccaaaaagcttctgcacagcaaaggaaaagtgcccattgttggatgaatagataaagaaaacgtggcaaatacataaaatggaatatttttcagccattgaaaaaatgaaatactatcatttgcagccatcgatggaactggaagccattatgttaagtgaaataaaccaagcacaaaaagacaaatgtcatatgttctcactcatgtgcaggaggtaaaaatgtggatctcatgaagatagagtagattggtggctaccagaagccaggaaagggaaggggaaggagggagataaagggggaaaaacaatataatgcatttattactactgaactatacacttaaaaatggtaaagatggtaagttatatatgtatattttaactcaataaaaatgttttaaaaagaaaaaatgcttttttttgtcatcaatacattgctttaataaaagctgggtgggtggttcacacctataatcccagtgctttggcaggctaaggcgggaggatgagttgaggccaggagttcaaggccagcctgggcagataatgagacacagtctctatgaaaaaattttttaaaaattatccgagtgtggagacaccttcttgtagtcccagctactcaggaggctagggaggatcacttgagcccaggagtgtgatgctataatgggctgtgatcacaacactgtactccagcccgggtgacagagtgagaccctgtcactacaaaacgaacaaacaaacaaatgaagaactaagcacccaagtggttattttcagtaatgacctatagttaaatgtaagtttactttttgctaagtgaagccattttgtccttcaggattaaaaagtcttgatgacatactggcttaaaattccattaaatgtatagtttatttgaagagtattgatctttgtaatagtgaatcttttcaacttggagcatatgtctctctgtttataaagtttttttataatttatgttattcagtaaagttttgtacatttcttcagatagaggctctgcatatttcctggtgattattcctggatatactgcatttttgtagttgtgaattatagtacaagagaaaagcagtacctgacattcagatggagcatttttatatacaaccatgggaggggcagagagccatccagagtcacagccattgtatattgaatctgtcaatactgagcaaataaaacaaaagcattctgcataattctgttgatttttttttgtcataggaaagaagaaaagagtttgaaactaatctcagaaaaacaggtcttgagttggaaatagaagacaaaagggtaaatgtagttgataatttatacaagcctctttaatttaagtgttgttttctcctactctggcctttgcctggatagactctgtgtttgggggcaatacaatagctcttttggctacagatatgtgcaccgggatgatagggcctgtggtcttacaggtaagtagatgagtactgtgaatatgcagtaataaatggaacactttataaattgacacagtttgcattcaggatacaaagagaaagaagatgtggactttttatcataacagtttcattttgaagtctgcctataatctggtaccctaaataattaaccaggctgtcttgcagcataacctgctgtttaagccaagacattctttctgttcatgaatctaccaaattttctttttaaagtcattttatttactgtttttctagaatttccttcaaaattgtttttaaaggcctatttaatatcttaccctatctattccagcctgggcaacatagcaagatcctgtctctacaaaaaataaaaaataaaaaattagttgggcatggtgcctgtagtccagctacctgagaggccaaagcaggaggattgctggagcccaggagtttcatggttgtgctgctgcactccagccttgccaacagagtgacgctctgtcttaaagaaaaagaaaagaaaaacagaagcattactctctagttctcccattttcagtgaactaataaattattataccacacaatccataatttctcctatgccatgaacctttgttacctaaagttcttcctcattgtgtaggctaaacaaagaagctgggtaagaagagtgagtacgttttacagtttatatgtatcacttatataacgtaagtaaaattttgagcttatagctagttactaaaaacttaagaaattgcccagaaccgcataggttattgtggatttagagatgagtatacattgaccatgaaatatatgtttaaaaatagtctttctctgcatgtgtctttgtatgtctctctttctgtctttcacatatatacacacattatatgtatacatatatacatgtttttgtaactatatgttttgtgaattttgttttctcaaagttttgcctgaaaatttcaaaatattgaaaatgctttgatgtgtttgagattttataaaatattatccatcttatttaatcagctcaataacaaactgatcagtaagctttctgctgttttgccttttttttaatgcaggactcggaagatggaagaacttattttgtcaagatccatgccccttgggaggtattagttacctatgctgaagtcttgggaatcaaaatgcctattaaggagagtgatattccccgccctaagcacactcctataagctatgtgcttggacctgtaagactcccactgagtgtgaagtatccccatcctgaatattttactgcacaattcagcagacatcggcaggagctcttcctcatcgaagatcaggcaaccttctttccatcctcatcaagaaacagaattgtaggtagagaagacctttgggcacatcccttcaaatacgagatgtatgcttgtgtgtgcttttatacatgtgcagatgtcgtaccatttctgcaaggtgcttctgtataggatataagcatttggtgatattggggagtttgaaagtctaattagaccacataaacgtattactctccctaactctcaaactgttgtttaaaagtgagtggttgatggtatggatgtagtaaagaaagagatgttatacaatattggaaaaagcaattaattgagagctagaggactttgattttgtaagatctttgtaaaatggttttacaaacttggagtttggttttatacagtcagtgcatagtaaaggaactatcattccaaatggaaatgaaatgttttaattcctttatatatggataaaatttgagaaacctcaaaacttttttttcccttcatttacaactattttctgccttctaaatagtcttgttttctctgcatttgaagtcctaggatctttaagtttcccattgaaaacctctctcagaaagaatcatggttttgtgccactgtttctttgtgcttagactggaataatatccacttcataggttacccagataattaaattagttcagacataaagagctttgagcagtgcctggcttgtaccaagtgttcaacaagcgttaagatgttattatcattatttatctggctttcagagggaaaaaaataaggttgtatgttaccttttatagcttgcttattttaaaaaatttatgattgacacataattgtacatatttatgtgataaaatgtgatgtttcaatacatgtatacattatgtaatgaacaaattgggataattagcatctccatcatcttaaaatttttcatttttttgtgatgagaccattcaaaaacctctcttctagctattttgatactttattgttaatgttagtcatcctactatgcaatagaacaccagaacttattcatcttatctaactataactttgtacccgttgaccaatctctccccattctttcctccccctacctcttcccattctctgctaatcactattctaccctctacttctatgaaaacaactttgtagattccacatatggctgagatcatatggtgttgatctttctcttcctaccttaatgtcctctaggttcatattgtcacaaatgacaacatttcattctttttatggctatatctagccataaaatttatttaattctgtgtgtacaccttttctttcttcattcattcattgatggacatttagattgattccacatcttgggtatcgtgaatagtgctgcagtaaacataggatggcagatatctcttagacatactgatttcattccctttaggcatatacccagtaatgggattgctggattatgtggtagctctatatttaattttttgaggaccgtccatattgtctttcataatggctataccaatttgtattctcatctgtagtgtgtaagactacacactctccaccttctctccatgtcctctccaacgtcctctccaacactttctctaggtactctccaacacttgttatcttttgattttgtttattaatttaatcatcagggttctaacaatcacaagattcttttccttgagattacttactttattttcctgaggaattagagatctgattccatgttttttctagttcctaaataaatatttttaaaattcactgacaggaatagtcaacaaaatgtgattcctagaattcaggatatgaatccacaaactaaaaatgttcttcctttttttttaaccaggattaaacaataacaaaacctaagtcaggatttatgggaataaagagcaaatgacatggaatcagaagaccttatttcaagtcgtaactctgctactttctaaatatgatcatttctcttaaaacaaataatgataatactgacatgattgtgaaaattaaatgaaataatatatgtaatgcactttgaaaactgaaaagtattttagagatatttgttacattgaaaaattgttcataaaaagccagtgaactcgtaggaacaaattaggaacttgatcaggaatagaaatgtcagtattcatttacctctacttgttctttgtgaacagtgtcaataccttagtcgaattcaactttaaagcacactttatcttccttcatagtgtagcaacattgttcttgctttattgaggaagatatttgggaggttaatgtagacaaagtccctacctttttatcctcatccataacacttgtttcaatggatatacaaactgaataatattacaagagcatcttacattaatatagaatttcatacttttcaaagcatttcacaacaatcatggcatctgagcttcacaatatatagtaaataatatataacccatatatgtgatatgtttgtttatatatacaccaatatgtagatttgtgaatgtgtatatgatgaatatatatgattatgtgtttacaccttttattgtggaaaaagtttagactttttaacattaacaaagctctagatttatccagctgtgtcggtgaaaaagcttacactatcaatatgagatttaaattgaacatatggccaaggaatttctatgtgtatagaaagagaaacaaataagatacatctaatcattttagttacaatgtccttcttaaagatagagaattaatttttataggacaccaatgccaaatttcagtccatttataatggaaaattttccattgcactaataatatgtaatatatggattcatgtcagtatctttttttgtcaaataatattttacagctggattttatacattctaagtgtacttcatcccaacacagttgctttttgatagtgtttttaaaaaattcttttatcttaaatttcagtttgtaaaatgtttaaaaaatttcagattcataaatccaacacctacaaatcacgtctgtgtgcctattgaaagcactcatgttccacatgcctaaagccaaacttttaactaccattcccacatgtcctcctgactatcagtaccaaaaagcagacagacaaaagtgatgcaaaccgggtcctctcctaagtatcccttttcccatgaacagcacctccattcaggcatcagcaagaagcctaggatttctttatactacctctcctttaccacccatgttcaacccatcactaggttctatcagtttaactcctaactctctttgaatctgtccacttctatctccaccttcactattaccaaattatccaaaattatagtcgtcattcatgagatctactgaaatgcattttaattggtcttcctacccgtgcttttgctactctctaatatagacatccagaatgatctttgtaaaatcaactctgatagggtcagcccttcaaatctcaccacacctcttatggcacagatcagaattattaatgtggctgagaactgcatgattcacttcagaagaatcagaagattttgaaaattaaataattatttttctgtttttttattagtgttcatcttcccattagtcttaccattgtatgctcaatgcccagtatataacactcataagtatttttaagtaatgaattaataagatgtacattatttcatcacatcattttatattataagcattttccaatatttcaatatcacttttatggtcatttaccttattaaattttttaattgtacgactgaagcacagtttcatcctcattgtgaaagtatcaaacattaaagagatgtatatcataaaatgaaaagataagttatattaatccccattttacttatttttcagtggaaaacactcatcagttaacagtatattctttcatatctttttgtgacagtagatattaatctatctattcattttaatggttctttatattctatagtatagatataattttattaaacattttcacatctgatagctattcaggttgtttccaacttttctgatattataaacaactcagtttgcaagctggtatttatacatttcagcataaatgtaagttttctgctaaaagagatacacatgtaaaattttgagatctaaggacatgcacatttaaatttttacatgtattacactatcacactttgcaaaaagatgtagtaatttggagtcctggttacaatatatgggagtacttggttttccacctacatacctttctggacacaagaaattatcagtctttcgtgttgtctcttttcttaatggacgcataaaatgatagaggtccataagtcgtaattatcacaaggtgaacacagccatgtgaccaccaccaacacctagagagaaaatattcttagccatccagaagctctagtgtctcctctcgttcactattccttgtctcctctgcagagatagactaacttcttacagcagagattagtttggcttgtttttaaattttataaaaatgcaatcatacagtatgtgttgttggtagtctggcttctttaactcaacctttatttgggtgatcagttaagctcttgtatgaacttttgttcattcattctttggcatagaaatttatttgtgtatgtgtcattattgttttaatttgcacttccctgatgtaaatgagattgatctccttgtatatgtttattggccatctagatacgcaattttgtgaagtacctgctaaagtctctggtctgttttcaattagatcttcccttttcttgtcaatttgcagtagttatttatatattcttgatctgagtcctttattcattatatattctactgatcttttgttattttgtgtttcccttttgaatgtttttagataacagatgtttttaatttgaatataccccactttctcaattttttatgttatgaataatgctcttaatattcaactcacaccaggataatgaaattaatttcatatattatcttttaaaagttgtattattttactttttacattgacaactactatctacctgtaattaatttttgtgccttgtacaaaatgtaagtcaatttttttctctcaagtgtatagtcagtcaggttgcaccaattattgaaaacattcaacttttcatactgttttaccatgccaccttttcttataacctaagtatctatatattcatagctctacttctgaattttattctgctgatttactccatctgtttttgtgtcagtacttagaatgttgaactttctctgagttctgtagtcccttaaaacagggacagttaaaggaatcatttcacattctagaaaactgtttattacacagaactactctttaccatatgacgtagataatactcatagataccccttcccgcaagtttgacttgacagtaccatttgccacacagttcatcctaaattcacctggtaattgaagtgttcatctgtgttacttacttgcttttattccaagaaaaaacaaaactcatatctctatgtcaagaagtagttacagcatggagccaggtgcttaggctaaactcccatggagactgggagatgagtatgctgccttttttgatacttacattcaaaagtgattactccgagaaaacataagaaaaaaatgcctgatttatgaaattggtaagacccttattagctttttaaaagacacacatctcaaagggacaaagaaagaatttataagttctctaaaagaaataggaggggacttcaaaattttctggaaaaacagaatttaaaaaatatatataaattttatttatcaccgtaagctttcccaggttccagacattttttgtaagtgatcatagcagccatttagtctttccctgaggaactgagggtcctgggaatctaaccatgtcaatgcagtcttacttgcattattaactgaagaaaaatggatgccccttccacacattttaagattaagaaacaaaaagaagtcagactgagccaaatcaggactgaaaggtggatgcctaatgatttctcattgaaactcttgcaaaaattgcccttgttttatgagaggaggagcaggaacattgtacctgtgaagaagggctctctgctgaagcattccaaggagtttttctgcaaaaactttggctaattttctcaaaacactgtcataataagcagaagttgttgttgttcagcccaccagaatgtcaacaagcgaaattccttgagcatcccccaaaaaactgttgccatggcctttgctcttgatttgtctgcttttgctttccctgaaccacttccaccgcttggtagccattgctttgattgtgctttatcttcaggataacactggcaaagccgtatttcatctcctgtcataattcttcaaagaaattcttaaggatcttgatcctacttatttaaaattttcattgaaaactgcttttgtctgcaggtgaactgagtacaacaattttcacacccattgattggaaaatttgctcaactataatttttcagtcagaatggggaaagctgaaccagttgagatatctgtggtgttggctattatttgtgctgttcatcattggtcctcttcaattaggacatgaacaaggtgaattttttccttgcaaattgatgtgcatggtctgctgctgtaggtttcatctttgacattatctcatcccttcttaaaatgagttattcatttataaactgttgatctctttagggggattgtcttcataagcttttggtaaagcatcagtgagttcaccattcttccccacaagcttcatcataaatttgatatttgttcttgcttcaattttagcagaattaatgttgctctgacagcggcgcttttcaaactgatgtgtccttcttagtctctcaaactaaatcctgttcggacatgttataacaagttagtatgagtttaattttgtgccaaaaatttgaaaaccacacatatccatttttcattagtgttttgaagacccctttgtactccaagaaaaaggaggtggggcaagtcactttgccttttggcaccagggaaaatctagttcttttacatctatccttacccttgcagtttcttccttttgttgttattaacagtttctggtaacaaaggccagacacacttcacttcctccaaattcttattcttcgttttatgagtggttagctgaactgtttatccccattgatccatcagaacaagcagttgacctgacttgaccaaactttaattaagcttctcttctccctataggaacctgaacactgacctaccctcaacttgagccagtattgtgatgtatagcagctcctccttaacacaaagaaagataatccctgacacttgcttacttctccctatgaatgaaatcacttttctgcctgacatttcagatgtttgcagatctcctgaaactttctttctattgcagtagtccctctccatcttttgcaataattttttcaaataatgtattttcaggcctaaattcaggtttttttttaaattttagaatactatgctttacttatcatagctttataatacatcttaatacctggtagtgtaaatatttccactttgttaacatcccaagagagagttcttattgtggtgaatctttcctaaggaaataatctaaaatatgtaaaacaggtcatatttatgacatcatttgtaaaaattaaaactacctagcataaattatgatctatttaccgagatggaatatggagctgctcttaacatgaatgatgagtttagatgatgatgattcaagaactacaaccattccaatcaaaaagtccttgaatggtgaaatgtaaaagaaaggaaaggtaggggactatgtataaaacagtgctgaaaaaaacaaatttagcaattagaaagaagaaattttgaaaagttgttggaagataaaaagcagatgagattgaattcacagaaatacaagagcagaggataccaaagcccaaatcatattcaggataaaactgatagaaatattcaagttgttgcaaagtggctgtagagataggatcactttggctaataaattcagatatcaggtaaaatcccttgtaaaaataattaattgaagaagtattcaagacagcttggataaatatcaattctactccatattcccccaactgaactgttagtagtgacattagtatcctacttgaagccctaattatagtagaaattctggcacaaagaactaaagaggaggtttggacaggagaagcaaaataaattatggtctgttcacccctgcaccccatcaaatgaatgctctcagactcagaagctaaaatatctgcaaactccatataatccctcactctacatcttcctgacaaccaagagaagcttctttctataattagagcctgtatctacattcaaagtagacattgttaaattgtgattgaaagaaatgtggaaagcataaagttctgagatgtgatagtgtctctttgcacttaccttgtaggtgtactatattctctcaagatgtccttttggcatagaagatgggaagaaaaggtttgggattgaaagactgctaaactctaacacttactcatctgcctatccactccatgatgtatgtataggtttgattgtgaaaatctgagcttattttcctcctgccatgttcattactgggagagagaatcttcctttacttcagttgcttagttttctctcatggtgggaaaatccccaaagacttcttggttctgagctgagagctttacgagctatgctgagatatatagtaaatgtatctttaaggtttcaaatggacatttattttaaaaacttttatatttgcacatgactttttattagaacccattttgaaaatagcagtcacattaaaagaacatttttgaacataatatttggaaatttctatctgagtcctttagttcttttctcatttataaagttttgaagctgtaaagaatttaaattacctgcattcacatattcattcatcaaatacatgattggcttcaattatatgtaaagcattctgttaggcattattggaacacaaccatgaatccaagctcatagactaggactctcctagaaataaagcatgtgtacaactgcaatataaactaaaggcttcagtgcataagaatgcttcaggtgttatgacaactgatattcagaagaacgttttttgggggctggcaaatcattgtacaaaaacattgagtttataagtttaatagagaagtgacattttacgtgattcacctgttgaaccaaacctgaaaacttggccttggaaccaatactcagcctaatttctgggtgtttttgatggaaaccttctcatttgaatagccagtgtttaaatttcaccacctattggcagtggaaatcctggggctgaatgtgtacatattctactttgagatcatcccttggaatgtctatttttgttgtttcttttgttacagttttactcttccatacttaaaaagactttttggtgatgtattctctttgtaagaaatatagttctcagtaatagaagaaacaaatatttcaattgaaacaagtggcagctaaataattccccatttttttgaaatacagtgttgctgtaatagttcccaaaagcccaaagccaagctcttcctttcataggacttagtctgttgtgctagttttcctctgttaatgtttaatttttgttttgtttacttttgttttttgagacggcgtcttgctgtgtcccccaggctggagtgcagtggtgcaatcttggctcactgcagcctccgtctcccgggttcaagcaattctcctgcctcagcctcctgagtagctgggattacaggcacacaccatcatgcctggctaatttttgtatttttagtagagacggggttttgctatgttggccaggctgtaattgaactcctggccaatgttcaatatttattcagtagtatgagaatttactccaggtcagttcaacactgattagtttttctgtaagagtagaggaaattttccaaaatgagtcgccattttcaacaggagtgtcaatttagtaacttaagtattagaaaaaccaaacagcctcttctttttttcaacagcccttgaacacatatatagtaaacatccactgagggttggttccagaaccaatccccggacccttggataccaaaatcccagcatgatcaagttcattatataaaatgtagtagtatttgcatatagcctacacacattcttcagcatactttaattcatctctagattatttataatacccaatacaatataaatgtaaatcgttgttacactgtattgtttttaaatttgtgtgtgtatgtgtttactgctgtttaaaaatatttacaatctgctgttggttagatttgtgggtgcagaacctgcagatacagagggcccactgtcacaatttttttttcctggggcaaagaaactcttaggagattatagattctaaatactaacatggacgtttggtaaagcagaaagatctaaagtaggttaataaacactttgcattgcattctgtccatctttcttcacaaaagacctcatagttttttttttttttttgaagattttgagttttttaaaattaatttttagggcattagttctattcttacaatgccatatcataaagccaaactaatgtcttcagtcatcagcaattttaaactatgcatgtagcctttcagtagagtcatataggctcattggaaattcgatgtcactgagctatcactggagatagctataacttactggtgattttactttttaatctttctttacttctgaatgcagtgttaggcactggattttcccttatgtgctttacagaatcatttttcaaaatacccacataggctgcttttttggttgtttaatttcttaagattcagttggattacctacagaagaagaaaaaagttggaatctgggtgatataaaatttaacaccttatcatataaagattttcacacgtgctaaattttattttatttatttttttaactttctttttcttttattatactttaagttttagggtacatgtgcacaatgtgcaggttagttacatatgtatacatgtgccatgttggtgtgctgcacctagtaactcatcatttaacgttaggtatatctccaacgtgctaaattttaaactggatatttattcagtgctgccttcagcagttcatttgtctgcagtaaaaacagaatgtcttaaacagccacagtgtacacaatactttgctaggccatgaaaagatattaataatattagtcagtatctaacaatgggaaaagaacttatgcatcaagcaataccaagccccttaaatgctaaagtttgttgtaatattttaagttctttgggaaatggctatcagtgaggacagaacaggagtctcttccagtaatagcagtatgactttggattagttgcttaatgttccttgaagtttaattttttcatctataaaaaaaagtgttagcccatttctaaagtcctatccagctgtatagtgatatggctctctgggccgtgaatattatattaggatttgagtagagaagaaagggcattccaggtgaaagaatagcttgagtaaagccaaagtcttatacttttacttgcattttgagatagctttgtgtgataatttaataaataaatattattagtttatgaaataatttcacatcaattgaatatgaaatctaaaagtaaaagaaaacatacccttgtttactaacattcttagaacagcagtgtttatttacttcgtctttgtcttttgcttcgtcttttatgtaccctcctcttgaatatctgcagggccaatattggaagccatcagaacctcccaatcctaccaatgaaagatacacacttcaccagaattgggctcgattttcctatttctacaaggagcagcctttagacttgattaagtaagtttcatacacaggatcagaccaattaaaacttgataatgtgatttttattcacaatggcataatattttttttactactattttctcccactacatttcacaacttcttgatttcatatctacactataaattagcaattcatttaggagaatgttgttgctaaactgatgaaagacaacagcgatagtatggtggttaggaggttagaccttagcatttagctaggctgaattccaatccaagttctgtctcttgaaagctatataaatttggtcaagttacttaaccattatgaaaatagatataacaatattactactttttagcacattagttataatatctatactatctgtaaaacgggaatagcaatattactactttttagcataggggctaacacttagtgtttaatacatattagtttttgtttctcttggagtccagaaatttggaacataagacaaaggttgtgtatggatgtttgtgtgtgtgtgctctcagtgagctgtgaagacatttgttctatgacctcaatcctttagatagtttcattagctaagcaagaagactatggttgcaggttatcactttaaagcatagcaatactacaagcatacaagatattaggagacatatgattttattcaatgaactattagattagagatctcttgctactataggcagtgttttttccttgatgatttatacttgcattgctatgcttacacagcatcacagtatctgtttcatgagactgatttgaatggatccatccaaatcaactgaaatgttatctcaacagtatgtttaagtcaaactagaggacacattttggaaaattaatgtcacttagtcagtttataaactggggcttttgataaatcatgcaaactctttcttgaatggctattttaactgttttgaataataatcatttaatactttaagttataaaaccagaatatttatcaaaaacatttcaaataattaagagatgaacaaagttttaagtgaaattctaccttcatcaaactccacaaaaataactaggcttgatttggataatattgatttagtcctatttttgtgttcctgcataaaaaagcagaaacatttttttttctgagagcaatggcatctttctcttctctttcatgctaatatttttctttattcactaaatagtatattactgatgtccttctatgaatacacaaagatctatctgatactatttagtggaacacagaatgccttattataaatttttcataattcatttatttgtttttctattgaaaaacattaggctgtcccaatttttttatataatttcaactttttaattttagattcagtggtatacatgcatgttttttgtgtgggtatattgcacgatgctgaggtttggggtgcagatcctgccacccaagtagtgagcatagtaacaaatagggagttttttaacccacacccctctcccacactacctcctctagtgtatatcgtagtcatccttatgtctatgtgtattcaatatttagttcccacttacaagtggtttatatataccacgttttatttatctgctccaccattaatggtcacccaggttgataccatgtctttgctattgtgaatagtgctgcaatggacatataggtgcgtgcatctttttggtagaacaatttatattgctttgagcatatgcccagtaatgagattgttgggtcaaatggcagctctgttttaagttctttgcagaagctccaaactgttttccacagcagctgaattaattttcattcccatcaacggtgtataaatgttctcttttctcccaaatctcaccaccatctgatatttcttgactttttaatcatagccattctgactggtatgagatgttatctgattgcggttttgatttgcatttctctggattagtgatgatgagcattttttcatatgtttgttggctgcttgtatgtattttgagaagtgtctcttcatgtcctttgccaattatttattggggttatttggatactgcttgttgacttgtttgagttcctcatagattctggatattagacctttgttggatgtgtagtttgtgaatgttttcccctatactgtagattgtctactctattgatactttcttttgctgtgcagaagctctttagtttaattaggtcccacttgtcaattattttttgatgttgcaattgcttttggtgacttagccaaaaattatttacccaggccgatgtagagaaagatacttcttaggttttcttctaggatttttatagtttgaggtcttacatttaaaactttattccatctttagttatttttctatatggtgaaagataagggtccaagttttattcttctgtatattgctagtcagttatcccagcaccatttattgaatacggaatccgttccccattgcttgttttcatcagctttgttgaagaccagatggtgggaggtgtgcagcttcatttctgctttctctgtttagttccattggtctatgtgtcttaccagtaccatgctgttttgcttaccatagccttatagcatagtttgaagccaggtagtgtgatgcttccagttgtgttctttgttgtgttctttttggttaggattgctttggctatttggccatttttatggttctatgttaatgttagaatagctttttctaattctgtgaaaaatgtcattggtagtgtgataggaataacattgaatttgtaaattgctttgggcagtatggccattttaatgatactgattcttccaatccatgaacaaggaatgttgttccatttatttgtgtcatctctgatttctttcatcagtgttttgtagttttccttgtagagatctttcacctcctggattagctgtattcctagatatttcattttttgtggctattgaaaatgggattgtgttcttgatttgactctcagcttgaacattattgccatatagaaagctactcacttttgtccattgcttttgggtcctgaaactttactgaactctctcatctgtcatttatgaaatctaggagacttttggtggagtctttagggttttctaggtgtagaatcatttggcaacaaagagagatagctttacttcttcttgtcctatttggatgccttttattttttttctcttgcctgattcctctggctaggacttaagcactatgttgaataggagtggtaagagtgggcatctttgttttatttcatttctcaaggggaatgattccagcttttgcccattcagtatgatgttggttgtgggtttatcatagatggctcttattattttgaggtatgttcattcaataccaagactattgagggttttttaatcatgaatggaaagggatgctgaattttatcaaaagctttttctgcatttattgagatgatcatatgttaatagtttttcctcttaatcctatttatgtggtgaatcacatttacttatttgcacttgttgaatcagccttgcatctcaggaataatgccagtttgatcggatgtattaactttttgatgtgctcctggatttggttttctagtattttgttgacaacttttgtgtctgtattcatcagggatattggcctgacattgtctttttgttgttgtgtctctatcagattttggtatcagcctggtgctggtttcatagaacgagttatggagaagcctttcctttttgagtttttggaatagtttcagcagggttgttacaagttcttctttgtatttctatctgctagtatttgggtgtgaattcatctggtctagggcattttttgattggtagatttttaaattaatgattaaatttcaaaacttataatggtctgtttgggtttttactttcttcctggtttaatcttgggagcttttgtgtttccaggaatttattcatttcctagattttctaatttatgtgcatagaacttttcataatagtattggaggatttttgatttctgtaggattagttataatatcatcattgtcatttctcattggacttatttggatctcctttttttctttgttaatatagctagggtggtctgtcttatttattcttttgaagaaccaatacttggtttcattgatcttgtgtatagatttttgcatctcagcatccagtgttagtattgatatgtgagattttgatcttgtcatcatgtcgttagcttgttgttttgtagacttgattgtatagtctctttatagtgtctttgggctatgtgtttaagtgtgttttgtgatagcaggtgttgttctttcattccatgtttagtactctcttaaggacctcttgtaagccgtgtctagtggtaaaaaattatctcagaatttgcttgtctgagaagaattgtatttctccttcacttatgaagcttagtttgatgagatatgaaattcttggttagaatttcttttctttaaggatgctacaaataggcttccaatctcttctggcttgtaagatttctgctgacaggtctgctgctagcctgatgagcttccatttggatgtaatctgactcttctttctagctgcctttaaatttttttgttcgtgttgaacttggtgaatctgatgactatgtgccttggggatatagtgtctcatcagggttctccatctttcttaaatttgtatatcaatttctggtgagattggggacatttttatagactatatcctcaagcactttttccaggttgtttactttcctgtctcaggaatgccaataagtcataagtttggtctctttatgtaatcctaaatttcttggaggttttgttcttttttttttttttttaacttttgtctggctcagttgatttgaagaactggtttttgagctctgagatgctttcctcagctcggtctattctgctgttaatgcttcctgttgtattataaaatccttgtagtgattgcttccattccagaagttcagttttgttttttcctaaaatggctatttcatctttcagctcttagattgttttactggattcctggattactggattgggttttaactttctcttgaatctcgatgagtgtcctttccattctgaattgtatgtctgtcatttctgttgttaccatctagttaagaagcattgctgaggagctcatttgaaggtaaggggacactgactttttgaatttccagagttcttgcactgaatctttcttgcctgagagggctggtgttccattaattgtagtataagttgagtatagtcaattggcttcattactgggtgctttcagagagccaaggctctgtacagggtctttatttgtagctggattcttgccttgggtttcacagttttgtatattggcagaatgtttttggtgttgtaatttggtttactatccagtagatggcacttaggagtaagagccagcagataggctcagcctcgcagcgcttcagtatttctgcctattcacagcagtgctctgtggtggggtgaaaagagagatgaccctctctccttgctggtatgcttcgggatcctgggggagacccctctgatcgctggcactgtgtctgtgtttcctttgttacttgctaatttcagtattacttctgatgtgatctgatatgatttataatttgctctacttatctctggagttcaatcaatttttgttttatatctttccactcttctctattcctttttttagtttttatatttctggggttttcttgtatcagcaaatatttatttgagaagagttcactctgtttttaggtttttattacagtattattcaatttcatgttatttggggagaattatcagactaaattatttacttcacattttctgattttgcttttgttttgcatgtttttttatggacgtggcctacctatttcaatttgtttttaatttataaacagagtttctagcactagagtgcccctctctgttagtccatcacacattctcaatgtgttgtctgtagacacctttctgcagtgttaaaaatgtcattttctcattgtgtgcctgtgttttgactgtggctcatcacatgaggtcaggggtagcattttctacttgtggcatcatgtcggcactcaaaaagtttcagattttggagaattttgtgtttcgaattttcagatgagggatgctcaacctggtgaatgggagtgagggagaatctgtttctgtgtgtgctggacctgaagcttcctgtgagtctcacagctgtgggcacccatcttcccttgccctgcgcagcctatttctttcatttctacgagattctaactctcctattttcttttttctgtttactgacactcctccaaagagtaccagtcttctctttgtatctgattcttctcaagaaatattgcttatctcaggctgccacttccagtctcactcttttcagatcctttcttatagattataaatgaccaaatccaaacatatattctgcattagggcatttagttaaacttttctctagggttattttagctgtgtttctttatgttttccaccctactttacatttttcccctataatttcttaaacatcttcacctctctcctgtgtcttaggtttgtagcagcaggtgttgtttttatttccttagttgcaggtaatttgaggatcatgactttctctgtcatgatactgaaggcctgtattgggtttgggtgtttttcctctccttgttgatttcatgggttttagtaaaggttttgtgggtagacttgataaaagttaaaatattcttaaaatagaaagaatttgcctgtaatctcagcactttggaaggccaaggcaggcagatcactttaggtcaggagtttgagacgattctggtcaacatggtgaaaccccgtttctacctaaaaaataataatactactactacaaaaattaccccagcgtggtggcgcacacaactgtaatctcagctactttggaggctgaggcaggagaattgcttgaacctgggaaacagaggttgcgatgagccgagatcgcaccactaccctacaacctagcacaacagagtgagaccctgtttcaaaaaaaaaaaaaaaaaaaaaaagcaaaaaagaaaagaatttattcatatatgcataattacaattgacacatttcttttaatgagactttattaagcatcactacatatcaagcaaggtactgtgcctacaaagataatcagatggtggtttcctaacatgaatttgtttgcaggaacacacacaaatgcgtattagttacagcacagtaatactccaaacaaaatacagagggaaaagcacctatcttcatgacaacctctaggaaagcttcacagtgcttttgaactatgtcttgaaagataagtagcagtatagtagggaaagaagttaggtaagaatatctcaggcaaagagaacacacaagagcattgtgtgtttgtttagttcttcaagtaggagtgttggcaaagaagatttgaatgttcaccaggaacaaaatcctgaagaacaatgctgaagtaaaaagatgaagctttgaaggaagaaaaggatattgctcaatttttctttagaaacatcattttattggaaacaaaagataatttagatggatataagattgaactcagggaagtaaaggctgttaaaattgtccagcaataaattttggaggtcttttcaaggcattgacaacaggaaggagaggagactatgaattagaaaaaatatttttatgacagaattcattggccctaatggattattggatatggaggacaaaaataaggaagacagaatgatagggtgtctagaaagagatacagtttataggaatctgagttcctagatttcacatatttcatgttacctctataccaaacatcactttaatgtccagatatctggaagtggtttttctgccttttgagcacagatagttttgtcacattagataatatttttggggaaaatggcaatgctaagattgagaaaaatgggctgatggagcatataaagttgaagactgatcactggcacatcagctctatcagctcatttttttttccttccagcttacacttcaggtaatttgtttttgatatccatatgttgtatgttaatgcttagaaacaaaattgaaatactgctacatactaaatagcatagactaaatatatgtgtggtacagataatgttattacaatgtgaggataatactgaagctaagtttctcagatgtttatggattcattgtaaaaataagtcattttagaaaaaaatgtttgcattgattgatttatcaagattgtattcaatttaattctatcatcattcttttgattatttactatgtcttcaactaaatattacatcttggaaatacaaaatgagagcagtcccctcacacagtatctaacacacatctacctatcagatgctgtgttaaatggtgcagtgccacagatcagttgaaagtctaataattaaaatggacaggttaaaaaagatcatagatttaaatatatggcatatttttctaaaaaataatactcaaaagaaggctctccctatatttgagcttttgtagagtgtctcatgttattagatttctcttattttcttagttatgactaacaagatagtttaaattaaatattaaatgtgatttcaataatgtatgcatttttaccatattgcaaatctaagaaatatctcctgctttctgagatcctgaaagattatttcgttgttaatctgttactgttagatacccaagtccaaagtttagtaagataatttgtatatttccacatgtaataaatacttacctgatttcatttagtaaattctcagcaatttctttttttgacaggtttagagttcttgagggattttgttttttatgctcaaggaataagacttgtgacaattgaaaaggagaaaaaagtagtactttaaaactaagattgttgaaatatccagtttccttatgaatacttaaagaatttttaagttaagtctatagcaataatgttgatattatatttctaataacattgattctgccatttttaaaacattaaaaatagacatggtaaacagtaaatttcataaaatatatttttgtactttttctgattttgatgtcatgtactattacaataatttctacatttttcagaaaaaaactgggagaaaaagttcattcactctgagtaagctaaggaagttgtgaatggcagattagcaagggaatatgatggcattataatttaatttcaagtttatagtgatctggaaaaccaaattagggaaattaacaatgcaacaatgttcatcatcactgaaaagaatgaaaaaagacaggataaacagaaagatgcctattaatattaagagtgttgaaatatgaagaatgggatgttcaataaagttaatattgaatatgataaatacattttaaaatctcattgagaaaaaatgtttataacctttatgttcagatatgtgttcttgttaagcatatatagaaattacaatttaatattaagtactttcacagaatcatatggcatgctactagaacacaaaaggtatcacatctttctgcctaggaaactgtggaaagactcacagatttggtgagctgggatctatatgaataaggaggaagattaatcaggttaaacaacaacaacaagaaaacctgactttctgaggaggagaaaactactttctctcattcctaaatgggtactaagttaaaaacaaaacacttggttgtgagaattaaaatgttgtgccgataaacgctgtcacttttcaattctttgaaaaccaagagctaggctgcatatttcatagaatttttgctaaagtagtcatgtttaattccttggcctgctgcatatgtcacaatcctgtaaacatccaagattcaaacttggagaaagatggaaatgtatatctacaatgcggtcagagaaatgttttcagttttagagagataaagcaaaagtccatgcagattttggatatggttttgatttgttaagttcattcctagaaattacattgtagaatattctgtagtttatttaaaaaccatttaaattctctttataatacagaggctttccaaattatcttatttaaattttaaagttaaattccgtttaattggctttctacttatatctgttatcccttttaatccttgtatcagtccttgcagtatggcataagcaccatcttgtgttaaaacatgataatgatatggaaactgaagtttagagagttgagtaacttcaccaaaattacatgtctagaaagcagtggagccaaaattagaatatatgcctgtctgaatacaaaatcaaggctccagactataacattcttccatattctgattctgtttttactctttttcacaggaattattatggagaaaaaattggtatctattttgtctttcttggattttacacagaaatgctattctttgcagctgtagttggcttagcttgttttatttatggcttattatcaatggaacataacacaagcaggtaagtgcacctgagttgcccagatagagaaaacatctttatcttgtgccaaatgaagttgttgttattatttccctggcatttccttcagaatgtttccttatagcagcagataatcgatattttccaaaaactactcaaacataacagttgcctctcacctggtgctttatggaaaatctgtttttaaagctgggctctgaaaactctactcctcaaagcatgacttgacccactatagaaattgctgcttgattgccccttctgttatatgtgagaagttatataagtagttgttctaataagaacagcttggacttttacctaaacacctatcactgttcaataactttgctgttcctcttgcagcactgaaatctgtgaccctgagattggtggtcagatgatcatgtgcccactctgtgatcaagtgtgtgattattggagactaaatagtacgtgtttggcttcaaaggtatgtatgcattgtaacatgttgaaaagacttggaattttcctcctttttattacatttagtactaaattatctttgtgatattgttattgttatttttacagttctcccatttgtttgataatgagtcaacagtgttctttgcaatattcatgggaatttggggtgagtaaatagtcccataaagaaacagctttcttcctattaatgtgttgttttgcctccatataacatatgacagatgaaatatcttacataccaaatgtggttttagatcattgtgtctttgttagcattaatatactgatggagtgcatattagtggccattagttcttggtccacaaaggtctctgttaaacatcagctcatttctctaagagacaacataatttttgaaacatcaaatgtattaatttcccactgtctttcagtgccatgttaaaaacaggctcaaaaaatacttcattcaggagagactaaacaaatattttgtggctggaggatattgatcatgtatacaaactggaacacagatcaaaaacttgaggactaatgaacatttttgagtataaattgtctagttacagttaccacttccacactcattcattaaaaatccttcatatagaatggaatttcccttaactttgaaaatgccctgcccaggacttcatattttaaccatttcagttggaaagttaaagtgtcatgaagtttttcctatcatcagcaaggaaaatgttttctgtaagaataacttcgttggaagagacctaaagactggtctaaaatatatcacaaaacttggagttcctgggtgtaaattagacatttttcccagttaaaaaacacctctaacaaacacaaatatatgccattcaaaactgggcaagggcggccaggcacggtggctcatgcctgtaatcctagcactttgggaggctgaggtgggcagatcacgaggtcaggagatcgagattaccctggctaacacggtgaaaccccgtctctactaaaaaataccaaaaaaaattagccaggcgtggtggcaggtgcctgtagttccagctacttgggaggctgaggcaagagaatggcatgaacccgggaggctgagcttgcagtgagccgagattgtgccactgcactcaagcctgagagacagagcaagacgccgtctcaaaaaaaaaaaaaaaaaaaaaaaaaaaaaactaggcaagggctgcattatccagtcaaataacatcaaaatttgtagtatgtttgcaaagcggagggatttatggctttctctcatttctgcttggctgctgtggtctgaagagagcagcctagattcaaagaaagaataaagaatctagaaatcttattaatggtttaacagcaacctcagtttttgtaagttgttgtatatacatccatttttcatgaggctgccaaatcctacctctcattacttggaatcaaaaatgaatgataggtgcatgattaaaacaaatacattgtgagaattttccattgtttccattgagagagattgtgcaccaacacctgccttatattacatcataaatagaggagtgggtgtgtgtggagcacccttcagcactatttgcagttacttgatcacaagtgagactgatcacatttttaatatttactgaccattggctctccttgatgtttgaagtatttaaatttttttatgattcacatgtgcttttgtataataagcacagtaatcctttgtctgccacataaattgcaaatatttttttcagtttgtaatttacatttgatctcattcgtagtcaatggacattttaatatatattactggtcataaaactttccttatggtttttcttgtttttgtgtttctttagaaaacgttccccactgagagataatgtaagatgttcacctatgcttcatttcagaaatttaatgatttcattttatttatactttaatataattcagcaactagtttttaaagtttctaccctggaacaggtaccattctaggcaataggaatttaaatatgcacatacatggtccttgattttaagacatattttgagtgtacatgcctccatgattgcaattgtgtataagccaggctcatcactagattacttgctcctttaggacaaacaccatggctttcatctccatagttccagggctaggcatatggtatgtattcaaatatatgttgaataaataaataatttaaatgctaattgtattccttcttaaaaatgaaaaaggtcaagtcctacttaggcacaatctataaggcccaaaccaagggtccctttaatttcctgaaatccttttcagggaatatatgaatcctgtgattcctatatacttataatcacaaaagtccgtagaaatcatgggaacaatattgtttttagtccacatcatttctctttccttacagtactctttttgctaactattttgtaccatcattaatttatctcacaatcccatctatgttggccaactttcttatttctacttcagcattaacaaactttgagacaagaaattttaaatgattagtgtatttaaaagttttagcagtatgtatatgacatccaatctcttgcatagccatagtaaccaaatactgcttctaaaattaatggtagttgttctattgtagtataaacaaacaagcaaatattaaaatgtttaatagtaccaagttcatgaaactgttctccctgctaacaatgtatctactgcatacagcagtaatgaaatgagtagagtagaagtttctgccttacgaaattcacaaccaatattaaatgatagaatgaataagtgaatgaaatataacctgttgttaagaaagttacaatctaattgggttagaatctgaagtctactttcgtagaagtgcattgtaaatgctgagggagtacagaggagggctgaattactttttgactggaggagttatatgaggtatctaaaatagccaaacttatggaatcaaagagtggaattgtggttaccagggctggacgattaggaaatgagcagttactaatcaataagcatactttaaagtttcaattaagcaagatgaataaggtctgtacaacattgtactaatggtccacaataattaattgtatactttacaattaagtggttagtctactgtgttcttcccatttaataaatgtttaaatatttctttaaagtttaaataatgagcaaaggaaaacataagccaatgtatacatgagcaaataaacaaacaaaaaaacaacagtcagatgataggtatatttgcactggaaaaatatattttggaagctgagagagcaattagatgactgtaatgataaaaatataattaggatttttaaaaatgtatggatatcatccatagttccttacattatttaaaaggtagagagtgagtcagaaagttgaatcttttatagatgatacaattatgagttaatattggaggtgttagtattctcttcctaagtatatccgaacagaaaggcatgtatatgcccaccaatagatacgtacaagaatgttcacagcagcactatgtgtaatagcaggtatctggaaacaactcaaatgtctgtcagcccaagaatatataaccagaactgcaatttaaccgtagagtcgaacactatgcagcaatgaaaataaatgaattttcgctgtacacagcaacaaagttgaaccaaaaaaaaaaaagcttgacacgaaaaagtatcagttgtatatcatttaagtaaatatatttgtaatggaatattttttatattggtgctggttatatgggtatatttattttgtgaatttttttgaattgtacatttatactttatgtatttttctgtaaatatatattcttcaattgaaagttgataattccagcactttggggggctgaggtggaaggatcactagaagccaggagttcaagaccagcctgggtgacagaaggagactcaaataaagacataaaaagaaagctgaagttttgtgtgtatatatagtatatgtagtttaaaagagagagtaattgtgctggggattggctcttatgcttcctaggtatatttccccaagcctgagaaagcagtacaaagacttgaatgatttcaataaaagataaaagatacatgcaaaaaaaaatatttcagtgttaataaaaagctaagttcaaatattacttcaaattgtctgaatgaagaaatatattaatatgtctgaaaaaaattcttgcttggaccactgaccaagaaactaaatttttgtatgattttttttcagtgtattattggatacacaatattatgccaacactaataattgatgaagttttaatcaaacacaacagtgaaagaatagccacctgaaacatgtgaaccatcctgcaaccaaagtaattaaagggaaaagttgaaaaagtttttaacttttttaatatcttttttttatatatttatttacctatagtcaccttatttttggagttttggaaacaacgacaagccagactggaatatgaatgggacctggtggactttgaagaggaacagcagcagcttcagctgagaccagaatttgaagctatgtgtaaacacaggaaattgaatgcagtgactaaggtagactagaaaactgtgaaacggacagcatatctcaatggacacactgctataggtttcttctcatataatcatagtttattttgcctttaaaatattctgcaacgtataaatcacataaacttctttacttgtttctaatatacatacatgtatataaatgtatatatagaatgtatatatatgaaaattttcaaacactttcaaatgtagatagaaaaatataatgaactacatggatgaacccatcactcagaatgaatcgtttttaattcatggacaatcttgtttcattcatactcatactcttttgtgtcactaaattatttggaaacaaatccaaggcataataacattaaactaagtgcaaaaaggaaaataatgtgtatgctgtgggctttgcatataaatgtacagacattgaaatgatgctaagtgatatataaaaattaaaatagtatttatattaagattgaggtcttatgttttattagactaacttttcttcacacggccccttttaactgattatattgagaatcattgtatttgtgtatgggggaagaagtctacatattagaatgcttagctgacaaaccagctatatgttcttgactgagttgtttaactttttggtacctcacttttttcatgtgaaaatggaagtgctttgcctttaaagaccagaatcttggttacatattttttgagcccctatcttcccgtaatctacaatcactgtgtttcctgctgctatttaaaagagaataatatgtgtcctaaatacactctcttcaatagaattccctattctcttcagaaaattattctcgcagtataacatttaaaattattttcaccatttaggcattcactgaacaattactaaatttcattgaaagatcatgaaaacatctcaaaagatcatgaaaacatctcagaaaatacattaacaatgtgggtggcagtttgaaattaagaaaatatattaaaagatactgacagaataatgacatgatgttcattcctatttcacgaaataaaaaagtaaacaaaagcagtcctattagctttgccaaaaattaacagaaaaaaatgtattgaatgcttacatttgaatccagttgaaaagccatatgtattgattcactgtgaattgttggcttcacttagctttcatggtttagaaatcatgaaacagagtttttttttgttttgttttgttttgttttttacttattgcagtgcttcctcagtgtttaaggacgaccagaactgtcacatttgagtccacattgggaacacacatgtgcacccacacaaatatgcatacagatgcatgaacacgcatacattgggtgcacacatgaacacacatgtacacagtgacatatatgcctacatgcacacacattctgaggtgtgtaggactcttggacagctgactctgcctgttgagagttctatttttattcagaccaccctaaaaattcttaaaatgtgaaatattatgttatggaattacatgattttgatttctgctgacagcgttttttttttgtttgtttgttttgttttgtttttttactattttttgcttcttttgggtaaaatctacttacttcttgatgcacctaagaatgtcagctgtataatcaatatctttcattaataactcctaaagactaaaggtggaattcttggctcctgagctatgtggaagaacacagtttatctgaaaaatataaagaaagcatctaatttaatatcatgcagagcaatgtaattcaattcaattagaataaaattataacaccattaaacatcataaatcatgtctacctaggcagcaaccttcattattcattatttgactttatttactcagtgccaggccctaaacattgtaattcagcatttaggaaattgtgtgtatccattatgtttcatatcatgtgtaagataacccatctaggaggcctggagatttctccttcaagagaaggaaccattcctataatgtagctttccatgacctatagtaggcccttttgggagactcctactttaactgggctctgtgatattgactagtgcttggagtcttgacttagaggggagattttgaatttctttgtgatttcttcaatattacaggagatggaaccttacatgcctctatacacgcgtattccatggtactttctttcaggagccacagtgacattatgggtgagcatttctttaaaaattgctataatttcttcaacaggtgattaaatgagctatctcaacagtgttacctacaatgtctcttgagtctttcctttccctctccctccctggtctttttatcttggttatagctcttatacaaaataaactgtaatttatgtggattttccatacttaaactttgggaaaagatcttggggaaaaggaggtactttatcttaaagcccgtccctccctgcctcacgacacttcgtttaagtgatcacttgaaatcaggacagaataacaaacttactctgattccaggctctttggttagttttagaaaaatcatgaatgtatctttatttccaccttatttcctgctcttcctttttccaaatgtgttccctcttaacacttagcatctaattttaggaaaacaggcagtgttaccttctaagaggttagttagcatgttgaaatataaataattgacagttgtagactatagtttagactcaccagtccataaaccccatatgatttatctttagcatttcttgttaaatctactattttcatattttaaaacagtaaaaatatgttttcttagattacataataatcattgaggagatgtgataaaataaaagggggagaatcattaattcaggactctcttttgagaaatcttctggagtatatccccagaaaattattctgtttttgatttctagttttcatttaatttgactcgcttcctcaacttttagaataaaattctctaatgattgatagaaagccatctttgtgcttttgcaatatgggaagtatacaaaatttatacagaatgtatataaatttctaaactaccacgcatattagcgcactaatggcaatattctgaggggaaatgaaatacaatattgacatgtatttttcttaggaaaataagtgatcttgattctacatctttaacttcaatgtagagcatgagtcagcaaacattttctgtaaaggggccagatatatttttggctttgtggccacatatagtctctggaacataattgcctttatttttctctataacctttagaaatgcaaaagaaggctgggcgcagtggctcacgcctgtaatcccagcactttgggaggccaaggtaggcagatcacgaggtcaggagatcgagactatcctggctaacatggtgaaaccccgtctctactaaaaatacaaaaaattagccgggtgtggtggcggtcacctgtagtcccatctactaaggaggctgaggcaggagaatcccttgaacctggaaggcggagcttgcagtgagccaagatcacgccactgcactccagcctgggcgacagagcgagactctgtctcaaaaaaaaaaaaaaaaagagaaaaaaacacaaaagaacattcctaatttaaggaccagataagatcaggcaaggccacgggcaggatttggctttctactatagtttgccactccctactagaggatgagcctagaggatgagcaatgaatacgtttctcttttagacttaatcagcagctactatatgccttatctctaacccttttaccttgccagtgttcatgtcttgccatctagggaaagagagactgacttagtttgctttgcacatgagaactgctaaacttcatataatgagatgaacagaataatcaatatgttagatatatattcataacagagatacagagacccaaatagcagttctttgttttcctttcccagatgtctcttgtcgtcaccagtatggtagctgtaattgtgtaccgcctgtcagtctttgctacatttgctagtttcatggaaagtgatgcatccttaaagcaggtcaaaagcttccttactcctcagataaccacatcactcacaggatcatgcttgaactttattgtcatcttgatcttgaatttcttttatgaaaagatatctgcctggatcacaaaaatgggtaagctggccaaatcatttgtgtgattctgaagaatgattcttattgatgctatatgtctattttggatcaggtctccaggagttcattttcaaaggacacattttaaggcagtttttctctataaatagacccatatctgctatttcaaaattgctcaagagccaccattcaaggtccattataaaggaagaggcaaaataactgaaaaaaaaaaaaaagaattctgactctatatatctttctcagtatccttgtcttaattctcccttgatgggtctagttgaatcctaagaaaaataatcactttactgaagacacagataatttttgtttcatgtgtatggttcttataaagtattgattttggaagttattgtgagaaaaacagaaacatcagcttctcctaaataaatctaaattttagcgcttttcttttctactgctatctcttagaatttggaatattttcttgttaaaatattaaaatttctacttcaagccacaggggaaagtgaaaggggtcacaggttaagtgagaaattgagttaagtagagcagcacagagcacagtcgcttctgctctttttcctggcaagttagcagtaagatcggaaactcaaatcaaggcatcagcctcttctctgagtgttctctccagggttcaagctcgtttgaatctgttgtacatagacatcatggctgacgtcaagcaaaagaccacattattcagtcagcgctggaatgatcactgagatgagactttcattatatactatcttcaaatttggagttctctcccatttttacttttctctgctatcaacagtgagaaaatcatagcagataaattgcttttaaaagcacctaaaaactcaccattttcctcaatgggaaaaaaaatcaagttcacattacaggttttgtaggaatacagctacatttcactaaaatgggggagttatctgtgtctttaaaataatttgtgatactcttccagtattgctgaaaatgtcatgatttggctggatcagctcatgctactgggagatcatcagctcaggaaaacatacttttctacatttttgtgcttcatgatcctctattgcagggtgaagataatttaatattttgttatctttagaattcattaaatgacagatcatgatcatgcattttaaataaaggagagggaaaatgtgtattgtttctgccactatttgctaattacattattttcaaaattaatatagccattgaattaatgagagggcaacacaattctgttggaaatcatccctgcccttgacatgagcttactttctttaaacctgattgtaaaacagatgagttctaatggcttatagcatggcagatagtgtttggagatgagcataagtttcttcagtcttatttggtgtattagtttgttttcacactgctataaagatactacctgagactgggtagtttgtaaaggaaagaggtttaattgactcggttcacatggctggggaggcctcaggaaacttaacaatcatggtagaaggtaaaggggaaacaaacacgtttttcataaggcagcaggagagagagagtgcatggggaagtgccacactttaaaaccattagctctcaattggcgaggcatggtggctcatgcctgtaatcccagcactttaggagacagaggcaggtggatcacgaggtcaggagtttgagaccagcctggccaacatggtgaaaccctgtctctactagaaatacaaaaaaattagccaggtgtggtggtgcacatctgtagtcccagctactcgagaggatgacgcaggagaattgcttgaacctgggaggcggaggttccagtgtgctgagatcacgccactgtgctccacctgggtgacagagtgagattccgtctcaaaaataaataaataaaaccattacctctcttgagaattcactcaataccaggagaacagcatgggggaaaccacacccatgattcaatggcctcccaccaggtccctcccttggcacgtgggaattacaatttgacatgagattttggttgggacagagtgccaaaccatatcatgtgggtttgaatttcaaattctgtgtaaccccaagacaagaatgctgtctctctgactgtggtaacaatagcttcctaggcttttccagtggttagtttaatacaaaatgtgtaacagaaagtctagcacaaatccatagttacttaatattggcctactatcgccagaatggggagcattctataggctcccagaatgatgtgactagatgttcacttgtcctagggagtacgaagttcaaggaaaaaaataagaagatgcactaaacatttttttttaacttaacagaaattcctcgaacataccaggagtatgagagcagtcttaccttgaaaatgttcctgtttcagtttgtaaatttttactcatcctgcttctacgtagctttctttaaagggaagttcgtaggctatcctggaaaatacacatatttatttaatgagtggagaagtgaagaggtaagaatttccttgagagttgaggtgtgtagcttcaatacctcagtattaacaactttctgtgtgtcaagcactgattcacatgctaaaaaattacaaaatatatctaggcactgactctatccacagagagtattgttcacagatgaatcctgtcatttgataaacttctcagtttatttttgagcaagaagttacattatgcctatggtttagcagtaaaatatgaaatataaaatgacataagttctttattcctgaaaatttcctgcaaaggaagactgattactttctgtagaaatggttccactatgggtagtagagttagaacagatccatggcttccaaattgtggagaatggaagatataacaactcccaaccctaacccagatataaagaactcagaattttctaagaatgagacccagaaatctgtgttttttaacacagttcacagatgaatctaatgcagctagcctggcactggtctgtgatcaggtttggaactattgggctaaatatatcttaacccttccaaccaaaacctttagattctaattttatagtttagggtttcctttaggtgttgcaaaattccatctttgatcattcaattctgttttctcccctcttgcttctgactagtgtgatcctggaggctgtcttatagaattgacaacccaattgaccattataatgaccgggaaacagatttttggaaacattaaagaagccatttatccgtatgtatgacttacaagctttttatttgatttaagtaaccatgagatatttcctctagaagaagatggaattttttgattaccatggtgcctttgttagaaaatgtttaagccaaaagaaagctttatttttaatcaacagtgaaggttgcattaaagtaatataaactcttatttttatttatttatttattttggttccatggctagcaaggtttttaaaaaattttatttgacaaataataattatctatatttatgaggtacaatataatgttttgaacacaatcttttaaatatgcatttttgttacttttctttcctgtgaagatttcactgggacatctaaatgctatatcctctgcagtttattctacatgctgtgtattatttctgaatattactaaaaggtgaactttgtaaaaatatcgatgtgtcatgtaatctaggcataaaaatagattgtaagtgaaatgatggagactttcaggtcaatacatgaaagattgctctctgatcaaaacacagcaataatgaatacattataaaaagagaaaactaaactgacagtttatctcaaatagtagatgaaaattgtcatggataaaaagagaaagaattataaaatcgtaagtctacgatccttcagggctcctagttaggaaatgactgtgtcagggtttggcatgcaatacaaagtggagtaaaagtgctccacttaagacagaggcccatccactttaactgcacttgaagccagagactgggtttattctcactcatgaaagaagactgaaaacaccatccctgcaccttcccacctccaatatacacacaatttcatagtgccacttagggctctatttcaagtactaacaaaagaagaacatggacttatccttacaaatggtaataaatgtaagcctagccttctagtttcatgcttagatataccacatccataagggaaatagccaaacctttttttttttttttttgagacagagttacactctgttgcccaggctggagtgcaatggcgcaatctcggctcactgcaacctccacctcctgggttcaagcaattttcctgcttcagtctcctgagcagctgggattacaggcatgtgccaccacacctagctaagtttctgtatttttagtatagatggggtttcaccatgttgaccaggctggtctggaactcctgacttcaggtgatccacccgcctcagcctcccaaagtgctgggattacaggcgtaagccaccatgcctggcccccaaacttttattttaagttctagctctagattgagaacccagaggactgaatggaggcaatacctaaaccaaacagaagatgggggatacatatacacagagagggagagagacaaaagacaggggaggtaaaagaataaaaaaattttaaaaaaaaaacaagcaaattaacaacaacaacaacaacaaaaaccctgaaccttcctaataacgaaaatttcaaaatgtggtaatatttaatgctacaaaggctgtgaacaaaatcaattattagaaagtgaacttaccccagctgatatttctaactagaatattctggaaaagcccttaaaaaatgatgttgacaatactaacaacataaggaaaggtgatactgtcattaaaatagatcaggaaataaataaaaactgacagaaatgaaataagaataagtaaatatgaaatggaagcaattacacataagtgaaaaattataccttaaataatgagtacaacaagatgggaaaattccagagtacagttccagcctggacatggttgaagaatgtattagtgaattggaaaataatagtgagaaattcctaccttgtacagtgtaacaaatatatgacatttaataaaaataaaataagggtatgttagattaagaggcttccacattaatctactagtagttccagaaaaagttaattgagtcaatgctgaaggaaaaaaatattcgaataggtaattgctgaacatttttcaaaaatgaggaaaaacacaagtttcagaaatggaaacaaattctgagtatgaatcaagataatagaattcaattcatacccagattcattatggtgaaactacagaacaccaaagataaacagacaatctttaaaaatcttagatgaaaaagattaactttattcaaatgaatgacatctacactatcatcagtttctcatcaatagcattagatgccaaaagataatgttttcaaggttctcagtgaaaatagtgttcccctttcatttctagaaccaggttaactattatttaaagtgctggtaaaatagacatttttagacatgaaaagactaggagagtttgcatgtaaaattgtcacggaaagaactactgaaagattttcttgagcaaaaagagatcacaaagtgaaagtacaggatgcaagaaacattggttagcacagaatttgttagctccaaacaaatgaaattatttggtagactctaaagtcatatagaatttgtgtggggagaactacaaaatcctgattaaagaaattgtaaaactatataaatggagagaaatatcatgttggtggtcaattatccccaaattgatatatagatttattgttattataatcaaaatatcagcaggatttttataggtatagacaagtggattctaaaatttatatggatggccaaggaactaaaataacccaaacaagtatgataaaagaagaataaagctgtaggaaacaccctactcaattttaaggcttactacaaactatattaatcaagacaatgtaggattggtgaagggatagttatataaactaatggaatggagtagagattgtagaaacagatattacagaaatttgtgctctagccaaatatgaccatttaatttaagacaggtgcaaaaacaattcattgatgaaagagtagtctttttcgtaaatggtgttggaaaaattggacatcgcatatgcaaaataatgaaactctatgtgaaacttgctcctcattcataaatgaactcaaaatggatcatagacaaaactattttttaaaaagcaaggaagtgattattataaaatttaagataatggttatggatgtggggattgaagaatttataaatggaatgaagcacatgaaagagcttccgaaatttctagccatgttctgtttcttgaactgagtgatctcttttccattgtgactccagttagagtatgctcgtctgtttgatagtgtctcagaaatcacaggtgctttttcctctttacatcattcatttttcctctttgtgttttggtttgagtataagcaatatacaaatgttcctcttaatccacatttgctacagtacttcatattgtcttattaatttttgccaactgggggttataaatgatatctcattttagtctaattttgcatttttctgattaacaacatgaataagtatttttggccatatttgtttccttttcaattaaatgcttgttcatgttgtttaaccattttcctacttgtcaatcttttttcaatttatttctatgaatacttttaaacttctggttactggtttttgtttatttgcttcttttttggttatatatgttgaaaatattttattctaacataaatgttatctttttattttttaataatatgtttaggtcacagtttcacaaccacagaattactgatataattcttagttgtggggtgtgggttatcctttggattgtaagatgtttgacagcatccttggactctatccactagatgccagtaactcatccctctccagttgggacaaccaaaatatctccagagagtgcaattgtgtcattgtgggcaaaattactcccagttggaaaccacggctttagatgaacaaaattacataactttaatgtggtagaatttatcaatcttttattttatgtgttagcatttttaaagaattgtttaagaaatattttcctacccaggattataagacattttcattattatttactatatcggttaaagttatgcaaaaagtaaggtcctaggcaaaatactggatatgcagatgtactgataaaaagttatatggaaacacacacacatacacaaagatattctcatatacttacttctaaattttttatacattttaacattattgtttttcactttcaaattctaaatatacgtggatgggatttttacgtttgatatgagatacaagtctgttttttacatatatgtgtatatatatgtataaactatatatttgtataaatccttatattaccatttattgaaaagttcctttttcgtatgctccatcatctacaatactcttcatctacatacaatattatctacaatactttttatgccatataaacactatctacataccatataaatatctacaattatatatatatatataaaatctatctacaattataccaagtgcaaggctatttcaagttttccactctatcccaagatttgtttatccctgtaccagtacaacaatctctctctttttttttaactgttcagaggtacatgtgcagatttgttacacaagtaacttgtgtcatgggggtttgttgtatagattattttatcatccaggtattaaatctaatacccagtacttattcttcctgatcctctccctcttctgacactccaccttctgataggccccagtgtctgctgttcccctctatgtgtctgtttgttttcatcatttagctcccacttataagtgagaacatgtggtatttggttcttgcattagtttgctaaggataatggcctccagctccatccatgttcctgcaaagaacatgatcttgttcttttctatggatgcctagcattccatggtgtatgtgtaccacatttgctttatccactctaccactgatggacatttaggttgattccatgtctttgctattgtgaatacagtactacaatctcttaattaatatagctttctaaatcttgatatctggtggggcaacatttatcaacttattttttatctgtagaactgtcttggctattcttggtcttttatcaatctatatagattttataaacatcttgtcagattttacatggaaaaataatttggctttttcattgaaattatattttaattgtttcaatataaacagttgacttttttttttaataataccgagccttcttactcgtcaacatttaaattggaccttaatgaattctaataaatattttaaacttctacatataggtcttataaatcttttgtcacatcagtgtctaggtactttttaattgctattgtaaatgatatctttttagaatatatatgttttctacttgtgtgttgtgggtgtataggaatgaaatatattaataaaccctaatattgtttctactcatttttgtctaacttcacttgggttttctattcagacaatcacatcactgttaataatcacagatttctcctttatttccaaatattttgcctttcttattttattttactggctaagatctccagcaatcttgaatgtgatcatgcaagtgcttattttgttcttgattctaaaggaaatgcttcagacttttcccaagtaagaatgctgtttgcagcctggtgcattggctcatgcctgtaatcctaacattttgggaggctgaggagggaggattgcttgagctcaggagttcaagaccagcctgggcaacataatgggaccccgtcatgtggaataaaatttaaaaattagctaggcatggaggcacatgcctttagtcccagctacttgagaggtggaggcaggagaaaaggtcaaggccgcagtgagctgtgatcacaccactgcactccagcctgagtggcagagtgagaccctgtctcaaaaaagaaagaagacagacatagagaaagaaaaaaggagagagggagagagagagaaaaggaaagaaggagggaaggaaggacggaaggaagcaaggaaggaagggagggattaaagaaaggaaaggaaaggaagggagaaaggaaaggaaagggaagggatgggaagggaagagaaggaaaagggaagggaagggaagagaagggaagaaggaaagaagaaaggaaggaaggaaggagaaaaaaagaaagagaaggaaaagggaagggaagggaagagaagggaagaaggaaagaagaaaggaaggaaggaaggagaaaaaaagaaagagaaggaaaagggaagggaagggaagagaagggaaaggaagaaggaaagaagaaaggaaggaaggaaggagaaaaaaagagaaggaaaagagaagggaagggaagagaagggaaaggaagaaggaaggaaggagaaaaaagaaaagaaaggaaagaaaaaagaaaaggaaggaaagaaaaaaagaaaaggaaggaaagaaaaaaagaaaaggaaggaaagaaaaaaagaaaaggaaagaaaaaaagaaagaaagagaaagaaagagtttgccctaggattttagtagatatttctgataagactgaaataatttttttctatttctacttttctttcctaagtaggttttaataggtccttaaaatatatcaaatgcatttttctgcatcaattgagatgattttatgtttttcacctcaaaccagtcaatgtgatatatttattgatttgctaatttttctttcttaaaaagcctctttttaaaaaaagtggtacattatcataatatatcatctttttatatagcatggaatttagttggttaaaattttgtttaatgttattccatttattttcatattatgtaagtcatttcctattatagtcaatttcatatttgtttgaattttcttctgagcatcatgacagcatcaggattagtaagtggtcttagtggtaactctctcctccacttattccttagccaaactgtctctgagtaaatatatttctctgagcagagtaaagattgtctcattttctcaatcaccctaataaagaactcttgacttctgcatgtgtcatgaaaagaacaccagattttgacttgcgctttggctggtgtcatttctctttgctctgtgatcttaagttatttaatctctaatttctgccagtttccagatctaacactctgattctctgatcgctttctttttggtcctatttcatatattaacttttatcacttccaacagcttggctttgaattggtggagacgccgaaaagctcggacaaactctgagaagctgtatagtcgatgggagcaggatcatgaccttgaaagttttggaccccttgggcttttctatgagtacttagaaacaggtaatttttaaccactgttttgaaacatagagttggcatgaatgagtggtttttcagctccagatacttctttctgccttgcacatggtaggtgttcaataaatctttgactggttggcaaaaaagatgagtggagggatataaagaaaatttgttccctatttccctgttccatcaaatagactgcagaataaagtttagcttcaaaacaccaatctcagagacataattcctgttaattgaatgttaatattgttgaaccaaatcaagtaagagtcattttttaacacccatctcaaattcgctttgatggctatttctccatttgtttgcctcagtgacagctcaaagatagaataagtagcctggaaaacatttccagagtttgacttgcaattagtatatgtcctttctgtgaggctaaaaataaggctaaaagcgattgtgtaagggaaatataagctgaacacaagaaacatccaaaacattgcaaggtttgaacagagaagagacccttgaggagcagctttcagagagatttttcggggaactgcttatatggtctgctcagagcgttttccctcaagcaactttctctgtttctctcgcagaattaaggaaactgtttgagacagagtctcgctctgtcgctcaggctggagcgcagctgcccaatctcggctcactgcagcctccgcctgctgggttcaagcgattctcctgcttcaggagaattgcctgtagctgggactacaggtgcgtgccatcacgcccggctaatttttgtatttttagtagagtcggggtttcaccatgttgatggcctcgatctcctgacctcatgattctcccgcctcggcctcccaaagtgctgggattacaggcgtgagccacagcgcccagccaggaaaataattttcttacctttcaaggcccataaaaccgtggtaggatacatgagatgagccaaaattcttcatacttctccagtgtaatacattatgtgatacatggattgaaatataaatttaggacaaatagaagctattttatagaactctttgtaaaatcagataatctttgccttataaggtgataaggctatgatttttaattgtgtaagtttcaaatgagtttgcacatatgtacatcagagattactactgaaattaaaaagttgaaacaaaggtttcataagattgtttaccacttattaagacataattaatttattctgaaaactatattatctctaattttgaaacaattctgcagagtattcattattctacacattttattgttgtgaattctgaaacttgcataggttaataaattttttatgggccacaaagattttaggtaaagatattagatgtgaacctagaaagttcatgctgcttctacataatacttcctcttcattttctacctcgtaggttaggtagagaaagcaggaaaaaaaggaggtgaatatgtatttttttcacttgataagacggattcagtcagatgagagatgctaaattccagaaatatttgagatatatttaaaaatggaggaataacggaaatttttttcctttaatggaaagccatttccattaaatggcttattatttttttcttcaatcatgtgggaaagttgggctgttaatagcatgggttattttaccctaaacattgttggaaacaaaagaataaaaatgtggagataagccagcttacacaggtgtggtcctctgttgagtcttaatgaggagagagaataaaatttatttagaaagatgtcatgatagtaaggagaataaagaccttaacaaatttcttattctagaaaatgtatatttccttttccggcacacacacacacacacacacacacacacacacacacacacacagctggctgctgggattatacaactgaatcagtcatcattcctgatctcaaaaattagatgggctagcaagatagaaaaacttggttacctcactaaattgctaatatagatgtaaagactagacaagcataaacctaagcttagcccataataaaaggcaaagaggaatagaatcttccttgtaacaagcatatctctaaaggaagagcaaagaaagaactcagccatgcatgcccagtttctccttccagttctagcaagcaggtaagtcactgtgcctcctgtggtagaggaggaactggacagacggatggaagcctggattgtcgtattcgtgtggatcactccaaaacgaaggaagtagcaggatttgggcagggtgttcctgtctttctccttcacaataatgagttcatgcctttttcttttctctacagttactcaatttggatttgttacactatttgtggcctcttttcctttggctcctcttcttgctctcataaataatattgtagagattcgagtggatgcctggaaacttaccactcaatacaggagaactgtagcttctaaagctcatagcataggtgtttggcaagacattctttatggaatggctgtcctttctgttgcaactaatgtaagtggacctatttcggtggggtgactttgtatttcattttggggggtgtggggagatgtgaatgatgcttaatctttacatgatttcattatggtgatactttataaagctaaaacattccgaaattgttatgcgctaaccaatatagaaaaacctatgtcatgcaaactcttagaaatacaaggacaattataaaattactctcattgaagtatcatgacacagtttcacagcatgtgacaaagcagacagaaaataagtaacagtataatgtgtttgaataaaacaattaaaaattgattatatttgtatactacagagaatatacatttacctgttgtgtttatgaaacaattattaaaatgtaagaacaataaatttccaaaagcataacttttacaatgcattttcacctacaatatactttataaattgaagttgataataagataatcaaaaagaaaatctaacacttttaagtaggcatcctataagagaaaacagaattgaaatcatagagcttaatttaaatgaaagcctgtaggaatgagccaaaaccactattacagataactccattgccatacatttttaattattaaaagaagactggaaaataagctgagtatataacttaagacactgtcaaaaattgtaaatcaaattgatagtagtaaaaaagaataaagatgtaatcagaaataatcaaattagaaaacaaaaagcagtataattgctaagtaaatcaagagctagtttactggaaagacaaagtaagtaaaactctgaaaaaaagtatgagagactcttgtgtcctcatttactccaataaattttgaaatatatttgaaatgaccacttttttagaaagcaaaaattgccagatctattcagtgagtaatagaaagcctgaatgtaccattagccatagaagttacattagattttttttaaagcgtagcactaaaattataagtgccagagccagatggtttttaattgacttatctaatctaaaagaaatatgctatttatactattccagaacttaggaaaggatacaaaattatcattcccatggaatcaaatactgaaattaattgcacccaactgtgagaaatttacaaacacatgatattctgcttcttcattcctttcctgttaatctcttacacacacacacacacacacacacacacacccgcagtcctacctcattgagttagtctaagaaagttaatttggttaaagatagtagaactgtgctgtgaaacaataagaaatgtaagaaatagaaagccttgatggaaagaacatggttcgtagagacagatacatttcggtctgactctctacttagccactttgtagctatgaaatcttggaatactgatcacacactgtaaatgagctactttgtgtttcaggacaaagacttgcatattactatgatttataatagtatttaatcattttgcatctatataatttatggtactgagagatgtacaaatcagacattattaaaactaaattggcagctgatgatcttcctctttttttttttattcttcaggcctttattgttgcatttacgtcagacatcattccccgtctagtttactactatgcttactcaacaaatgccacacagcctatgacaggatatgtgaataatagcctgtcagtattcctgatagctgattttccaaaccacactgcaccttcggaaaaacgagacttcatcacttgcaggtgatttgtttgtttgtttgtttaggttttagttttatcccttaagcgtatttcttaagttatctattacctttctgtcttacaatataaaggattttcttagggcaacaaaaatcctgtataaataaagtgtatccattctagaattcacacattgcatgattcagatttgaaaaggtaaaatggcaaaaactaagattatgggtaaaggtaaaatggcaaaaactaagattatgggtaaagataacattaattcaaacttttttcttactttctaatgtatcaaaaggatttgtcaccaacaagtgccccttagtccaaagctgcaataatctatagatcatacaacattgtcaaattgtatatacatttaacttacttgaatttatctttgtcctcagaaaagagagtgagacagtgaaatataatatgatcagttcaccacctatcctactaaaaggttttatactgtatagggaatataaaattgcatatgtgaacctactgtttttacactcagtgtatcatgtactgtgggatcttttcaccatacaatttaaagacacacacacacacacacacacgcttatcaaggccacttaatttaaaccagctgtttcatttgagactccaaacaaaaaagagcaaaatattgcaagacaagcagacattattatattgttatattacatatttgagtatagttaaatcatagcctaatgtgtttaagagcatggccactggtgtcagatttctggatgtcattaccccttagctggactaaatatttgaggaggacagtatccagtgactttatagaagagaatgaactcacaaagttgaacattaagaaaacttcagaattgtgttaagaaaaacaaagcaatacagcatcagaacagccaagagaaaatagagttccaagaagatagaagtggcctatatataatattcttatttttgaaagtcaaatcaaaggattaaaatatacctgcagtttaaggataggagagaaggaaaggactgggagtgttaaggaagtgggaaaagaggaagtggaagcagcaaattttgaataactcatttgagaagcttgtctttgaagggcaagagagaagttcctcttgtgtatttcttcttagatctattttgcacataagtagcatataccctgactttatgtgaacaagaaagataaatgtttcataatatcagttaactttgacctgatttttctgatcaactagaaaggtctgttaagagaaataagaaattatgtgaggtctctctagttgaagctataactattattattttttttttttgcatttacttccacttttcaggtacagagattacagatatcctcctgatgacgagaataaatattttcataatatgcaattctggcatgtccttgctgccaagatgaccttcatcattgttatggaagtaagctgttcttaactttcattcgagttactctcttctctctttaggcagatatttctaaaggtaacctctcatcagaaagttagcaatatctcagtaaactgtcttgaaggaagtattgtatttgtagtcataaaaagcaccttagggatattcttagtacaatggattgcctattattcacttattattgttgaacatgtcatggtgacagaaaaggaaaggaaaacaaatatggtttttttcccttcaagtcaggaaaaggggaaataacccactgattttagagaatacctattacttactagttccagaggctgtattaaatcataacaacattgttaattagaccttatcgctcacctttgaaaaggaatctgagattcagcaaaaataagtagctggcttaacgttaactaactaacattagcgctgagtctcaatgccaaatgtgcctcactcccaagcttatgctctgtctactatattatgcttcctctcttgtggaatatctagtgtagttatagagataaggcctgcaagaaaaggtaaacaatacagaggcagtattgggcaaagtttcaaattgagtgatacaaatcatagggcaagaaggcctatcagggagagaaaataaaagaaaggtactttttcaccctggaataaagcccgataaaagacaatcctaacccaagaacatgccattccaaccagtttctgtttttttttattgttatcaaggtttcacatgtaattttaaaaatcaaatagttctgcatgggaaaaaaacaaaagagcaatcgtacataatatacctgcctaccctaaaatcctaatatccaaagtaaacttctcaatttttttaactcattcttctagtagttgcccttgtatggcaaaagaagatcattttgcagttatatatttttattttttaggttgagctatcaattactgacattctactttggcagatctcacacacacacccacacagacagaaagagagagggggaaaaaaaactttctcctactgctcaataattaaagcatatttttttggtctcattctgaaattcaaaacctcagaaaacaggaagtattttgataatttatttagcagcaacatatgatctaattctgcctttattatttttagtgtgactattcatttactttgctgcagaaatatttaagtgtttgatacagagtgccacctgagaccctgctggtttatacactaaattacatatgtttaatatttaatctcaattctgaaatatttctgtccatcagagttttgattaagagattttatataaatacaatagtcagggtttataaattatgactttataaatattagtcacatctgtttcctgtcttatattctgaacatatttcttttattataattgtacttttcttttctccctctgtctcttagttccttatgaatttatcagtctttcattccaacattttgcgtcagaagtttagatcacctttcagccagtaaattacttccggaattcttttgttttaatttatttattatttgtgttaattttttgtaatcattgcaggctccaaccaagcatcatcctgggacttctcttcatcttgtcttctattgaagactaaattttctgcaatctatgtttctcccatttttggtttactagcttattttggtgaagcacatcttctagtaattttctgaggaaaaattatgggcagtccatttttgagaaattgaagattgaaaatttcttttctttccttacatgtgattatttggaatagaatgtataattaaaagttgtttttcttaaaaaaatttttaatcaactttattttggtattcctgaaattttgaagatattgcttcattttcattcagcttccagtattgctacaaaatgcaatactattctgactccccagtctttgtgtattatctatttttaaaatcaatacggttttaggattctgtcattagccccatttttatgaagcttcacaagatggttctttgctatttgtcaatattcattgttttaaacactcattgagccccttagatctaaaaacgtacttacccttcaagttgagaaaatttgctggcataatttctttgataaatttttgataatgtctttgataaattttttctttctttgtgctgtctctctggaactgctgttattcagatttacacttcctagtttgaaattctaattatttgttttctatgaaaacctggattaatatcttttttaaaattctacttttttcttttactcctttccttatatctggttcttttcctttttttttttttttccatgtcagagatgacttacctacatatttggtggttctgctcatgtttaagagtgtggaagtgaaaagctgattttaagcattttgtgcatacaggagtgatgtcacttggtgggtttcactgtaggttgataacgtagtgagctgatattttcactggatccttacaaaattttgacatccacagttctgcttttacagaatagttatttttcccagagaaagccctttatagctgtctattgagatattttgtggctacctattttctaagacctgagcaaggcagaggggctatgtatctcacagttcattgtgctgaatttcactgtttttacttttttttttttcaatatgttgtcatacctccactgtgtctggtgcccctggattcacagctttgtggtataatttctgcagaaaacaaactcttcagctgcttccagggtatagcatggagtgaaagaatacctggatacagatgggagaaaggctccaaaaattcaagtgctccttatgcagatttgtatctaatcctcttgttttcaactccaactcaaactaataccttcaaaagtccttattgccttctttcctgaacttttgtgaccatctgaaacaaaattggcttttgtctttttggtttccactatcagtcaccacatcaccatttgcaagtttgctagcctttttcactcttttgagtctaattcctttataaatattttatcaggttttcaggaaggagcagtgataaagagtatattcaataatcatgttcaactggaatattgctagttacatatttaagtatatatttatttgtttgatgttgatctttgtatgaaagttctaggacagagaccatatcttcttccttgcctttctacctcatatgttgagcagtttcttaaataagtgaaatgatttgtaaagactttctgctgagcatgtgacacctctaacagcgtctaatctttcctttatatttcctctagcatgttgtgtttttagttaaatttttgctggcctggatgatacctgatgttccaaaagatgttgtggagagaatcaagagagaaaagttaatgactatcaagattctccatgattttgagctcaacaaattaaaagagaacttgggaattaattctaatgaatttgccaagcatgtcatgattgaggaaaacaaagcacagctggctaaatcaacactctaatcagtatagtgaggaagcagcaggtgatctgccttacttcactttatcctctggttttagggccagacgccagaagccatgtgtcaattttaccctttcttttttttttttttctttttttttttaaactcaaagtttttatacacttttatagaggccaactttgtgatgttggaaatgtactacttctctgcttcattgactgggccctctccagatgttgttttctgaggtgctgtaaatgactgttgaaagtgcaggtagaatcagaatactgggaaattatggagtcttgcagtttagtaagaaacactggccttgggctgtcccatcactttccagtgcatctatttatttttgtggtcttctcttgggttatttgatacctccttccccattaagaaaaatgttggggcaaaaagaaatggatcaaagagactgactgagccctatatatcctatcattttaaaatatgcaaatgaattgccaagatcagatgacataagaaaactcacacattaaggtgttaatgtatcatagcagaggtttattcctaacacattcaactaccatcagaatcccagatagttcttcctggtaaaggcagaattccttttctcgagactgaaattttgggtttcaacataaaacaacttggttcttagagataataatttggttataatagtttcaagactgatcttatctggaaagcaacattatgaagctgttagattgcttcaggttctcaagcaaagacacaatacagaagtaaatgtgttttcttagtagttaatggatgcaggacaatgtatattgattaatttgttgattttaatttagaaaattgttaaattatttcttaaaaatcacttttcttctggaatgccaatttcacatcatgaagcctttttgtataagttagatacgagttgtttatgataaacatttctttgctttaaaataattgcaaatattttaataagtttacaaccttttctattgatgtatcatcttatacaatgctcagtgccttgttccaatacctctgacacacaagaagtcatgttgttagctagtgatttgatgtgatgtaacatcttaaatgtaagcttgtcttaatgaaattgtcagtgtaataacaactacagtcttgaaaaccaaaagtgaatcaaccaactaagaatgagttcatggacttaataatctaagggggaaaaaatgtttgttgaattattcctctcaaatttaggcttgtgttacatgcacaaaaatccttgttctgttttcacttaaaaaaactaaatatgtataactttgtgtatacacacacacacatctatatatataattattagcactagagggatatagtccagttatgtagtatttaaatctccagtttcaaattataattcacctccaaaagaatagttttttaatcacacacataagaaattttatcacaatatttaaaactaatatttcattatctaatgctaataaattattgtggtactgccagtattaaatatatggcagatggtattaactactgatcaatagtaagcatacagaactggggattatggattttataaactatgagacagtcaccccagtttggactgggactaatccccagtactgatttgtcatccactgagtagactttatgaatattttgggtaatttgaaatgatctcattattgaaagatgatttcatatgtagagaagataatatttctttcttgaaaaaacaagtcaggcttaccatgatgtgtgcaaccaatgtaggatctttggcttgtcaaatcagattctccattgctatagtgtacagtgcacacagctcatattgcttccttcctgggtgctgataaaaataagaaagagcatggaaattggtttcttgaatataagctttaatttttaaggcttaaaagtattcatagaggtagactgtatgataaataaaaacaaatttaattcacaaagttatctgtacactgcagttttaaaatataccaactaaattattgggtttctggaagtgaatggagaaaacagcaagggaagaaatcgtttttaagataagtaaataattcccatggattgataaatattttccttttaaaatgttatggactgatattttttattcacctttaaatttcttatcaagaagtttatctttgtttttcagatttaaaaatgaaatacaggtattcgtcactttcctgaaaccatgctaaccaaaatcagtagccaaaccaattcagatagatgtgtctcatctaattaaacccattggtttttatgggagggctgcattaagagcacccaaccaccacatgtaagttgataattaccagcatggcaggtgattttatctgctgaccaagcgcatagttttgttttgttttcagaatgttctagggaacatttgagattttatgtgaaataaaattttaagtgccaaagccaaaaaaatacttaactcttttcaaaggccctctttcatccttgccttcgtcaactttcctttgcacacaggaagcaaaatctacttcaagacatttattttagaggaatccattaagaaaggattgttttacttaaatgaaatgctgtcttatttttgctgtgtcttttgacacctcttagctttaacattcttcttttaaccaagccattatgcaaagttatcaaagaagaggagaaggaaaggaggacagatgaaagtgacgggaaatgagaaagaagaggagtgaggaaacagttatttccttatgaatcctgtgtgtttctttggaagaaagagctgttccgaggaagtttggtccagctgtggttgataagaggtatatctcttaaaaaagacacctaatgaaagtgagagaaaagctaaagaaaatttcaatgtgaccactattatgtgtcaaaataaaacttagattccaaagtggttttgtagtgttgggtgctatgagtaggtatggatctctgttgattgactccagttgaaggtgagaaatctgtaccaatcattcaaaaagggaatctattgttttgaaagaaactctctcatatttcctttaaattgttaatagttgttatgcaactaaagaatgttatgaagaaaaatagcattgcaaaaagtaccattggccagccttacaagtcagccacaatgagtcggtataactactgtgttattctttttctagacaaattttgactcttctacttttatgtgtaataattccagtattctatttatttcagcattatgtgaaaaatgataagaatgttaaaaagaaaataatagtgtggtttaattggtatgagatacctgcttcctcctcctcaaaggtttgactgggtgtatctctcctatgtgtgacattatgtctcctggtgttaacacaggaaatgagtgctcctttttaaaatttctttcttccaagtttttttttccaggaagagaaatatgcagttatgcaggaaaagctctcttaaataatgtgtacataaatctcaagagaatcaaattcacagagtgaataaagtaataatattaaactacattttgacatg

SEQ ID NO: 1608 - DNA, 90193 bp, Homo sapiens; identical to SEQ ID NO: 1607

SEQ ID NO: 1609 - DNA, 569931 bp, Homo sapiens
aaagttttctcaaagcaattcctttattgcttccccacccactcccccacagctgtgtgagtgacctgcttttctggtgagactagcagctctttatttttattttgttgtagagatggggtctctctagactaacagctcttgtagagcaaggatcaaaccacaaaccgcttttccccctatctttctgtacagttcctgactgaaagagctatgtgttcaatccaaaatgctggctgccctgcagatgaagttcagtctagtccaggtcaacctcagcctagcgcccactctgccaggcgccatgttgcccaggctcacatacaccgatgcatcagacccactccctgccccaggagctcacagcactgttaggacccctgttcattgcactcctgcttacttgctctccggggcagcctaagcctggcctttttctctgtccccctccctgagatcccggatctccctcccgtacttctctgggaacgggcacagcagaacgccacgatggttgccataaggacgaggaaggccacaccagctcctacggccaccccaatgatgacggccatcggcacagactctgtgggagagaagcgggcacagctgatgacggatggggaatggcctactatccccccatgatctcaccccgttcctgcgggggcagcccctgccacatggggccctcctgggaaatgcctcagtggggcctgggcaggcacaggccgagtccaactggggtcagctctagctgggactgcaaagaccagggtggaggacacaggggcttggtgggtggaggagagggcaggggaactgaggtaaagggcagaggaaggagagcgaggcaggcagacacggagaagggagggccaggggacaggaagaccggagatgaggggtggggctggcacgatggagctctctctggcattaaacaggaatgctctatcacacagcggccagtgagtcataggccctggctttttttgaaaaatgactatggtcactgcccttgtttgttccgtatgttctctccttcccttccctttctcgggtgaatatagaggacatccggctcttagtgtttgcaggtctaagtagcttccccgcaggtctgctgggcatcagttgtggccctcaggtgtccaagtctcagggtccagggagcagggttacagcttctccactgccacctctctaaggagagaggcccctttccctccatctccaggtctgcagcttctccctcaaggctgcccctctgagcatccttgcacccctcctggcaagagaggcccacacactgggcaggcaagccctcacccctgctgagtctctgtggcctgtctcctgcccaagccgagtgggggtagggacagggagggtaaggatagagtcgggggtgatcttccacacagccttggcccttctacagctgcaagtggggtcggagcacatgatttagggccttgaggaatccatcaggaatagaactagagaatgctggggcagggagagcttggggctctcactgaggtccggagaagtcaagtgatttggccaaggacacacaggagctgcccagccagggtcaatccaggtctcctctcactgctcccacccctccactcaccccactcccaccccgtccagctccacccacagagtgacatgtgagatcccccacatctcatgtgctcggtaccgcccagactgctgctgctccgagtcctggctccatcccttctgctgagcaactgactttgcctctcttatatctgtaggatggggataatggtaccggcccctctgagggttgttatgggcttgagctgggtgaatgtgggcagaggccttggagcagagcctggcacccagccctgtttggtgtttgctgttgttgttacccaggaaggggtcaccagcagttcacggtcttttatttttgggatggagtctggctgtgacacccaggctggagggcagtggcacgatctcagttcactgcaacctccgcctcctgggttcaagcgattctcctgcctcagtctcccgaatagctgggattacaggcacatgccaccatgcctggctaatttttgtatttttagtagagatagggtttcaccatgttggccaggctggtctcaaactcctgacctcaggtgatccgcccgcctcagcctccgaaagtgctgggattacaggcgtgagccatcgttcccgatcagcagttcacagtcttaaaggccaggaaagttcctttgaaagactgagcccctccccagcctaccctgcgttcgtcagtgtgggcgagtggggacagctaggtatcagttctgggttgtaagcctcttgctgtctttttctttaaagggaggagaaagacctcaaaccctggcctctgaagatgctgctgggaggaggtatcaaggggtgggggtagggtggcagccatttgccctccggccagagggagctggcgcccctggctggcagtgttgctggttaagctggcacatccctttgccaccccaggacttgcacacgaagccattggttacctaccaattagtggccaggacagctgtaggggtgacagggaggggaccaagaggaggtggaatggtggacacttagggattgaaacgggaggtgctcgcattggttcaacagtcagactgagaaaaggggctgggcctcagcagagcttgccttgaccaatagacgacaacgtctctaggtttagttccatgaagaaagggaaactgctgtggcagctcattggttctctgcttttgaattggattgatttgggttggtttctcctcagattcctagtaagtttccttggaaaaacacagggcttgtctcagcggaactcagagccaaagcatgtccatggaaggctcttaacacctctgggcctcagtgccttgtctgcaccctggagagctgggcagcagcattgaaggtgccttccgatcctgggatccccagcccacgtttccacacgctgctgacggctgggggaggggtgccctcttagctggacaacggtcaccagggaggtgggcagggggagagcagggggtcctgtgggggcgagtgccccggggtgccatctcttcccagtccccagcctgcctgtgtgtgtttcctccttgcctggcttcctgaggtttggcctagggcgatgtgcaggcccctcctctctgcacagagccttccctgcatggctcctggagagggactggagggaggggctgtccccactcagcctcccctccatccaaggaggtgtgccaggcaccaggagccaccgaggggggaaggtgttggggagctctggatgagtgtcagcagacacaggagacacggagacaggagacaccaccctcagcactagcatggacccggggagaaggcagcgggaggctggcagctttctgggttgccccagtgtgggctgcaggggcctctgtgagcaacctgtgccctgggttggtgctctgataggggcatgtctgccaggaggggcagaggcaggggcatgaggatcccacgtggagcttgttgaggaggtaacagaggccaggggccagtgtggcaggaggcctgggatggaggaccactcaagtcttcagcatggccatagagcctggcttgctggtcctgattctcttttctggttttctgctcggggtggggttgagagcaactccgcccagggggcctgatgactgctttgctgcgtgtgcctggggagggaggcgctgccctgcagcctcagcttggggtgagatgacacttccatggggactgcaggagtagggaggggtggcaaacagcaagcatggattgcacaagccacagcaggggctgggggcccccggtgtcctgggaagcagtggccaagctggtgatgatgtggagaagcgggaagggtcggagagagcctggaagcagaaggcagtcaggacaggggccagctgaccccagaggccaggagtcagggctcctgaagagaaaggatggaaggaatggagcggggacgagcaagagccagtgtcccagagaggaaggagttgtgggttccggcggcaggcaggagacaggtctctggggtccctaggcccaagctggctgggacctcctctccccactgctttgtctacactaaaccctcaggacgggggagggcggagacactagcggccagcacaggcctccctaccccctgctgggttccctccccagctagccaggaagtcccttccccccttcccagggccattctcatcatctccttccgtacctgcttccagcccggctcccgacttcatttccgaacctgtttggaaataaagcaagcgtctacagccagggcctggctggccagggtggggtgggactgggaattagctgcttgagcggggctgggtgaggggctcctttcccagtcatgtctctgggaccccccaacagatccaggctagcccagctgaacttggagttcattcaggctgacttagagactctggaggggctagggaccggagagagatcacgtctcggaggggtctgggagggttggggtgagaacactcgggggagggcatggggatgggggcaccaaggggaagacacggagggtaggcaacaggggaccaggaaggtttgggatgatgtgtggatgatattatgcaaattatgtgcaaagcattatgcaaagcagcacctattagggaagaggtgttgggagatgctgtgtgatttgacccataggtgtgatcctggtgtggcccactgaggcctgggggcccagctgagaccacccacttggcctagaatctcttgctgggcctgacagcctgcgaatggacctttacctaagagggtgtcagagatcgtcaggactgaggcctcctgggcctcagaggcccaggcccagctgagcacgaatccctggtccaccatggcttagcccctgctggcaaaagggcaagatcaactgcccctctcagaacccggcttgctgctggctgtggtggggcttctggagccacccctccgtgcccctccaaggctccccatcctgttgtctgtgcctgagagctctgagcagacgctggagatctgagcctctttgaccaggagctgggacgtcagcgcacgggggcacagtggggtgaggcttgttcctcctgcctcctccctctcacccacccggctgctttgcccagcgctgcctttgaggtacaggggtccatgtgcctcctgggtctgcaggtcatctgagcccagcccccgaccctagggatctggacaagcaagcctaaccccttagctttagcctgggtgccctctgtgggacttgtgtctgagtaactggatgggcttgtcatcttaactgtgactgggccaggttcccagcacacccatgccagtgtatcccacgctccacccaggcatgacactttggtgtcagaccagggcccatggcagagggcagggcacagaagccagggcctctggaggctactgggcagcttgtcactgccaccagcctgctcactgttgtggtcacctcccactgaagcatcgccctcaagggctgcccctctgagctgtgttcttccctttcttggttcctggtggaggctcgtgccccttgcttcagcgagagcctggctgaggaggctgctggctggctaggctgtgtggtcagccaggaagagcactgtggcttgtccttgggccctggcccaccttgcagccacccgcgccctgacctaggtgaggagagggccctctggttccatcgttcgttgttccctcatggccctggcagctctcaccttgctccttgagccggatgatctcagtgtcggagccgaagctgttccaggccgtgcagttgtagatggtctggaagtcggcccgcacgatgttgctgatggtcagggtggagatgacgccctcctcggtgctgatggtctccaccgtatagcgccccgatgtgcccgactccagaacgttctccttccaggaccaggcctgcccgggggcgcagaatcaggaggagaccccaccagaggggcccaggacacgcccacaccagagtcacagtgccactgtcctgctcatgttcatgctcactgccacacactaacacatgtgcacacgggtatgtatgcaggcacacatgccacacaccacaaatatgcacacatgcaggtgcacacacaacacgcatcaccacacatgggcatgcacagcatcccacacggcacccacatgcaggtacacgtgtgcacacacaacacacaaacacatcacacgtctatacacagctccccacacatggccaacacgtttatatacatactacacacaccacaaatgtgtacacacagctctgcacacacacaagtgtgcacccactataacacacacatcaccacgtacacataccaatgtatatacacacaggtttgtacacacacaccacactacaaacatgcatatgcaagtacatgtaccacaacacacataaacatgcatcacaacacatgcacacaccaaagcacacaacacatcacagtgcacacatgcctgcacatatgtgcacatgtcacaacatgcatacacacatcacagtacatgcacatcacacttcacactaaaaacatgatacagacatgtacatacacatggcagacacgacaccacatctacacgcaacacacagccactccccgaaatacatgtacacatgcacacacacaccaagatgcacgcaccatatgccacaatacaacacacaatacaagcatgcttacacacatgtacataccacaacacacactgcaacacatacacacattcgccatacacaccatcatgtgtacttacaggtacacacactatgacatacacacacaccatgtgctcacacacacaagtacacacactaccaacagatacacatgttcacacatgccatgacacatgtacacggtaacacacccacaccacacatgtacacaatccacaaacacatgtacacacacatactctggggcatcctcagagggtctttccatcccagaaaggggcctggggagcatctttctgggcaaagtgggtgccctgttggcctgcgcactgcgcctccacacaaatgccccccgggactgtggctgcctgggtgggtgtgagttaggacagcagccccatgaacgcgtctacctgtgtgatgttgtatgtctgtgtgagaaatgtgtctacagagctgtgtttgcgatcaccttcgtctgccttagtttacagggctgctggttaacagttttcagagccggccacatacactgtctgcacctcatcgtgtaagcgcctcgtatatcctggttcggggctgatgagagggactgagtttctcaagcttgctgctattgtcacgctggactgacccattcctggccgtggggctctcccaggcattgcaggatgtcagcagcaccctggcctctacacacccggtgccaggagtatcctccaagtgatgacaaccaaaatgtctccaggcactgccaaatgtcccctggggccagtgagaaccgctggcctagaatcagatatttctggagagaaggtgtgaaaatgtccaagagtgaatggaatatttgacaatgagcatgtgttacatttataattaaaaacatcaaaaagcaaagtgaatggggaggcgtaggtattagttttattcatgagttcttgcaatttttttgtgaatctttcagacagtgaatgaactgaatgcttgagaaagcgtgtagcagcaataatactctaataatatcttagttaacaggatgacagtttcagttggtgcagcctgggtgtctcagcccccgcatgcacgggttaggggtgacctcagctgcttcacatctgggccagccccaccctccctgcacaactgccctgcccactccacccctggacagtcttctagcaggattttgccatacactgggaattactacaaataagttttccccgagtagtgctataaaatgctcacttttctttgttttcatgcctgagatccctccagttttagatggatttgagtacaagactctgcccctggatcacctgaggtcaggagtttgagaccagcttggccaacatggtgaaaccttatctactaaaaatacaaaaaaattagctgggtgtggtggcaggtgcctgtaatcccagttacttggaaggttgaggcaggagaattgcttgaacccaggaagtggaggttgcagtgagccaagattgcaccattgcacccagcctgggtgatagagagagactctgtctcaaaaaagaaagagggaaaaaaagactctgccctcaccttaatttttttgttgttgttgtagagacagggtctcactatgttgcccaggctggtctcaaactcctgggctcagtcgatcttcccacctcagccttccaaagtgctgggattacagacatgaggctcctgctcagtaagaccctccctttaaaaaaatgcagatactggctgggcatggtggctcacgcctgtaatcccagcactttgggaggctggggtaggaggatcgattgagcccaggagtttgagaccagcctgaccaacatggtgagaccccatctctactgaaaatacaaaaattagcgaggtgtggtggcagatgcctgtaatcccagctactcaagaggcgctgaggcatgagaattgcttgaactgggaggtggaggttgcagtgagccgagattgtgtcactgcactccagcctgggtgatagagcgagactccatctcaaaaaacaaacacaaacaaacaaacccaaaaaacacacaaacaaaaaaaccaagcagatagctggtaggaggcgctgagggtggactcctcagttgccttagctgcattgcagggataagttctttgaggaagggagagagaatggaatggtcactttagaggggacgattgataggcaacagggcaggctaccatggacagtaaaggccacagagacctggcaaggagggctccaggaggcacagaaaggggttgccaactattacctgcgctctaagattttgctaaagactggcctggagcccaggaagagaagaagtcacttgtcttttctctccactaccctcgtgtgcccctctgcccttaggatgcggaatttggtcagagccgttcatgtcagagctcagcagaatggcagctgaaccctgggagagcactgcctgttctgagaaaggcctgcaattgtgtcttcacgatgcttttccaagacagccaaggcaggtataattttcctcagcaagaaagaggaacctcggaggtgtgcaccgcctggctggccacccaggtattggcaaaagtgactgttgggctgctggcccggcccccgcccgccgtccctggagcactcacgatgcggtccggcggcggcgtgctccggatgaagcacttgatctggcccttctcgccgtggagggcgtgctgggtctgggtgctggagatgatggggggtcctgttgagaaacagcgtcccattaggcacccgggaagggcacgtccctgctggcgccctcttgggtgggttcagaagtgtattcattaatccaagcattcagcaaacatttgccgaaggcctgtatgtgcaaggtaaagtgcaaggtagaggactcagagataaattaggcattcagtcataaacctctcaagggatcatgagcgaatgcttctaagtcagaacccccagaagatacaaataactgtaataaaaggtggtgagtgttagtaccacaggagcggtgcagataaagtgctaaccgacttcagaggagagagaataattctatctggcggacggggaaagctttagggaggaggtggtaagcctgcagagggggtggggaggtgtctagatgaaggaagactcccccgcctcagccagcggcacccctgcgagccattcctcagatatccagtagagggcgcccttgcctaacaaatgggagctgctcggccagacgggccaacgggaagaaatggttgctgtccctctccttagggcgggaatcaccccggacagggggaatgcatgcgctggccgtgttcacagccctcctcccacctgtgtctcaggaggtcctgcagttcatcatcttgtctgcctccacgtccatacccagactgcccaagtgaggccatggctcccaaactgaccccaatattatcatatcacagagtgtggcacatgtttatgggtgtcaggttctgagagcgcctgtctcattcaccacattgcacagccaagagagttcacctggtggaggggagcctgttccccagcgcctcctgtccagttccgcctgttacctaacccaagtctttcccctgtgacgcctgcctggccgtgaaagacaaaagaaggagcagctagcttagcctgggctctgctggcttcctggctgggctgggtggttgaaggatgggagtagggacggaaactgtcatgctccctttccaatccctggggtcacagttgggacttagatggcagataccagaggaaagacagccgggagcaacgcatctggagaacacacagaattatgcaggaacaaaacaaaaattgctgcaaacataattgctgtttattagccaccttaattaaagcagatttgcatttctatgagtagctctcagccaagggagaaaaggtactgtagacactccagtgacttctgttgagtttgagaaggcaaaagggctcggggcagcgtgaggtgggcgtgggggaccctccatggctttaagaatgggctgagcgctgccctccttcctaaaaatccttcagctccaacaggtctaggacccaaagagatgaggagattgatgttttaggaaccggatggtgctttgttttattgctggactaaaacgtgatgataatataaaaccttttctggtcaggtgcggtggctcacacctagaaacctagcactttgggaggctgaggagggtggatcacaaggtcaggagttcaagaccagcctggccaatatggtgaaaccccgtctgtactaaaaatacaaaaatttttagtatttattatttagcctccctacttgggaggctgaggcaggagaattgcttgaacctgggaggtggaggttgcagtgagccgagattgcgccactgcactccagcctgggcgacagagcgagactccagctcaaaaaaaaaaaacaaaaaaaaaacaaaaaacccaacatgcacagacacacaaaacacacacacacacacacacacacacacacacacacacacaaaaccttttccttgtgcttcccaggagctaggaattccctgaggggttttcatgattctaaaagccatcatcaaatgcatctgcttcttaaaagaaaatgaaaaccaggataaagggaaatggggtgagggttagtaagatttctctccccttcctgcagatacctgatttgagccaaatcggttgaggtgtgtgccaatttctttcccaaaggactgctgcgctggccagcagttgtccaaggctgggatttgtcgcgataaaaacctgatctcatttgaatgctttcatatcaccagctccctccagcccatgcccaggtcccatccactgggcgtcccccctccctctgcctgctctgcagaagcaggggcagacagttcgccccctggcaggtctggtgcgctcccctccggggccactgaactcatccacctgcctccaggtgtgtgaggccaccctagtcaagaaataaacaagcagcttctttgcttccctccaatccctccagcttttctctgcctggaagcctcggggagcttgtgctggcaggggtggaggcagaggaggggagagaaagagacctggagagtgcagattcaaccttggtcagcgccagggcccgggtttcagtgccctccccgtccaagagaaatgtccctcccggcctgtgttccccagggggcattctctcctcaagaaatctctttaaatctcccttggaaatgtctgaacgtctaaagtgacagcagatgtcagctcctcctttatccacctgcttttccccagaaacgccaatgctcatttgatgctccaggcttgggggccctggagtgcatgagtgagtgtgagggtcccgggctggctggtcatagggccagcagagcagagccggctgcaggcacagacagcctgacttccgagtgccctggctggcgcgggctgtgtggagggccgctgatttcactggggcctggagctctgagccgagtgtcagacacctgcgctgaaaggaaaaggctgcagcctgtgttgccatggatatacggaggcgcgatcagatgctgttatttttagccctgcagtgccaatttattggtggcatcctggggacactcaggaaaggcaggagggctccgactcagggctctgccaggacaggtggctgtgaacgtgctggggtctgggtagactcagcctcccttgggggctgccacgactctggggtggggggagaggaatggaaatgcggggcagtgtggggggagctggtgaatggagacagtagagaggtatggctgaggagacaccaagctggttttggttttctagcgaaggggagaatagatgaggccatcagcaggtggctttctgggtagagaggaagctgaagcccacgagctaatttggagacctcaggagggccctgctctggggccaggacccagatgtcctgcaaatgttggtggttcagttcctgcagggtcccagagctttggggttttgatctgagtcaggctatggtgggaacaggggcctcccaaagggcagtgggcatgacagaggtgaggggggagcattcggaaacggcagaggaatcgaactggcagctttgctttttgcctgtggccaaagcaccagatagggcagggacgtccgcatttgcgtcctggtgccacaaccttcttgggtctggcctgagccaggtctcagcttctccatgactgtctacaccccatcattcaggcctggtgtgatgcccttgtccctacatatttcatgtaacagtcattcatctactaactcccaccgtgaaaatactcccctgctgcaattatttttattatatataataagacatgccccctgccctcaagggggcccctgaacacgtggcctcgtggagacggtgacagggctccctggctgggtgactcacacgcattgggaagaggctgatcaggagctgcagagatgctctcttaaattctcatggggccaggagaggtggctcacgcctataatcccagcactttgggaggccgaggcaggtggctcacttgaggttaggagttggagaccaacaatggtgaaaccctgtctctactaaaaatacaaaaattagctgggcgtagtggcacgtgcctgtagtcccagctactcaggaaggtgaggttgcagtgagctgagatcgtgccactgcattccagtctggacaacagagcgagactccatctcaaaaagcaaaaaaccaacaaaaaattctcacgggccaaggccatggtgagtggatgaaagggtggacacgttggccacctagtgacctctgatgctttttttcctggccaggataaaattcatcacccaccactctcagggctgagaccccttcaaagctaacaaacaaaaagagaggtgactagaaaactacccaggcccttcctccctcagcctgggtctgacggggaatccaggaggtggacctaattgttgtctacccatagttggaggtgacagcaaggcccagagccagcgacagctcctttggggctatgcctggtgccaagatgcctgaggtccttcttccctccctcaggcctggctcaccccagcgagggtcttaccattgacggtcagggtcacctctctctccccggctcccacacggggcaccacagcccggcacacgtacttgcccgcgtcctcctggcgcacggatttgagggtcagggtcttctcattgctcaggacctaggagaattggcaggctcagatgccaagagcaggcggaggggtgcactcttgtctctgggaacaaggcagctgagaggctggcctggggtaactgaggcagtctccggcatctcagtaggaagcaaggtggggaggaaagaggccaaaagtttcctggcccagacaatgcctgtgggctgtacagaggagactgtaccagcagagaggccaccccgtgtgactgaggatgttacatcccaggcgcagccctgtgggctgggggcatgtgggggcacatgtgccggaggagggggatgcctgcctggggacttccaggtttcctcctacaggaacctccctgtacctgcggtggcttctcctctcccaggctagccatgggtgacatgatcctacagctgaacttctctgggggctcctggacctgttttcagagtcattttcaggatccctttgggatatagcttggagtgatgaaaacaggctctggcatgagcttggtctgcgttcgaatcccggctccagcagtgaacacctgtgtctctttggtcagttacttatcttctcagacgctccctttctatgtatggaggctgctaggataatgcagcgtctgctacataacaggccacacaaaggtcggtttccttctggtccccctgcttccctacctggagctctccctgttccttcctatgtgaggacatctgacaatctcttatgcactgaagaatatatacgtcttaaaagaggaacacaagggctggacacggtggctcacgcctgtaatcccagcactttgggaggccgaggtgggcggatcacctgaggttgggagtttgagactagtgtgaccaacatggagaaaccctgtctctactaaaaatacaaaattagctgggcgtggtggcccatacccatagtcccagctactcaggaggctgaggcaggagaattacttgaacccgggaggcggagtttgtggtaagccaagatcacgccgctgcactccagcctgggcaacaagcgcaaaactccatctcaaaaaaaaaaaaaaaaaaaaaatggaacacaggaaagtgaagcccaagtccaaggctaacggtggctttatttgggggaagtttaaaaggctctttctttctctttcttttctttctctctctttcttttctttctcctttctttctttctttctctctctctcttcctttcttcctttctttctttcctttcttcttcttttttttccccaaggtcttgctacgttgcccaggctggacttaaactcttgagctcatgtgatccttccacctcagcctcctgagtagctgggactacaggtgtgtgccactgtgcccacttgaaaagcctttctagtgccttccctcccagcacattggtgaccacctacttttcttgtaaggtttaggacagggcaagagtgcaatggctgaatgtgctcagggtgggacaggcacatgggggtgcctgggttccccctcctctttctgggatctttctccctgtggcttacactggaggctgactcccccagtctaatagtgagaggggcctgggcagcagttccttcttgctccactgtccccgccccctgccagaggtgccccgaggtctgagctgcagcctcaccactccggagccccgcttcatccagacgatggtcagggatgggttgccggtccaggcgcagctgaagatggcatcagagcccagatccacgagcaaggattggggttctgtggtcatccggggcccaactgcgatgtgaggaagaagaagacaggttcaggtgggtggggagctctgggatcctccttgctgctgcctccttttccccctagaccttgactggggggaggcaggcagtggggtacttgtgccacctcagtcgcttccattttaagtcttatgtccgggcggggtctgggatctgggagtgggactcaggaagcaaggaggagaccactctccctgaggcttcgcctctcttgggcccatggaggtggtcggcagcgtggggcctgggaagaaggtgctggggaccaggttctgcctggatttacccccacggctctcatccccttccctctgtctggatcacgcccggtgctagaaagctgcggaagcccctccatcccagtggcgggcaggggccctcctcctgccctggaaatctgggctcttgggatcttcatgcctctgccttcaagctagctgccatctcctccagcctcagccttcatgacctggaatcgagtgactggtgcacctctggggtgggatgggggctctgagatgcagggtgatggaggcagggctctcgtgacccacgcctcctcccccagggtttcccacccggtgctctcaggccaccctcctattacagccgttccagcctctgtgtcacgcccattgcagtggagcagccctgggttccacttccgacccctctcctaagcattaaagagctgaatgcaggctcctctccaccttccctagcatgtctggagccttctgtagaccaagcttggtctacacagtgggggccgtgtggggattccaggctcagggtccgaccgtggccaggcaggcctcagagtgctccttccagggagcagacagagcctgaagcctggtgccaggagactgcgattagtcccctgatgtaaaaagggagtaacagcactttcttcggaggcttcaagggcaagggggagggccagattttttcaagtttgtaaaagcaagtttaaaactgtaaggggcggtgcatgagctaaggatgcttgttttgaacacatccagccagctagtccatggcagtgcgctgccttgctgcgggtccctgctggacctccagtgaataagaggggatgggcaggtgcggtggctcatgcctgtaatcccagcactttgggaggcagaggtgggtagatcacgaggtcaggagattgagaccatcctggccaacatggtgaaactgtctctactaaaaatacaaaaattatctgggtatggtggcaagtgcctgtagtcccagctactcgggaggctgaggcaggagaatctcttgaaccagggagttggaggttgcagtgagcagagatcttgccactgcattccagcctggtggcagagtgagactgtctcaaaaaaaaaaaaaaaaaaaaaagaaataaaaagaaaaagaaggtacgtccgtgagtcccctcagtggaaggcagcagaatgtgtgaatgggcaatggatttggtcattgcctgggttcagttctcatttggccacctactgtgtgacctcagacctccatctcctcattcagatgatgagaataaatatctacccatgatggcctgcgtgcttgtgtcccccgtcaaccctgcaattcgtaaattgaaatcctcacccctgtgggatggtagtaggaggaggagctttgcaggggcaggggttagatcatgagagtggagccctcgtgatgagattagtgcccttggaataaaggccccaagagcttgcttctctctttctctctgccatgggatgccacagcaagaaggcagctgcctgcaagccaggaagagagtccccaccaaaacccaccacgatggcaccctgatttcagccatttaagccaccgagtctatggtaacgtgtcatagcagccccagccaagaccctgactcatggggtcatgatagggattgaaataaacatgaaacaatgcacaaaccagctttcgtcgagtgcaaaccatcctacgctcatgacgcatgaagcttgtgttgtgtgcaatgaatctagccctggtttctccagctctaagcagaaaccagtggatgcctgctcgcctggggaagcctgcaccactgcactcacagtagacgtcaaccgtgcggctgaggttggtgctgcccagggcgttggtcacctcacaggagacgggctctgagaagtacgtgtagtccactgtggtcctgtacacctctccagatgcctccttgatgatctggccccgcttggcccacctgcaacaaaggccaggggctgatgtgggccttgagtggcaaggccaaccctccgggagctggacacatccatcccatggaaaaatgaggcctgggttgtgtggcaagtggggagtcctctggggtccgtcaaggggaatcttcacagaggggctacttcaagggctcagaaagagttggttttgctcccacccaggtggttgtgaaggcagtgggctttggtttgtggtcaccaggcagtcagtggcactcaacaagtgggttattctggagggggtgagttgattactcggctggtcagcccatctgctggctagacgatggaaaatccaactgtcagtgggcagacagctcgctgtcctgctctgagctggatcatgggcccctttggaaaagaaggaggccaagtccatgacctcagaggccagggtcaaacggagcatgcccatacatgcatgctcatacgtgtgcacgagcacacacacacacactgacaaggcgagaagctgtaggagaggtatgctgtaggggctccatctcccgtccaaacagtggaatactaatacccatcaggaggagtggcgtgagcgagtagccctggctgcccctctctttcctcttgacaagctctcagctctcctgtcctgttctgcctcctgcttccatggggttctgcatggtgtctcctcgccccagaaagtcctcctagtttccctggatggcacttgctcttcttcctgcctggcctctgcccttgcagcctggctttgctcctctgaagcaatggctccatcagcactggcttggtgaggggatgtgagtcggaagtctcttttgtcggccaatcggtaccacacaataggggaggacaggaggcctctggcttgctttggatctggctctggggcagtgacccctgtgttggaccagtgacccagcagcctgctgtgtgcagaaagcaacggagcctcacaggggtgtatgtgtatacacatgtatgtgggtgtatgtgtatacacatgtatgtgtgtgcatgtgtgttcatgtgaatgtgtgcatgtatgtgtgcacgtgtgcatatgaatatgcatgtgtgagtgtgcctgtgtgtgcatgtgtgagcatgtgcgtgtgtgcatgtgtgagtgtgcccatgtgcacgtgtgcatgtgtgagcgtgggcatgtgtgtccatgtgcatgtgtgcatgtgtgagtgtgcatgtgtgagtgtgggtatgtgtgagtgtgtgcatgtgtgagtgggcatgtatgtgtccatgtgtatgtgcgcatctgtgagtgtgtgaatgtgtgcatgtgtgtgggtgtgagtgtgtgcatgtgtgcatgtgtgtgtgtgcatctgcgtatgtgtgcatgtgtgtcaatgtgcatgtgtgcatgtgcgtgtgcatgtgtgcatgtgcatgtgtgcatgtgtgtgtccatcggcgtgtgcgagcatgtgcatgtgggagcatgtgcacgtgtgtgtgcatgagtgtgtgtgtgtccatgtgcatggtgcgtgtgtggtgcgtgcatgtgcgagtttgtgcatgtgtgaatgtgggcatgtgtgagtgtgggcatgtatgactgtgtgcatgtgtgagggtgtgcatctgtgcatgtgtgtgtctgcatgtgaaagtgtgggcatatgtgtgtatgcgtgtatagatgtgtgagcatgtgcacgtgtgtgtgcatgtgtgcatgtgtgcatgtgcgtgtgtgcatgtgcgtgtgtgtccacgtgcatgtgtgcatgtgtgtgggcgtgtgtgcatgtgtgagcgtgtgcatgcatgggtgtgtgcatgtgtcaatgtgcatgtgtgcacgtgagtgcatgtgtccatgtgcatgtgtacatgtgtgagcatgtgcatgtgtgcatgcatgtgcatgtgtgtgcgtgtgtgcatatgtgtccatgtgcatgtgtgcatgtgtgtgtgtgcatgtgcatgtgtgtgcatgtgtaaatgtgggcacgtgtgaatgtgtacatgtgtgaatgtggccgtgtgtgtgcatgtgtgtgcatgtgtgggtgtgtgtatgcatgtgtacatgtgtgagcatgtgtgcattgcttgtgtgtccgtgtgcatgtgtgcgtgtgtgcatgtgtgcatgtgtgtgcatgtggttgtgtgcattagtgagtgtgtgcatgtgtgtgcgtatgtgagtgtgactatgtgtgagcgtgtgcatgtgtgaacgtgtgcatgtgtgcatgtgtgtgcatgtgtgagcgtgtgcatgtgtgtgtccaagtgcatgcgcatgtgtgggcatgtgcatgtgtgtgtgcgcatgtgtgtgcatgtgtgagtgtgtccatttgtgagtgggtgcatgtgtgagagtgtgcatgtgtgcatgtgtgtgatcatgtgcatgtgtgtgtgcgtgtgtgtacatgtgtgagcatgtgcatgtgtgcatgtgtgtccatgtgcatgtgtgcatgtatgggcgtgtgcatgtgtgagtgtgtgcatatgtgcgtgtgtgtgcacgtgtgagtgtgtgcatgtgtgagcacgtgcatatgcatgtgaagttgggggcttccttacggatctccagggagagagagttctccgtttcccctggtttaatcctactctgatcccaacattcttttttttgaaaccacggaacttctcttcaggctgttacagttgaagtgtctatggggagtttgtctttccagagctgcagaggcttgttgcctccagaagcgtcaccccacagccactgctccctggaactgcagtgtctctgctcccctgctttgcctcccctttatcttattcctggagcctttcctggcaccacaaacgccgtctcctgcccttccctccattagcttcttgcctccgtctgacccatccagccccgagagacgactgtttcttggcatcagacagaacacctaggctggcaccaagcagttgttattgcaaattaatattgggtaattattaagaacacaattaataataacaactgtagtttaacaacagagcaaaccatatctcccttagagcttaaggagcttcccaacaaaccattatgagttattcatgtgtcgtttcaatctcttaactttgatttaatgaccagacttaaaagagtcaggccggcccctgcctgcggcaaatgaattcagttccaggcacagctagggaagtgtgtccagccccgcagttcctttcaccctgctgaggcgagggggccaggtggtggatgcagcgtgaggccaagcgggcagctggctgggctgggaaggcagggagccctggctgctcacagctgtgggtgccgggctggggctggagggtttgggcccaggtgatagggccaagcatgcgtcttcctcagggcttcctggagaagctctcgcctctcctctccttccagggcccctcaccaggagcatcacggagggtggaagccccacctgcttggccccaagtaatcagcagaactgctgctggctccgggagccaaggttccctgccctccctgtcctctcctctcatggtgagggagccagagacggaagaggaccggagccgctgtcggggctgggtccgcaggagcccaagccaggtcttttggggaggtgcctcaggacccgacagagcccgcagctcacatctcgcccagccggtctttcttcccctcctgcactgaaaaaccctctgagaggtccctgccaaaagcacagacactcaaaccactgcatccacgcagctggccaaggatccaggccaagagctaaagagtgagtctcgccccaccctcttcgtgcctctcctgattttggtgcagtttcttccctgtccttcctctttgtctcctcccctctccccacccacctcccccaactcactgttgcttccccacctcccccagcccctctgaaagtggagtcagcttaagcctctcccaatcaatgtctaatttggtctgaacaaatgtaagaggattaattatttatatcacagaatcaggggggctggcgtgtcacagccgccaggttgtcctcaaatagaccaaggtttcatctcgtgtgggggggccacatcccgctatctgctggggaacactgagagactctcagaggaaagggccccaaagcactttgggctcctggtccctaggagcatctgcagtgacatccccatgccacccaggcctcctttccaggcactgggatggaggagggcgttatctctagcttcagagatgacagcctcttagtgacagcagggaggaagctatcaagatgaatgaaagtaaagaaacaaagtttcctgtaatcttgtcagttaggaaaaatcaatgtacttatgtgatgagatttgcttacggcttttcttcttggatcccaacattgcttctaaacacctggctgcttggtgagaccttgctggagtgaaggggctgagcgagtgtgggtgggtgcaggcgcccaccacctcccctctccgtggcccctccgcctcctcccttcccaggccactctggctctctggcattaacctgggggccggaggggctccctgaaagcctctggagtcctggagggagatgacccctcagtgaggtgttttcagggcccttcactaatcagaaggccatgagggaaggtgaccaggaagaactagtgagtctctgcagggcaccctgccctccctgcccctcccagctcctgcttggtataggaggggccggctgtgatactgtgagctccaggggagtacgaaagggaggacccacaggccacctgtagcatggggaagcccgcatgttctctgcttgttcattaacttttcagcttgcaaaaaacaaacttcggaattacagaaaagttgtaagaatagtcccattaactgccaccctcccatcgcccggattcaccagctgttaacattttctcacgcgtgctttgcggagacctctcctctcctcccaccttcttctctttcctattattgctgttctgcttttttgaggttggtgaccctgggaatcaggcccagcacttcgtttcctgggtgtttgctgtccgggtcagtaggcaggtgtgggtgggggaggcaggcctgggggtggaggggtcaggtcccagggcgtgcagccctgctgtctgcccagcctacccatcactaggaccccaggtgaccagagcctggcagtgaggagaaacgaaagtcgaaagttgtgtgtcctggtctctggggcgcccaacaggcattctaagggtggctgtgagggtgaataggggtgcttgccgggtggtctgtgggtgtgaagggctgccctgggaagctagcatgacagatattttctgggcatgttgtacctggtgtttagggaccaggagcagagacctgggagcagacagaggagagaagctgaacttgtatggagaaacccaggcctggcaggtgcagcgtggaagcctagggccagggagtctcattgggcgcctctcttgtatcttcagtggcttctgaatagatgccagaccacagccaaaccagacttgccccctggacctggctggacccacatgattctggggagcctggagtccccggctcagaagggaccctggaggtcatctgttctttcttctgactctagtcaagcaaatggttaaactggacaggacaaatgggtttcatcctatttaaaaatatccttggggataggaactctgggctctgcctgggtttctgactccagtgctgcttaattacgcactctgcagggagcacctcctcatgtccaacctgaatccctggctgtccctgtggcccatttccttccattctgcccacgggggccacactggctcttgtcttccctgttctccattcccacaggccggcttatttcctaggctggcaccattaacatccttggcctttgcagatgctgcagcttaatggccgagatcaatggcagaggtgacacctgggctccaccactaagcctggtctggtggaaagagaccaggctgagtcagggccatggcaagttccacgtggcacccaaaaggaggtgagtctgcccttgagtgcctccaaggtcacttagtctcctagagtcttgtgcagtgacagtgcccaggcagaaaggcgcccagaggaagcgtgtgtttattggatcagtcagacacatctaaggagcatgtggtttatgccatgtgctgtgctgcatgctgagagccatcagtgactaaattgcagttcctgccttcaagaagctctgtcacaaggcagaaacaagtaaaacaaaaacagtgatgctttggccgggtgcggtggctcatgcctgtaatcccagcactttgggaggctgaggcaggtggatcacgaggtcaggagatcgagaccatcctggctaacacggtgaaacgctgtctctactaaaaatacaaaaaaaaaaaaaaattagctggcgtggtggcgggcgcctgtagtcccagctacttgggaggctgaggcgggagaatggcgtgaacccaggaggcagagcttgccagtgagctgagatcacgccactgcactccagcctgggtgacagagcgagactctgtctcaaaacaaacaaagaaacaaacaaacaaacaaaccaacaaaccaaacagtggtgcttttatccgtgttgtgagcaagagacacacaggggccatgagtaagtgtgatcccggatgctcactggactgggccggggcccagacatcctgatctacccaggtgaaccagtttgatgggcacaagactagaatggaggttctgatcttgctgcttctcctggttgttctggtttttttttgttttcgttttttttttttttttttcctgagccttttccccatgtttggagtgtggaataatcaggctattcaagcagaagccgtgagtcctgcttcctccagtggaagagggcgcgtgcacgcacagaggagaggaagggtccacacggctagcaggcaggcgggtttaagaggaagggaagaaggctactggacacgcggtgtggactaggcacacactgcagccatgctgaggaccctaagtgacatcccacgtgagaggcacgggggtgggggccagtggccaggccgggccccctcagcagtgactctcacctgtactgggtgacagctgggttggcctttgcagagcagtggaaagtgacgacgttgtcctccagcactggctgtggctccaccgagaggttgaccagtggagggtctgcagggagaggagagtcacttgtagaccggagaaagaatgggggcagggagatcctgggcgacatggaggatacagccagagactccaccacccagggaccctcagagcagcccccgccctggtggtcttcaggaagctgggggctccatgggaggtgcctgcttcagacagtcctggaggtgggaacagggcctccccgtggacttggggcctggtgtggacacgaaccccgagccaggaagcctcaggcttgggcccaggggtttcccatcctccaacttttgggcggaacaaaataatctaggaaggagaggtgggaagaggggtgcagggcagagaggggcgcgtggacactcagtctcgcttcagtgcagactgtctttgaaatgtctgtttattatctcttttccgtaaaggttctggggcatttgttaacttgaaagcggcatttacaccctttcatcagcctaatcatctccactcagtcctggctggtggcgcacggcctcagcttcccaggccggggctcgcttcctcatttgacgtgataagaagccaggctctgaagtgctaaatggtgggaaggggaggagacagaaagtcagggagagaaagaggcagggagacaagaaccagagacacacagagacacacagaagggaccggaggccgacagcgagacatgtacatagaggagagacatggagaccatagaggaagagagattatgtgtgtgtgtgtgtgtgtgtgtgtatgtgtatgtgtgtgtatgcatgtgtatatgtatgtgtgtgtatgtgtgtatgcatgtgtgtgtatgcatatgtgtatgtgtgtatgcgtgtgtatgtctctgtgtgtatgcatgtgtatgtgtatatgtgtgtgtgtatgtatgtctctgtgtgtatgcgtgtatgtgtgtatgcgtgtgtgtgtatgtgtgtatgcacgtgtgtatgtgtgtctatgcgtgtgtgtatgtgtatgtgtgtgtatacatgtgtatatgtgtgtatgcttatatgtatgtatgtatgcgtgtgtgtatgtgtgtgtgtatgtgtgtgtagagcgagagagagagagacaaagatgaggaagtgacagggacagggagagacatgggcagagagacagaaagacacacacatagaaattgagaagtgcagaaaaagggcgagaaaaagagaaatctagagaagcagagggcagagtgatggagagatggagagactgacctgtttgcagagactgtgaatcagacaagaatttcagaccaaaagcagaaaaggccacggagacccggcacatagggcccgacaatgacagggtgttagagagaaagaccaagtcaaacaacgaggaaaagagatatgaaggaggagcagacgctgcaagatggaaagatggaaacagctcgagggggctgcagcagagagacagagaggtgggaagggcttccatcagcctggccctgcccagctcaggggcagctggctctggatcctctccagaggctggtgtcacccctgctgctgggctcctggtggcccccaggcctcggcacccccggggcatccacacgccgagggatgggggataacgagccagttcccatcctttttccctgtcatggcccagagctctggctgagttgagtgggcagcccaggacctcatccccatggacaggctgggccctgggctgcatcttctgggtcagtccccaccaacaagcagagcaaattgctggaaagtcacgaggacttctaggggtccagcccatttccagaaaaagaagtaaagaaaccagtttctcagaggcaatgaggaaaaatgctggtctctttcggtccccatgggggcaccacaaagggagcaaggccccagctggcccagttggtctgggctctggttgggactacggtggggtcctgagaccctcagagagtcatacagtcatgcactcagcctctaagctgcagaccgagccggccttactctggagttcggatcacataactgctcagctgccctcttcctgctggtgcccaagaggaccctgcctccctgcctagtgccaggcacgggagctggcctgagagatggccccagggctgtgctggtgtctgcaggcactggggagagaactctgttttctgagtagcaggtggctgactgtgctggggagcctgttctcccacattttccctagttccagacgggggaccacaaatccaggaaacctctgctcctggtgcggtcagcctgcctgcctttcgtggggaattacaagggaagtgccctcacttgtgatctcaatcccagttgtaaggcataattcaagtggtcacaaagatggggttacaaggaatagccacgagaacgctcctcccacccccagaaccccgtgacctctcctcgaagctgcaccctagcttccagggcaaggctgaatcaggagttccagccctctttccatgcagggctggctggctgatctgggcgtccgtgggaccctacctagagaacatggacactcagggaggagcctgcatctcgccgtgggttggagaagtggaggtggggcagaggagcttgggaatcgccaccggatccaaacgcattgctggcccgtgccctcgcattataaaggccaacgctgggacgtgagtacccaccccaagtctggtttgaggaggtgagtgccagtcccataggctcaagggacccgccacagaacttggggggctgttccaggaggcccttccctcacctgggggtcttttctaaagtgatgaggtctgagaggcagggaggtggggcacacacctgttgtaggaccttcctgctgcccgatgcctcatcacgcccctgccatgatcagctcactcgtaaggctgctctcctgcactttcccttcctcttagcatcgtctttggtgatcacctgccccgaagcgattcacaagggttccacactcactggccatatctgcacctccaccccaagaccagaggtgcccaagcttctttctccacttctgctggtgtacagaatatacattttcaggagtctgccaagctccagaggtataaatagtttatgtcatatccaactattaaacatgattttaatctcacttgtgatgtcggcagcataacttgcaggagggcagctttgatgtagctggtggaactgagatcacattgaacagatgttacagctgagagtctgttagtgtttccatccgcccgtgtgtgcgtgtgtccatgtgtgtgtgttttcaggggaagtattacatggaggagagggtgggaaaagagagaatcttcatgactcagtgattttgtagcacattcatttgaaacttggcagctggacacagagtccagatgtggtgaggctttgggggtgttaagctttctctcccattactcaatctgagggctttgtcttccgttgggtaacatatgaagaccaagagaaacaaacaacaaatgtgcttttgctgagtttggatgcttcttggttgactgagaaaatgagcaggttcacaaaggcagctctgatgcagcccatggtgtccttagtaaacagttggatgctgactgaatgaacaaatgaataaatggaggaggagcgggagcaggaggagggggaaggggggagggagcgggtggagaacgtgtgctttgcttggcaagcacatacaagcaccttcaggctaggggcggtgagcgcggggacaaatggatgaagatcccttgcctgttagggctgtggggacacctgatgaggggcaccactcacctatggctctgcgtcctgacagcagctggtaggtgtggggcactcacaacgtgtcagacactgcgctagggggcttgacaggaaggatttcatttaatcctcactgcaaccttaggaggtaagcatgattacttccatgtacagaggaggaaatcggggcacaaggaggttaactaaccgggtcagtgccactcagtaagtggcagagagttcaaagcaggaagaatgctgtggccttcaccactacccagtactgccttggacgaggctggtctgggaaactgggctgctgggccccaagtgtcactctgacctcattctgacgcctcctaaggtggctgagatgtccttggaaaggaagccagaaagggcccagaggcctggcaagacccagtgtcctctggatgcagactgtcacctgcaccctgttgaacgatcttctgtgggcatgagtgcagaaggccgggtgggctgtggttaggagggcgagtttcccgttgcctggagaggttctcctggggtaatgcctggagcaggaaactgcttcttcccacctctccctgccaggacctacgctgctgtcgcagggggccagctagattgtcacttttgtccaggagtctgtaacattttgtacaggcctcctgatcaggttggggacaggctggggaagaagcgagggtggtggtggtggcagtgaatcgaatggcagcctggaagtaggaagcttggatgctctgtgtctcccgccctctccccttcctgatttggattgcatctggacagagagctctgatccgtggccagtcctcgggcaagaaggggccttggatgtcatttggccaaatcagacaaggaaccagagtcccctagggtgatgtgacaggcgtaggcccagcccacccatgggttgtggagccgtcgtggatgctggactgcatggctttgcggcatctcaccttttccagtggggcttactgctccatgtggctgctcaccacacaggaggaggcggtgctcagacccaggacccaggccagggccagggccagtgagggggaagagccgagggtcggagattaaggaggcctggcctcactttcagggccagccctgcttgcactgtgtgccccgggacctccttcagtcaccctagctctaggcttggccagagctccgcggccctggctgcttgtgaatgaggatgccagaaggctccttggtacaggggtatgtcgggggttgtaggggggacagagatgtttgttaatagctggtggcaagacagtgaagataaagtcccccccgccccaagaactcagcctttgtgtgtgggtatcttgagcctacctgaggttttcaaccatttcttctgccctctggaatctaaatggtgtctgtcaggattctagacactggctgggaacttctgctctcagctgccaagatgagctctcagaaccttaagacctggaccccatctctggactccaggtccctggagagacactcggagcccagaatccacaaggcttagagaaatcagggctgttaggaagtgtttttaaatgcacttgctttaaaatgagtaaaaggctaaggaggacacgaatgccagcctgcagctccagccttgaaattcagagcccaggacagaagcagccacctgcttgcagtagcgttatgtttggcggcagggaggggatctcagaggagagaagtccacttttgagtcctgactctttaaactgaactaatccagtcttgagaggaaggcccctggaacaccttgctgagctcttcttggttctggggctgacaggcaccttagggagacttttaggagactttcaggggtctctgttaggtggttgtgggatgcgatgctggtggagccctgaagcatcataactgtcaacatgaatcctaacacgggccaccgagggctggctgggcaggagtgtggagaggatgttaccagggtggactctggaaatctatgctacctaagtggtcttgggcaagttaatcaccctttcggtgcctcagtttcccacggtagggaccacagttgcaccttctccaaacagttgttgtaaagattaaataaggccaggcgaagtggctcacatctgtaatcccagcactttaggaggccaaggcgggcggaacacttgaggtcaggagtttgagaccagcttggccaatatggtgaaaccccatatctactaaagatacagaaattagctgggtgtagtgatggatgcctgtcatcccagctactcaggcaggctaagacaggagaatcgcttgaacctgggcagcagaggttgcagtgagccgagattgcgtcattacactccagcctgggcaacagagtgagactctgtctcgaaagaataaaaaaaagattaaatgagataatacatgtagatttccttcttcttgtccccttgatcaacccttccatgagagtggctggtgcaccctctccagagcacagcgctgcttgccaattctgaagcctggggacccttcaaataccagcatctccactcagacttcccctccaacagaggggccaccggctaggccagcagaggcagcagctgaccgtatttattggtgtgaaagtcccaccttgtacaggtgttgaaatgtggcctgaagatgtcctttgcgaaagaccctcatctgtgaggttgcatctcatgacagtaaggaagacaagatggtccttcctgtccgtatctacaagctggccaatccacagagctgcctgacccatttcctgctatcagatgggccaggctatggtcagggttgctgggtgtttcaccctgggcctggcagggctgggttgggggagggggtgggtactcacgctggatgtcaatggtgaccgacgtctcctttcctccggggatggctttgttggtggcacgacacacgatgctctggccattctccacgtcaccaggggagatgaagagggtgctgacgatgctctcccgcttgccgtcccgaagcagggtcttgggagaaagggaaaggggagagaaagctccatgtcgcttggctggggtggccagcctgggttgggggtaaacgagcaccagcttagacagaagggggagctgtggatggaggggttcagcttaggagacctgggctgcccatgtctacgcagagctcgggggttaccccctggctccctggcctggctaagtgctgggctgtggaaggaaaaaggaactagacagttttccaccatgtgaaaattagcctggattcacatgctaaaagcacaaaagaaagcaggatgggtttcatggaaaccaggcttcagggaggtcccatgttgaaatgaactcacatctttttgcctctggtgcttgagtgacagtctcaggctctgtaggaagcaacgagatggtttgcaaccagcagggactgtggcccctgagcggggacagtctgcagaggaggcacagtttggggaatgggagtcagagtgggtggggatatgggcagaatcagtgcacatcaacctttcgattatttgcctatataaatcctttcaactttccaaagcgtttcactccctgatctcattagagtctcaatcaaaccataggtgggacagataccattatctcccattggataggggaggaaataggtgggctagacagaggctatggagcttgaccaaactcacatttcaagttggtcctgaaataagtactagtctcctacagcaggttgaatggtgtcctctccaaattcttgtctaccaggaacctcagaatatgaccttatttgggaatagggtctttgcagtttagttaagcaattagtaattagttaaggctcttgagatgaggtcatactggattcagagtgagccttaaacccaatgactggtgtccttggaagaagagaagagagtctgctgggtgtggaggctcatgtctgtaatcccagcactttgggaggctgaggtgggaggattgcttgagcctaggacttggtgaccagcctgggcaacataggaagatcctgtcactaccaaaaaaaaaaaaaaaaagaaaaaaattaaaaaaaaattagccaggcatggtggcttgtgcctgtagtcccagctacttgggaggctaaggtgagaggatcacttgatcccggaaggttgaggctgcagtgagctgaggttgtgccactgtactccagccagggccacagagtgagaccctgcctcagaagaagaagaaaaagaaaaagaaaaagaagaaggagaaggataaagagaaagtgaaagagaagaggaggaggaggagaagaggaggatgaggagaagacagagagaaacagagaaggccaggtgaaggtggaggcagagattggagggatgctgccacaagccaaggaatgccaggagctgccaggagctggaagaggcaaggaaggattttcccctggagcctttggaggggcacagccctgctgacaccttgattccagacttgttggcttctacagctgtgagataattgatttctgttgtgtcatgcaccgaattgtggtgctttgtaatggcagccctaggaagcaaacccatcttaactgctggtctcccaccttcccaggtcattgcttttctctactgggccacaatgtcattccgaagctagttccccattgtggctgctacctccttccctctcctgttcctctttgcagctacttccccatcactttggggcgcactaagtcaggtgcaccccggggagggtgtgctgagtgtgtgtgggggtgcacttccaggttgggattggggtctggtcagtatgcaaaggcttctgctactaggaggtactaggaaggaacctcactatgggtgcagtcctgtttcccccgactggagccagggagtagatgaacagaccactcctccctcaaaacctcccataaagtgacaatggcaatgtctctaattcttatgagggccccggaagacagcagcattatctttgattagccaaagagaaacctgtgttccaagtgagccgggaacttgctgggtggagctaggatttgcacttaagaatgggtgaaccctgagccacagcctctgctgcagccccgggggtgctggacggtgggtaccgtgctcttggcaggacagatgggaacagttagggccacagggagaaacctgtaagctcctagaaccccacattctgggtccttaattcagtgaggtttttctcaacttggggcaaacctcgtggcgtcaggagaacagggccagagcctctatatagaacagcacatcttgctggaggcaaagccggactgtgacattctagagagccacgcggtgcagctgcaggcctgggactcagggtgccagccacggccctgggcagaggggctggaggagagtgacgtggccagatgcagcaagccgggggcaggaccactgcagaggagtgaagttgaaccccaagccaaagcccgggcagggagggagcagcagctggcaccgctttaccaccctgccttgggctcttcagcagacctcatcgagtctataaatagccaagtgataataagaacaatttcctggatgaaactaagacttcgggtagggcgcgcaggggcggggaggtggtgaggagcaggttggtattcttcttctcttctttacatttccgttgtgctaacaagggacatttacataagcttgactctgccaggagcccttccaacggatgggctctgggcggtgggtgccagtggcaggggagggaggggacccagctctaattaggccctctgactgctccccctcctccctgcacccagcgtgctcctccgcctcggaatgatgattaatgacatatttactgggtccaggcgtgtgcttttctgggaaataaaaattctggttcaagttgtttgttccacctaattagagaaaaagggagatgtgttcattaaacaaaaggagggtgaggggaaggcacgtgccccagcaccaacaccctctctgtccccgtggaaggtcccagcacctcctgggcccctagctcgcgggggaccccaggccccgtgcagcgggtatcccagggaggaaggctgggtctgccagctctgctgcaggacgactgaggggaggaaggtgggacagagctggggggcccagggggaaggctggagggagccctgcacctgcaggacagggcgggatgtggaggggcacgggggatctgcacccccgggtttctcttcccccattcctttctgatctcgcctctcttgtttcttttgcttcactccttttcagaaatgaatctcccctaattgtcacttttctcatatgcaaatggagcctctggactttgcagccttgaaggtactgtccaggagaacattctatcatctgcaggttctagtcgcagctccactccgcccctcccttccctgcttcccttcactgagcttggctctggggacacaccatgggcattgaacctcccacctcctgcttcagaaagcttcatgccttgcaggtgagctccagaaggaagtgagttattcatggtgggccactcactgtgggagccaccgcctccaaggcctccctccagtgtggtgagcactaacgtgctgccagcccccggctcgcccaggttgcccatgtgactgccatggtggctcccaagagtccccgaggacccagctcctgtgtgtgcagatatgggccaggggcaggcatatagatggcgtgtgtgcagcatgtgtccgggaacgagcgtgccagggcatacacccccgtgggtatgtgcgcgtacctgtttttgtctttgggtgttcatgggcctctgtccactgactgccgtgactctgcggggccccaggttctctctggacgctgcctgctcaggtgccgcctcagggctgtgcacccacccccactgcccctccctaagggcagggatttggcactcacttctctagttccccagcaccggcctgggaggccggtcttcccaggtatggttgtacacagtgtaccccaccccatggttttcctgcttgggtggcagtggctggccactctgctctttccaaagcccccagggcctcctctgggcagtggagagccaggctgagctctcggaaatgggtgggctggagggcagacaaggggtgggggcccaagcactggtgctaaatatggggtgcccgatgacaggcaaaccgtctggaaaggccgagagtagcctgattgcctggcagcaaggccgcctcgcttctccccgctactcaccttccccacctgctgggtccctttttttttttttttaaaaaatcatggctctgcttccccttttgatagctgcttggggctccccatgggctggttgccacctggcttgaataagggtgtgtgggccaggtggaggatgcgcagtgctttttgccccagtccctgcatccagccttgaggccagaggccagaggggtgcccttcacagagaaggccaggatgagcctcggccacacccagtggagactctaggcccctaagctgggcagataggtgcagggtgatgggtgagtgaccagggagggggtgcccagtggagggtgagggccctatgcatgtgggcacttatccctttcctgagtggggtctccagagctcctcttagcaaaggtggtaaaaggcgaggccagtggtcctggtggtaggggtagagggcaaggggctccaagcagacacagacacgactgtgcgtgctaagaccttgcaaccctcctgcctggcaggaagctgcacttaggaagggttctttctgggctcagcctgtcctctcgcccctcctcttccgtaacccatccttcctcccctgctgtgtggacttgggggctttccagaagaaagaatgtggtctccactctggcgccaggccctcagaagtatgaggaacagggaaggaacccactgtccccagacagcccagggttgagtctccaggaagaagcttggaggggccttttcctgctctgtgcctctgcagccgacacccgctgggagcctgcagtgggcactgcccaaggccccatccggcagtgtggctcgccctgcaccctggaggctgtgacagtggcctgttaaggagaagcatggccagcctgtgctgggggagggactgggtgcttcctctcctgcccttcctcctggggaaggggcctggtgccctccagggctgaggctcatccctcccctactggtcccatggtggagtcacagagagaatggtcggtgagcaacccagaaactttgagaacaggcctggtgttttatgaaatagctgtatgacccctggggcagggaactggggttccccctgtgggacaggagccaataatagtagctcacatttatccagtccttactcctgcccttgacagggtgcttctgatgcataatttcttgtaagtcactctgcaaccctaacagacatccgtgatcattatcactgcattttgcagctggggaaactgaggcagagggtgacatcaccatgttatgttacggatcccaggtttgagctaggccttcagaaccatgtggccagcctaactatgacaccgatgtctgcatatgggaaacgcgaggtccatagtggggtggaccttgcagccgtgtggatccagtgagggggtgacaatcccaacagcagtgcttgttgcaagctcgctatgtgccaggcgtgtttctcattcaactcctcacaagcaccccttaaagtgggtgctgctgtcgttcccattgtatggcaaggacagggaggcacggcaaggtgaggtcacgcagctggaaggtggcagagcccggatccaaattcaggctgccagctcctgagcccacggggataatcatccaccatgtgacagccactgagggcgtcagacccgacagcagccagggctgccctgaggggtcttttctggggtccttggaggctgcctgattttgtgtgtgctcccagcttctcttcctctctgcggctgatgctctggcccctcctcatatgtagcctctctggggaagtcaggagtgctgttggcctatggcagggctccttgcagccctgggggaggagggggtgggctgggtccctgggaggggaagcagaggggttggctcggacagcccccagagcctgctccataggagccctggattgtgtaacctactgggtatactccacatcacaggcttgtagcttctccctgcccggcacacagccccgtgcctggggaagctccactgacgtgtgcgggctctgctggtcacccctttggtctccatgagaaccactggccgtggggtggacagttaggatggtggatgaccatggtttggaggagaggcccagagaaatgaagtgccttgccttgggacacagggcctcttcccatgctcatgtccagggacacattgagggtctcaggcctctgctgctccctggacaagccacagaggggcaggagaccatctgaggtgactgtcccctgaggaatctgtttctcttccggagcgtctgatccaacaccttcattttgcagacgaggaaacagatgcccagggagtgagttgcctgaggttatgcagtggaagctggaacccaggcctgcgactgcctggcgctgccgttcccgtcacaggcccaggagcatggatcgggtcccccgccctgctgtgcagtagtatggtaccaggctctccgaggggccttcacaatgtagacaaggatgacatgttgagctcaaggtgatcctgggacaggtccagcagagtgaccctgacctctctctccacctgatggcatgtgtcctctgcaggacattgactctgctagggtccaggctggcccaagttcagggagggacaggacaggtgctcagactggaaggaaagcccctatccttccttttcattctcctctggacaactctctctctgtgttatatccttgtattacataacaggacagggtggcttcagcccaggacataagggagaggcttgtcttccaagaggcagccatccctccctccccctggacttgtgtctgagggaaggagtttgccctgggttctggcaccaggtgctgggttctttgatcggcagccctggagtgacctcttggcaggtggtcagtttgggacaggaaagacacaccctcagagtggggacgggcctgcctcacatcctcggatgaccaaggccctgcttatctttccaggattgcttagaggactggtgggtagggggaaccaggccgtgtatttccccagtctctgaggacaaggaaaaccctcagacctgaggcgagcgggcgttctggaggctgggcccccagctgcggagcttgggggaccggcttgccctaggaggagcatgggcaagggcagaggccagggtgtcaggaattgtggttccaggcctggcactgcccactccaccactgagaaggacagtcacttccccaccaggcctcaattttctagctgcagacaaaagaggttggcccaggtatactgtaaggcctcattcatcttagaggctctgtggtacattaaccccatctgggactctatgcacagttttgttgagtggagtttggtgggggctgtttaaaaatgtacccagaattttgtttttattcaggtagagggaggccaacagatcaggagacaactgccgttgaaaagacagtttgcggccgggcgcagtggctcagtcctgtaatcccagcactttgggaggctgaggcaggtggatcacctgaggtcgggagtttgagaccagcctgaccaacatggagtaaccccgtctcttttaaaaatacaaaaaaagaaaaaaaaattagctgggcatgatggcacacgcctgcaatcccagctattctggaggctgaggcaggagaatcacttgagcccaggaggtggaggttgcggtgagctgagatcacgccattgcactccagtctgggcaacaagagtgaaactctgtctcaaaataaataaataaataaataaaataaataaaaaataaaaaaagaaagaaaaaaagaaaagacagtttgctactcatagttcccagaggaaggggaggccccagggtcagttggggctggggtgggaggtgtggggagagtgtgggcacagcctctgttgtggcttgctttcataggaaggaatggtgaggtagggttggtggctcagcaggtttaggattggatagcttgaataatttccctgggccctgagctgtaggggtggtctgatgtgtggccctggggagatttagggtaggggtataatgtcctggactatggagcctgatgaaaaaaggctgtgggggcctgggctctggattggttggtctgctttgatataaagcctgcttgctatctccaggaattagcttaccctggtccttccctgggtctgcaaggccccagatgtcaaagcatcataaaatacacaacattttaaagacacaattaatacgggggccagttcagggtgcttccagcccttggtatcgtgtgtgaattagagaccagaacccctgttggtagacacagcagggcaagggctgttgggtaagggatcatgggctggatttcagccctccctggcccctgagccaggcaccttggagatggtggagcctaaacggcttcacctggcagccctggaaagtggccagatttagcaaataaaatacaggatactcagttaaatgtgaatttcagatatataatgactgtcttctttagtataagtatggcttgtgagtatgtccaatgcagtatttggaagatacttacattaaaaagttattatttttctgaaactcaaatttaactgggcatctgtcttagcccagctgggctgctataacaagatatataaactgggcggcttataaaccacagacatttatttctcactgttctggaggccgggaagtccaagatcaacgcagatttgttgtctgttgagggacagacacctggttcatagatgccctcttctcactgtgtcctcacaatgtggaagggacaaggggtctccctcaggcctcttttttgtaagggcactgatcccatttatgaagctccacccccatgacctgatcatctcctaaaggccccacctcctcatacttgggggttaggatcttgacatagaaatgttgggagccacaaacattcagaccgtgattgcatcctgcattttatctgcacccctagaacctggccactactgtccctgagtctcctcgtctgaccatggcctattgttagggtcttccccagcagttaccctaggacatagaggagagagagagagagagagagagagagagcacaagtcagataaaaggatggacacacatacaaatgagtaggagaaccacagcatgaatgagaaaaagtgacacagagtgagagagcaaaaaaagatacaaggagacaaagagtgagagaaaccaaaaggggcaggagagagggacagctgcagagagacagggcagctggttccctccccatccagcccccattatcccccctctacctaagcccagcccctccccagcagccccccaccatcctcctctctacctaacccccagcccctgccaaccagccccccactatcctcccctctacctaacccccccagcccctctccccagcccccaccatcctcttctctacctaaccccccagcccctctcctcttaggcccccatctagccccccgcctaaccccctctctacttaacctccacccctcctagtcccctcctaatccagcccccgctcctttagccccctccttacctagcctcctccccatcaactccctgtccacctagccccctccccacccactccccttgaagcccgtccacacccaccccctcccctccaggcctcaccttggagtaggtggccccattgatgacctctccctttcgcaaccagatgatggaggctgcaggcttggcattgtctgcgtggcaggtgaggttgagagggtcccccgcacgcaggctgatcacagggccccccaggatgacggggtcatcaggcggcactgcggggagagaagcagtgaggtcaggccgaggctcccacctcgggcaggacggcaggcaggctgggaggattttgtggagatggcaacaaacaataattatcacacattaataaaacgcatcgtccgcttgtatcgtaatgatgagagcagcacccacagtgatccctgacatgtgcactgcgtgcttacagtggaggatattcctgccagtcatcgcatccctgctcaggacctgccaggaggggacagggccagcagcctcagcctgcactcccagacccagaagcagagctctgtggcccaggcgatgtctgtggctgctttttaacttctttttccttttttcgagatgaagtctctgtcacccaggctggagtgcagtagcatgatctcggctcactgcaacctctgcctcccaggttcaagtgattctcctgccttagcctcccaagtagctgggactacaagcacgtggtaccatgcccggctaatttttttttttttttgtattttaagtagagttggggtttcaacatgttggccaggctggtcttgaactcctgacctcaggtgatctgcttgccttgcctcccaaagtgctaggattacaggcctgagccaccatgcccggccaacacctggttaatttttgtatttttagtagagatggggtttcaccatgttggccaggctggtctcgaactcctgacctcaggtaatccacccgcctcaggctcccaaagtgctgggattacaggcgtgagccacggcacctggcttttcttttttctttaaatgaagcactgtcacacctgctgtctgagttagtcctcacaacagtctggtgaggtcaacattaccaccccaatgacacagatccggaagccgagttccagcaagattagtgactggctcaaggtcacatggtggcagagccagggctggaggccaggcccagggaacctgggagcaccaggccggccccttccctggcagggagcagggtacagggcagcccttcacagtggagccagcgcttcggagggctgtgtaagcgctggcatctcctgagctcctcactcctccagagcggctccagccccttcatccccagaggcagcctgattctctcctgtcccagccttccactgcattttgtagtagggtcagagacgggtggctcccatcaagggatcctgagtgccaggaagagggccatccgcgtcggagcacggtctccgcagtgcccagcacagagccctgtgctggggaaactccactgacatttgctggccccactggggtcaccctttgattccgatgaggaccatgggctgaaggatggtggatgatcatggtttggaggagaggcccagaaatctgaagtaccttgcctaggacacagggcctttcccatgcttgtgcttggggacacgttgagagtctcaggcctctgctgctccctggacaagccacagaagggacaggaggtgaggcgactgtcctctgaggaatccctgtttcccttaccccaggaggagctgggcccaccagctctggaggctgagagaggcccagggcctctggacacatcaagacgtgagctgtctgtgtacacagcaaacacagaaggggtagttggataacgggggcgtgggaacctagcacaaagggtcctctctgcctggtggccagagaagcccgcccttctatgcaggctctgtgctcggggctctgggctggagaagttcagagctgaacagtcacagctccgggcccgtcctgactccactggctcagccttccagcctcagcctgcatgggaacttccctccccttctcaggggatcgccccgtcagcccttctcctagtccactccggcttctgtgaaagctccaggagggacaggaagccccagtgggggccggtaagaagccaagaagcaaaccttcagaacagctgccttgccctccctgcccggccttggaggcctgctcccacactaacagcacagcagtgccatttcctgaggaacaagcaacctcccagggcttccgagaagccatcactgaccccaggggcagcgagccccggactccaccgagatcctggctcaggaacagagtctgcctcaggcaaccctgcctggccctgggctcttgagccgggaggaagcaggcatgaatgggatggatggagaagacgaccccccagccgcccaccccacaccctttcattagtgcccatgggcctccttggggtgggcctggccacagggcaaaacggaggcggctcagggctttccaccaagtgggggtgggtgcaaccacttgtggaggaggggaattgcatctccacgcggtgagtgggggacttgcagcaggaagagcagggctcagaggtggccagccttcacccttctttcttcaaggcagcctccccgaccaggatggaggagctcgggctccatgagctagctgagggcctggaaaaagagccacgtggagccctggggacagcctggatacctggggcctcagccttcccagtgactgtggaaagtgcctgagagcagagggtggagcaggaagccccttctctcagggtggcttcaggtgcaaacgtgagagctcggaggatctgggaactgaccgctctccagcacggacatttactgggccttggacaggggtttgaagccttgactgcatgctcctctgcagaggttttaaaacctcactgcgggccacaccctgagcagccaagtcccagtctctggaggggaccccaggcatcaggactttggggagctccccagggggtcccatggcaggaccagctttctgggctctggactctgggctgaggggcaggagcctctgcttgctctgagcacagtgcagccaccaaggccttcccgagaatccaagacccagaggacgggcccttcctccttgtggctggagtgttgtgttactggaatatcggattagaggcagcgaggacgagggaggagggagtggggcgtgttgtgggagtgctcaggcacacgcacagccacgcacatacatccaccctcagaatggggcctgattacatcttcccaaataagtggttatcatgctgggtattcatgtagccaggcattattgattggtcttcgcttcactgcacaccagatgggggtgggggctgggggggggtgggggttggtgaggatggaggatgtttgggggccagcaggctgaagagaaatcagcagtcgctcttggcagctgtgtctggcgtggaagggggctcctcattacctccccattcagactcggccaggctgggccaggcagtggcgaggggaggaagtttcagagtggtccccgcttggagatgtattattcatcaccccctcgcaggattggttattatcctcaaccactatagagtttgggcttctaatttttaatcacaaggaaggtggaggcgttagccttttcgtgattaatccggagataaaaatagttgactgttttggtgttgtgcttgttgtcagtcaggaaaaaaatggcattaactgttggggcactgaagcctggggaggactgagcggatcccaggcagagtgggtccccagagctggaagccagcctaagaggccacagcgcggccttagccgggggtggctgagcgacactcctgcacccagctggctcctggggcattgattatgaaagaaacacatcatcgcgggatgctgagctctttacagtttactctcccattggccaggactggagcaggcagcttcagtctccctccctgctctgcccctacctgcccagctctgcagactttgccttgtttgggtgggcggtgggggtacccgtccctttccctgtgtgtgggagggagcccccaaaagctttccccaagttctgctgccaaagacaatggggtctcgggtggacaggtggcatggggagagggaaattgaggccagagagcacaagaggctgacccaaagttaccagtgacgagagcaaagaagggtgagggtgggcttgggacgcacatcctggctgtaactggagaggtaaagctttcatctatttcacgcactaaggttctctctaacctctatactcccctttttttagagacagtttgccaggttggccagcctcgtctgagcaggctggaaaaactctcttggtgccaggacaaggacagcactgagggaatttcctccagtgtccacttggtcacccaactgagacctggctgggcttccaggaattcctcgatgctccatcagcctgggatggttggtctctgagcatggctgatcggtggcagctggaggggtgggggaccagcagcaccaccctcctgcccccatactgcatggtggagaacctcatagacacccagccctttggagagcaagactggttctcatttgactcaatgagcagcgagttccccacaatgctggcagagtgggtctatcaccaacaccaaaccctccaggggcttcccgctgaaggagagtaggtgttgcctgcaagcaccagcacttacggccctcgctgcccctggggcctcggtctgttccaaccactccttacacagcagaccctggccccactgcgtctctgctgctcagcaaacccagctccttccggggccgggcttgccctgctcctctctgtctgtaacgctctttcctgttcctcactctgctggctcttcccgtcaatgaaggtgcagcttcaagagcccttcagtgactctccactacccacccctgcactttctggatcactgggttcatttattatctgtcaccgttctagaaaggacaacaaagaccttatctatcttggtcattgtgatattgctgtatcacacagtaggcgctaaagaaatatttgttgaatatattatttgttaaataaaagaatctcagaaggggagtggggatggggccggggggacggttatcatgggctttggcttctgaggtcagcgttttaaatcttgtgtgtgtgtatgtgtgtgtgtatatatgtgtgtacatgtgtgtatatgtgtgtatgtgtatatatgtgtgtacacgtgtgtatgtgtatatgtatatgcatgtatatgtgtgtatgtgtgtatgcgtgtgtatgtgtgtatgtatgtgtatatgtatatatgtatgtgtatgtatgtgcatgtagatgtacatgtgtgtatacatgtgtatgggtgtgtgtatacatgtgtatgtaagtgtgtgtgtgtatatgtgtgtgtatatgtgtgtttgtgtgtgtgcatgcatgtgtgtgtgcattgggtacagttgggaacgggctgcgtgagtagtgggagggaggagggcaaagcaggagcccttctgaggccagctgggacagcgctgtaggaactctgcgctgctgtggcatcagggttggtgctccctgtctctcctcgagagagggaagcctggctgaggggggcttggtgctgggagctgattctcagcctgtttctccgtggctgctgtcctctgatttgtctggaacataggatgggagagggcggcaggccgagcatggtgacagatcagagacacttggctgagtggggagaaggacgtttgtgggttctttgattttgttctgccgcagacccaggggctctgggagagtcagtgctaggagttccagcactgactacagtggagggaggatgccgaagcctcggggtgcatctcccacaccttcagcatcttctccatccccaggttccccgctgcagccctgcagtcagcctgccatgtgtcctgccctcctgcctccctccctcccaacctttctctcaccagcctcctccatgtcacaagctgaggctatgatagctgagtgaagccatacacggcctgccatcttagagctgatggggaggcccttgccactccaggccagtgcccaagacggacatgtgtgcagccttggcacctcctgggagcttgttagaaaagcagactcttgtgctccacctcagacctcctaagtcaaaatctgcctttgaaaagaccccagacaattcacatacattttcaagctggaggagcgctgctctaagggttccgaggtagaaatcatgacaaactgacaagtgctatgaagggaaggctcactggacaaagagcacgtgtggggacccttgatcccttcacaggctgcctgctcccttcgctcccccggggccggccagagaaaggggcagactgctccctgcttactagctttggagttacacgatcttgtttcagaacagcttcctttgtgtatgccgtttctttagcttggaatgctggcgttctcctggaccactggtcttctcctgggtcactcttacacaccctttgagacttagttcagagggcaccctctctgagcggcctttctagaatctgccagttgggccaagtgtatagggcttctgtctatgatcccacagcatcctgggcatcccctgactcactagctaccacatcctatggaaatctctctgtgtgtgtctcttccctgaaccatgatctccatccggatccccatctcccagcagagtgcctgcctgctgcacagggcacagggtggcatatgcatttgctgagctgaacttgacttgagtcgatcactttatgagccatatgattgtagacaagttatataatccgacaaccttaatcctcttatctgggaagtgagataataaaaatacctatcttgcagggttatcatgaggattaccttacaatatgaaagatacacagagaacattgtaaaaggctatacaaatgtaggttattatgtctaatttttaggaataatatttaggtttgtggctgtgtgaaaagtgctgagccaaggtcctctcattttattctcaatatcttttgaggcagggactattagggtcttcattttataggttaagaagctgagactcagagagggcaaattacttggcaaagaccacacagccataagtggtgaagttggaatttagactcgagattttgaccctacaacatgttctgttggagttagagcagctcccagactatccctgcagctgcagcagcccttccactaacccctgcctttgtcctggccctagagctctgcgaagcgggctctctgcctgtcccagggggcattcagacctggcaggtactctcctcccttccctccccgcagtctgaatttcagagggccccaggaagcatgagcctggctcgcagttggtgctttggcgatgtctgctaagggaacggacgaatgttgtttgtagtccgcccagctctttgctgccttttgtggttttgcccggttctctggttctgggccgcgtgtaatcccagcttccggtttcctcacgtatacagatgcgccacctaatggccacaatggagaactgcaggatgtagagacaagagggagctgacctggttttaagagtcagcttcccagtggtagccgaacaatgtttggagaaattcgtattgagcacctactatacgccaggccctttctaaacactagggacaagaagcttctgccctagtggagtttaccttctagtgggagagacagacaataaatgaatacacaaatacatacataatacaaggttaggtgttgataagtactagaaggaaagtaacactgggcagggaatagatacatcctaaattggcctccgggattccctcctggcttttctccttcctctctggttgttactttttgttttcttcccaccccttaaatgctggtcttccctagttagctcttgctggccatatctcatttgacacactatctaatggaaaaccttcacttttctgtgaactcaactcacatctttaagctgacgaattccaaagaagcatctcaggccagacctctctcttgagctccagagtcatgacccaactgtccacgggccttcgaagctcagcaggtgtgacaccacacccaccgcctctcccagacacccatccatccccatattctgtattttggagaatggccccactgtttggggaccaagtcagaaatctgggggtctttctggattccactctcagtcaccctgtcttgccaactagcctggttaaccctctgaagtatcgctcagatttgtctctttccattcccacaggcttcctggatcagccatcatccttttgtgcttggattacaatagtgcttctcccctccatctcctagtcctctgtgcttttccagagtgactgttacagaagtctgaatattcacctatccagtcaaccagtaattcacccaccatgtgctgaatgtctagcattcctctgtttcaaatcctctgaaagtccctcattgccatctaaatagtctgaacttcttggccactgctgactcttcggccttgcttttcatcacttcttacctcaattcctccttgtggataagagccacctgcatttgttggagtaaatcgcttttccccaattgcccctttccattttttatttatttatcttttttgagacagagtttcactcttgttgcccaggctggagtgcaatggcatgatctcggctcactgcaacctctgcctcctgggttcaagtgattctcctgcctcagcctcctgagtagctgggattacaagtgcccaccatcatgcctggctaatttttgtatttttagtagagatggagtttcaccatgttggctaggctggtctcgaactcctgacctcaggtgatccacctgccttggtctcccaaaatgctgggattacaggcatgaaccaccgtgccgggcctgcccctttccttttgctttgctaacttgaaggtcgggcagcttgggtttgaatcctgggtgctatgtttactggcttgtggccatgggaaaactgcttagcttctctgtgcctcagtgtccttatttgtaaaatatgaattaaaataacaaaaccagattcactgtatagttgccagggtcaaggaagatgtaacatgagaaaatgctttgtaaagggtctgatggatgatgtggcatgttattggttctctaagcagactgggctcattcctttgaaaggcgatagacgggcaggggagctgggacttagaagtcccagattgcccccttggtaaagcagaggtctatgtccttttccctgctttgccctgctgggagctgggtgaagaccctgctgctcccatgggtgattccacgctgccctgcctggcttggcatcccctccctctgggcccccccacattctgtgccaactgaggcacacactgcttatgggctgcaaaggcacatgtgagccccatgtggagcagagagatgagccatctcagctgagctcagcccagattgctgactcacagttttggagtggtttattatgcagtatctgcattcagaacacaatactccaagatatcgcatcttagaagttgagaaaacagcagaagcaaaaagtttactctccaatcccctgccttcctgggcgagagctagctgtaaaaaattctttgacccatctcccctgaaactaggtcatgagatcctcattccagagggatcctgccctatactcagaggaaagaaacggtgtacaggaactcaaagaggaatgcaggcaaggccttgctaagttcttctggtttgttaccatgaggtcatacccccttttttgtccaatcacatttctgcacaactgcccattctttgttgaacataagcctacaaatacacaattttcccatggcatttgggccttcatttctgaaagctcacataaaactttggttaaatacatctgttgcacttttctcttcttaatctatcgtttgttacacgggtgtcagctgcaaaccttgtaatggatgaggaaaatatattactttttctcccctgcagcagcaaaagctaactgatgtaacccagtagtcccctgctgtttgattcagaactgggcccacggcatcaactgtctctccacttccctccgatccattctccctccactatggccaggtgactgttctggaagctcggtctgctgctcacaatgttcaatggttcccactgctccagcacaaaaatcaattcctcatcatgggggccttccccggttctctccagtgaggtctcatctctgcagctttctcctgtgtgaccattaactcttctgtgaggatagcctgcccttttacaaatacacgctttggcttgtgaagttccctttgctgggaatctccttgcctgagtcttaactggctggaatcccagcctcttttcaatcagctcaaaggcctatcatgccttgttaactcttggttattctttaagactcaggctattgtcacctcctccacaaagtcttctctcaatctcaacccctgactctcccacctgcagcctctgcactgccataagaccatgtgcccgcctcagcaggtacatgtggtgcctggcgccattaccacctgttgttcccctgaggctgtgagctccttgagggctggtccttgccaaattctctctctagtacttagtacagtgcctggcatagtgagcacttaataaatacttgttgcctggtgccttgcctgatcccactgaattagaagccccctccccacctgagcacctcttacactggtcctcaccacatctctattgcattgacttgtggacctgtttcaggttccctacagttgcagggtaggagtcctggcgcctctttgcctgtctcccattgcctagtatgttaccttggatgcagtcataaaaaaacagcaccaataatatgaataatagctaacattgatatagggcttaccacacagcaagaactcttctgtgtactttacaaatatcctttaatcctcacagctctatataaggtagatacaatgacgatgcatattttggaggtgaggaaacagccacaaagtagtcaagttacttgcccaacatcacatagctagtaagcagcagagctgggatatgggtagggtttccagacttaacaaatcaaagaacagtaggccctgttaaatgtaaatttcagataaattaaaaaatggtagtgtaagtatgtttatctgaaattcacatttaacagggaatcctgtattttatctggcaatcctgtagatgtgttaattacatatatgtgatttaattaatgtaggtgtgctttccccctcttcagaccctccccgcctccacttaggtctatattaagaagatgtggggcaagatgcaaatgggatttttttttttttttttctgagacggagtctcgctcttgtcacccaggctggagtgcaatggcacaatgtaggctcactgcagcctccgcctcccaggttcaagcgattctcctgcctcagccttttaaatagctgggattacaggcacctgccaccacgcctggctgatattttttggtacttttggtggagacggggtttcgtcatgttggccaggctggtctcaaacgcctgacctcaggtgatccgcccaccttagcctccaaagtgctgggattacagctgtgagccactgcgcccggccacaagtgggattgttaaaggatgtggcatccgatatatttggcagcacaatcgcacagacgtgtctccaaggaggttggggacagagagaaaagaggaacaaggagcaagacgcaggtttaggatgatggcatgtagctcagaggaaggtgtgctggaggctgtttcagttctgctcctaacctgggggtggggggaaccctgaactagctgacttcagaggtcccctgcaaaggtttgggacactgggaagcccacttctcagctggagctcatattgtttaggggataagaagggaggccctgaagtcagagtgcctggctgggcttctggctccgtcattcactggccacgtgaccatgtgcaaattctctgtgctggatgatgttaatgtcatagatattatagtagctgttgtacagggctggtgtgctgtttaaatgagttcatgtaagagttatgcagtgtcttgtcccagagcttggcactgtagtaagaacccactaaattttagctcttagtattattgttgtttatttaataagtaactccacatgggggcagagtagcatattgcatgtgaaatgggcttgtttccacctcttgttctgctattaccttgttccatgcccagccctggactcctgagatggaatggtcagtaccttgcctcaaagcacctttaaaccactagagcgatgacaaggaggtcacagacccaaagatcccacagctgtacaggtctgatgggcagccctgctgcctttaggcaggagaccccaagggagggagggctagtccagtgggccagggaaagggagccaggtgctgtcagggtcaaagtcagcagtggcttggttcgctccttaaattaggaagggtgaatgtcctgtttatatttggttaaaccctgaaagagggtctgagcatctcagggcagagctacttgtgaggagacagacgtttcattaataatgagtagggatgtaagtctcaggctgtatgcagagtggaggaagggaggtgggtagagaagggagctgcagtgatttgcactcaagcagaccagtgtgcctgtgccggctccagatgacagagggtgctacgtggccgccgtctgcacagcaagggtgagagggcttgggagaggccagcagagaagggacagtggggtgggggagtgcatcaaactggagagaggaaggggtgagtagggctggggcaggaaggccagtgtgtggtgctgggtggcttacactcaccctcccagtcctgcggagcgagagactttctcctttctccagcccagctcctatgctgatggctgcaggatgggtgagagcgcttcttaggtgtgtttgcaggaataaccggcacatgcccccttgcagccgctcacaaagctctccagctggtttcgaccttaacctgatttggggtctcttttgctcaacacagctgggttggtgggaaaagcccatcatggtggctgccgtggacttgtataatccatgcttcatggtatggtgggcccttgcagtagccttatttcataggtgggtaaactgaggcataggctggccaaaacatttggggcaagtcacgcaactggcaaggactctggctcagatcctgctgccccaaccactcagtcctaactgcggtaccataggctgtgctagcaggaggatctgcattggttcacttcggtagctttaatagcatcaaggcagccatcctgacccagcaaagggccaggcagggacttggagtgtccccgctggtcccataaatagaagcagaactgatatagttggttttgctatgggctccccatccggtaaatccacctcctcaacgagcctcatagtttcagtaaggacgaaaatgaggccaggtagaaatcctgcctaccgataccctggagcctcagaagtcttagcagaaatggaggggcgcaggaagatggtcattacattaaggggtttaaaaaataagcacaagacattccagtagctttcttttgagatgacagattaggaatactgtgttttgcaggataaaagcatgcatttgttccatatcttggttggttacaggccagcagggcaggcaggaggagggaatagagaggtgaccatgagacagaagggcaaaaattaaaaagacaggcaaagaggcaaagacacagggcggggcgtggggtgcaagtcacctgctcaggaagaagatggatgtggggagacacacacagtcctttgggatggagcaccataaaaccaaatggcagtgttccaaggaaggaaacaagcaaaacactttctctaggcctcttgctacaaacactcatttcagggaatcccagaaaatcactaaaatatacctttcaactttatgcaaatttaccagatccactgtttgccagaatcctaagaggaaaaagtcaaaatccttttccgacctgagccttcttctttttttgttttttctcaaaaagtacaagcttctacatttgaaaaagggcaatatttttagaactcattagatgaaagtgttttaattctcatctacagtctggccttatagttattttttgaaatctcctctgttcctcatttttcacatttgccccattctggggagggaggcctggcctttttaccctgtggggacagtcactggaagtgagcttcctgtctttagccacagacaactccagagtggaactcagcagggagttggccgccccgcactccagcatgagtccttctgtcctgtcctgaaaggggtaaagagaaacttggtagcaccgcagcttccactacggggtgccgctcacagaaggcggaggtggagggagggaatggcctcttcccccagggtgtcttctttcgctccatcactgttgaggtgggatggggctggttttggcactagagtgcttacgatcagaataagccccttattcagaataagaagagcttggttactgggtaaggaggggactgtgggcctcctatgttcatctgagacctattcaccggggcagggagggactcctcatctggctctgattatccctacaattaagtttgctggtgttggtggggatggctttggggccacccaggcccctgcatctccagcccttggtgggtgatgtcaggcaggtgaagaaagggcacagcctttgctctcagacagagctgggaatgatcccacagggtgaccctgaacaagtttatcaaccttcctgagcctcagtttcctcacctgtaaagtggagctaatatgtgcctcgagtaatgcaggattaaaggagaagatgtagtaggtccgcagtcgtggaggcagcctgctggtcagcatgaagacaaaggctgctgctgaagacccactgccttctcttgtgtgaagatgagctgctcccctggttaaggcagagtggcaaggaagctcagaccaaatgcatttgtgcagtggaagagaagcaacatggaaggagccgcggcttccagtgacctggcctgtggcccagggagctgcagatggaggctccgtgagctggagcccacaccctcccaccacccatgagccacacagggaaagcctgctaggtgactgctctcctctggcctctccctgctcctacctgttccccacaggggatccccccaaaatgacgatctaatcaagttgtccctctgcttatggtgtccaaagccccacagcacccaggcctggccacctttgcagccttaccccgtgcccgtctccagccaggaagacgggatccttgccgcaggccacagccacatagccacgggcctcggaccctggatctgtggctctctcctccgagactgcgcttcctttcctttcctgacttgtggacacctacacgatgttcagtgtttgctcaaatgtgccctctgacctccactagactgcgcttaggcatctggagcgcagcagtcagtctcatcctggggtgcatcccagggctcagcctgggacctcagcatggggctgagcaggacggaagctgtagatggatgcgctgcgtttgcggtggagagccggctgcatgggaatcactgctggctggacccgggtgcctggctcgatgggagcttcctaagggaagcagccctgtcatgttcctctttgtctctctctcctgccccagctcagcctgcacggagcaggtgctcaacagatgagcaccccatcaatgatggaagggtaagaagagacgcctgcatcaggtgggagttaggtggggaaaacaaagcttccagaggggatactttgggaggcgcagatctaggacacattgataagcatggagtgtcaactatgttccaaaagcttcctgatggccctattgttactccatcttggattcctgggtcaattttgggagatgctgagatctgtagtccataagggcattgctggatgcagatgtgtgaatcaccataagtttggacccaggacagctggtgtcccctggctttcctgagaccttggacgtgccccttcccctctgcattccccactctccaccttccaccacccctttctcaggggcccatcagctaggcctagcagcccttggatccttaatcacctctgttcttttgctggctctctctgaggcttccctttcagctttgatgagcaactcacttgccatggaaagtgtgttgttcatggcggatcctctatcaaaaaacaggatggtgtcgagttgcagtgggtgcgctgggatcagtccgggttaaaatacgtgggtctcagctcagatctccatccctggcactgtgcaggaatctgggcgtgttagtgctgcatacgttggggaaaatgagacgtgttgcttggaagcagcccatgagctgcttcgaggagtgaacggggtgaggtgtccagtgttgctttgaagtgaaatgttttggatgtgccttaaagtcacagttagctcccatgatgggcattcgtgtttgtggccagaggcatacataatccaaatctggtgtataattgagaatattatttgcatttggctttggaatgcattgtgtgtgtgtgtgtgtgtgtgtgtgtgtggcgggggcgggggaggcaaggcagctttactttctgtgtatgtttattttagactcccattagcattaatttgcattcactggacacagccgctagggagaggtgagcagagctttctccccatgaagtattcttcagcctggccctgtccgtgagccaggttattggaaatagaccatgtaggcctgtgttccacgggtgctcagaaaagaccatgtaggcctgtgttccacgggtgctcagaaatcctgggggctgagatacaacctcagtgaacaagccactgggccagggatgcagagctgtgtttgtggtgagacctgggagcgactcctggactcccggttccaggctgcatggccttggatacgttaattagttatttgagcctgtgtcttcgtcataaaataagagggataataattctgtgaaggttaggagaagttccatgggatggcatttgtgacgtccccagaacagggctcagtgaatgctcattccttttcttgtctctcctccctcctcgtctcccaaagaatgggtctgccttcttcatctcttgcgagtctgggactccaagggccgagcagagccggcagtagcatttggagtcaaataggaagacgccactgcttccttctggagtgcaaggtcaggcagggatgctcatttgctcttaagggtgcagggggtccacaaatgcctgaggatccacagcccacctgcacgaggagggggcgtttggagggtggaggagagcctgttgtctctttggagaatggggcagggctctgtctggattttgggtccatcccgtagtggaaaggggtcctatgtgaacagaagggagggcttcagataatcctgaaaccggaatcccaaagacaagccctgagtctccaggccaccactttctacctgcgtggactctggcgagttgcacctccccgggcgtcagcgtctgcatctgaaagtgggcatggcggtgaaaccacctgagggtcaggaaggctgagtgaaggccagaagcctgtgagcctgaaactctgctcaggtgtccgaatgtaatgtgagcccaaggagggcgggcgcgtgctggctctgagcgggtgctttattgtgtgatgggtggggacacttgctctcagggggaaagaaagcgccctctcttcctgcagggctggctgagaactaattcaaggccatgtgactctggctaaagcctgcatcctggttctctgctcccatctgggccagactgttggactccagtgttgtctgtcccccgagtcgaggtctggggcaggtaaggaggccatatcaggaacacctgcccatgtctgtccccagagagaagacccaggagttcaagcatggtgcagagaagttgagcaacatgcccaaagcagccaagattaccgtttctttgtgctccccacacacagatttggatgtttttctttttttcttttttctttttttttatatttatacggagtcttgctctgtcacccaagctggagttcagtggcatgatctcggctcactgcaacctccacctcccaggttcaagcgattctcctgcctcagctgcctgagtagctgggactacaggcgcgcaccaccatgcctggctaatttttgtatttttagtagagatggggtttcaccatgttggccaggctggtctcgaactccagacctcaagtgatcctcccgcatcagcttcccaaagtgctaggattacaggtgtgagccaccacgcctgggagatttggagtattgatagagggatttcagaatctggacttttattgtctcacttcccttcagtgagccaaagggccccatccttgcttacctcagtttcctccgggcttataaaatggacaaaaggataagttgcagagggccaccgaggaactgggaggatgatctatagacagtctcctcttcactgaaaggggaagatgggctcaggctgcagcgtgagggagtgaggttagacatctggaagaactgttgttggagacacagctggggaagggaggtcaggcctctttttcccaagcctgttcccctacccccgatgagggatgaggtggatgtgacaaggtgacatgaccctaaggcagggggatggacctggtggctctgcaaagcccctctcagcccctgtccactcaagtacttcctcattagttttgctgaagttacttccctgctcccagttagcccctgtccgtccagttctgagaggtgtttctatctgtaggggccgaggggctaggggagcatggggctggagtgggaaggaggaggaggagggatgaggctgccaattgccaccgccacacagcaagcgtcacctcagctgttggaggggaacagccaccaggccatttttatgacttcctatcaaactttgataaattgactctgaaagggccttttcttccaagcagttcatgcctcagtgactgttaatggtgaaatatcaagatgctgagggggctctgagctggaccgtgcagggaggactggcttcttacctgccccgagacccagctctttcctcctcttggatgctctggagagggagggggcaggactagatagagacctccaggcagatggcaaggttggtctccagaaaagacagaccaggggatgagggtggaggaattaagttagacatgccgcagaacttcctggccgtgggctgagtgacccaaaaggccgtagaacagcctcggtgctgcggctaactgacagggggcaggaattggcactgcttgttgcacagcaatttccctgcagggattgacgtggagcgtcacaaagacagtgaggtaggcagtgaggtaggcagagtagcaacctgcctctatctcatggcctctcagggcaggcagcagccctcctggactcaggaggaaagggctcagtggggaccacaggcattgagcccaatgcctctcaggcatcatgcaatgagaattggagctgggctgggcgcggtggctcatgcctgtaatcctagcactttgggaggccgagacgggtggatcacgaggccaggagattgagaccatcctggctaacacggtgaaaccccatctctactaaagatacaaaaaattagccgggcacagtggctcacgcctgtaatcctagcactttgggaggctgaggcggatggatcacgaggtcaggagatcgagaccaccctggctaacacggtgaaaccccacctctactaaaaatacaaaaaactagccgggtgtggtggtgggtgcctgtagtcccagctacttgggaggctgaggcaggagaatggcgtgaacccaggaggcggagcttgcagtgagctgagatcgcgccaccgcactccagcctgggcgacagagcaagactctgtctcaaaaaaaaaaaaaaaaaaaaagagagaattggagctgaacctgaacttcaagtccagagaggtttccctacagcccccctcacccacagcagcctgcatcttctactctgcccccagctggccccgcctgggcaaacacatggtgacagggcagtcgctggcccagagctgcttcattcctacttctcccttccttcaaggctggttctgggtcccggaaccatcctttcctggttcaggctgggtgcaggccgtccagcaccacctctctgactcaaggctggaattagtggggaggtgagtgaggctcttgtctcgggcacaaactttaagggtgtactcaaaaccccagtaatggaaataaataatatcttaatgcaaattaaacaaatcagaatgaatgtaaaaatatccacgatgaggaaaatatcacaattttaagtaaagacaggattagggagctgcagttaattaagaattgtttaagatggtcacttggtcaagagaaatggtcaaaatgccaattctctcagtcgaaaatgagataagcaaagaagtagatgattactattactggtgagttattttccattacagccaggaaagtaaaatgaaatacattctgtttttgctgtaaataaaatatttaagtgtaacataatgttggggattttaatacacctgcttttaaatgtttcaatatttttccaactacttcaatgttctggaaaaaatttaccacttaaagaatactttaaaaatataaatgaggtgcacgttttccctcttgctgcagggtctattgtgacttggcttggtgctgttgctgatcctatctttgtctaatattttgatattttgcttatcatggattttttcacattcatttggatttttaaaaatattgctttaaaatattatttgtctagattattgattctttgggtaccctttacattttgtgcctgagaatgatgcctcactctgaacttagttttattctgttcccagagagggaagctgcctctctatcctgtccttggtggggataaaatggaaaaggatccctcctcgggccctgggacccacctggggcatgttcaggcctgaaactgttttggggcggtgagcgctaggacaggcgcaggctgccaaggaaagatggatgggctcccgaggcccacagacagagacgggcagccactaccgagctcatccatcgggacccctgtgggatgacactcaccttaatcaggccacaagggccccgggcctgagggatgcgggtggcgtgggacggggagaagcgggtgagcagacgctcctgtaggctctaagttggtgtctggagaggagtgagaggttcaaccagggtggctaggctgtgcactggccaattccagtgggcactgagcacttagctggcccctcttaggccctgacctccaggcaagtcccaaggtctgttgctcggaccctgggctgtgctgtgtgtggggaaggactagcaggaagggaggagacagatggaggaggacacttagggcagggcctgcaaactggctcttccttgcctttcaggaactcccagtggctttcccttgtttgcagagtgcagtgtgacccatcagcttgacttccgggccctctgtaccctggcccaagcctctcttgccctctgagccccagagatcctctacatgaacctccctctctgcgccctacctccagcaccctctgacctccctgcctgaccccaggtggttctgctttctccccaaagcctccctcgactgtctgtgttcctcgtctccgctcatccttgctggccgggtttctggttgtggctgttgtgtgtgtggacgtgttgctaggaatgagggcctgagttattgtttatacctggccttcctcctccgggtctagcgccaccccagcagcagatgcctcaggaaggaagcgaccctgttgtgtcctccctgctgtgacaccaggtataagcagaaacttatggtcacagtcaggaccatggaggaggaggggcactcagagattcacctgccctctctgagcccatgtgggcactccctgcccttctcaccgctctccttgtaaaaggcagtgctgtgcagcagcctgaggatcaggacactgggactctagtcctgacactcagcaaatggcaactgcatgctaccaggagctcaggccaaacaccttgggattgtccttgacttgccctttctctcgtatcctaattgctgtgggctccacctttgaaacatgcacagatcatcctttctcagtatctgcactgctactaccccagcgctccagcccctagctgtttgcatctgcatagcccaggcaacagacatgtgaccccagcccctcctatgtctgattgcagagatccagaaccattcagctaagccaggctcagtttcttgacctgcagaaactgtgagagctaagaaatgattcctgtaattttaagccactgagcttggaggtgatttgttatgcagaaattgacaaccagacagattttgcagaactagccagtcaactttcaaaggtactttgtgctcggaacattgagaggcactgtgctgtttgcaaaatgctttctatacacgttcatctttctctttaccagaaccctgaacactggtaaggcaggcattcttagtcctcactttatagatgaagaaactgagggtcagagaggctaagtgatttggacaagggtacacagctgaaaaatgaaagggccagtcttagggcctaggaattcccatgataagttcagtgccttccctgccaccccatggctgccatttcttctcactcccttcacaaatgagaacccaaggtgttggccaagtttggagggaggggtgggtgtgatggaggcaaagggaaggaagaccacatccacagggtcttgggaggtggggtggagggacattcctggagaaggaggctaagtctggggtaggtgtcaagagactgagggctactcttggcttcttgtatctgccaaaacccaaacagaagcgctcagaaatgttggagggcctgcgtgcgaactcaaggcctgaggctgtaggcagggagtcagggctggggaagctgggctcagccaggggactgagacataggtcacaaatctaggagacttctctctggggcctctggaagctggggccagttctccagtgcctcaatgtcccggaattgcttcttggaggccaatgagagtgggcagaactgagcaatggaggaggaggcccacccttgctgtagggaaatggccaaggaaatgcaccccagcctgggaatcctgtcagggagtggggtccagtgcttagccagagcagctgcatacaggaccacacgtgacacagaggcatgtgaggctctgcatgtgcctgggcttaaagcctgcttggctgtgtgtgtgtgtgtgtgtgtgacagagagagagcgagagagtgtgagagtgtgcatgtgtaagagagtgtgtgagagtgtgagtgtgtgtgagtgtgagtgtgtgagagtgagtgtgtgtgagacagtgtgagtgtgtgcgtgacagtgtgagtgtctgtgtgacagggtgtgtgtgtgagagagagagagagcgagagagagtaagacagagagagagagactcccttttccccaaaatgtcaccaaggggggtcattttctgtgtgcctgccatctctgttcccagtcaccagcatattgcaagtcaaagggaggcctttccggtaatttgagcatttccaacaaataactctggtctcccagtgcaccagcctacagtggccgcagggccacaacgcactcttcccagagctgctagagctcacctctgctcttcagctcagattctagttggcatctgttatcacagggaactctctctggatggagatgctcaagctcagagaagtgagcaaactctcttctggttgcacagcgggctctcagccttcccacttctggtaagctgcttgaactgagaagtcactgatttttctcaccagatgaagaagccacgccagtgcacatggatgcatgcctactaatgttcagccccacctccaggtgctctcttggggagggaggggcccctataccggtcctgggtgggagtttagtgtagctcctccttcagtcaccaagcactttctctgtgccaagcctgggcctgagcctggagattccaagaggattaagccatggtctctgatccccagagagtttgtgggcccccgtggaatacacacagccccttcctaaccttcctaggccctgcagataagtgagtcaggcatctggctcagtaaaaagtgtcttctccattttatggacaaggaagcagaggctcagagagggtaaatgacttgccccaaatcacacagccagtaagcctgcttagtagctctactgcatcacactggtctggaccaagctgattgagtgaaagggggcagagttggggtggccatcaaacccctaaaacccgaggaggggaagagaggggtagcacaaaagaggatttactttcttcccccaaaatgatgtcatcagctaagacaaaaagaaaaagaaaacgcccattttctcactccaagtttccccctcattaattttaatctaatttgctcataacattcctcagtaaacagcagcctctctttaataagccaggctcttccccccgaccctgcgattgtgttcctaatcagccagtgtatcaggaaagacctgctgctaattgtcgctaggcatcacactatcctgtctgtcaggtaaggggtggcagcgagagataattataatcagatctaattagtaattataaaagatcccgactagaaattgttttcagttaaatattcccagagaggtgctaatggtctccggggcatgccaagtgtcacagccaggaggggaaggggcccgtgacctggcaccctgtgacgacaagcagaggagactcagtgatgagaggaatggtgtgtccatggggacagagctggcctggcgtcccagtatcctgcttcctgggaggagcaccttcccttctgcacctaaggttgagtccccctcccacaggagcacctgcgtgggccctcagtaaatgccagttcttcacaggctcaggacctcgacgcacggaaacttctggatcattaaagaagctgtgtgggccaggtgcagtgggtccgcctgtaatcccagcactttgggaggtggaggcgggtggatcacctgaggtcatgagtttgagaccagcttgggcaacatggccagcatttaatgcaaaaattagccaggtgtggtggcacatgcctgtaatcccagctactcggaggcagaggcatgagaatcacctgaacctgggagacggaagttgcagtgagccgagattgtgccactgcaccccagcctggacaacagagcaagactccgtttcaaaaaaaaaaaaaaaagctgtgcgttgctcaggcagcatgggatatttctgctggaatcgtcattgcattgaatgggattaaaggctttacctaggagtcccctggctaacgaaaatccattgggtgactctccgccccactttagtgcctcctgcctcgggacttcccctttctttttcatcgttagtaagcatctgcaaactcccggttgccctacttactttctgttaacaggacctaactacccaacacttccctgccttcagattcacgccccataccctgcatggttctgttcctgggaccctcggatcaggcgatgagctctcttaaacacctaggacggctccacactgcccacagccaaattcagatgctccagcgtggctcaaagccctttccactgagccccaacctgttgactgggctgacatccgactacacttgctcaagcattgcacgccaaacatcccaaacgctcacgttagggagtgggggcagggtgggcgtctatctttctgtgcctttgattttgttgctatgattacgttttcattttccagctgctaaaatcctacccattctaccaagggagagttcggtagttactgaagtcttgttactgaagtcttgtgaagtcatcccagattttctgagttgaaatgaacacttcctcagtattgtgcttatatattcgagggcttcttttatcctgcctgggatggtagtgagttgtttatgtcttctccctcctttggcagtaaactccttgagggcacagagggcattttgctatttctgcatcttcccattgggtctgatacaatgcttttgcacatcgtaagcatttaataaagatgtgaaggataaacgagtgaatgtattaatgggaagcttctacccactgactgcactatgatttcaatgtaaatgcttctgggaagccgacctctagttccccaggtccagatccttgaacctgtctttattattagatgctgttgggttgtcggagtacgattaggtggaatttggccagtagttgcaggaatctcagcctccccaaagccacctgatgtgaggctagcgtgactgactgaggagctgtatttttagtcttatttaacttgaattaatttaaatttaaatagccactgtggctagtggcttggtgcatctcagctgagagaccttggagccaccactatgtagggcagcctggagagtccagactcaaagcctgcttggtgtctggtgagcctggctacaagcgactcacattaatttagttgaaaaacaggatgtggctggacacagtggctcatgcctgtaatcccagcacttcgggaggccgaggcgagtggatcacttgagatcaggaattcgagaccagcctgaccaacatggtgaaaccccgtctctacaaaaagtacaaaaattagctgggcgtggtggcgggcacctgtaatcccagctacttgggaggctgaggtaagataattgcttgaacccaggaggcagaggttgcagtgagctgagatcgcaccactgcactatagcctgggcaacagagtgagactttaactcaaaaaaaaaaaaaaagaaaaagaaaagaaaaacagtatatattttcactgcattcttatttttttcagtgctgataccagatcagcatactcataactctgttaaccagaatgggagactaagtggggaaatgccacgctctgaccatgtgaggagttcaagtataatttacttcattcacagcttcttgaatggctgctgctggtctgttgcatttgtccacctgtttgcatctgcatgcggatcccaaatgtcagcctttccccttctgacgccctccacccgctgccgagacatctccgtgtagctttcctggctctgcctctcccagcctcctcctctgggtttcatttccttgctgtgagccttgtgcgaggcaggatatctccagtgcaaggacactactggtggacagctggtccgtcccacacttttctctgcacgtctgaggagtccaggaggactggctgaggctgcaggcaggaagctcagttgggtgaacccaggcaaacccaggagtcagcctggctctggccctagcttgaacgcctcggttgtagttctaaagcctattcatttcctccatgttcacatctttaagaggggaagacggggctgcagagggagaggagccagcttggggcctggggtgcagtcttagagactaaggaggctcctctggggagcgagggtgcccaggtggggaaggcagagcgcaggtcgagcagattctaccgcagcccgtcctgggtcctgttgatgtgctacacattgcagggagcattttcatcccaggcggtgcgtgacaaagctaggatttgaacccaggctgttcaactccaagttctgggctctttaaaatagggcagttattagcagggaaggaacacactgcccactcatctatgacaaatcaattaatttgtccaaattccactcatgctttcaaactcacttaaaccctccttaaagcctacacttgccaactcgcctggccctgggcactgcttgcctctgcctgcctttgcctccttttcccgcttctgttcctagttcaacccccacccacattgtgagctccctgaaggcaggtccatgtctggggtgggccaggtgaggggtggaaaacatcgataccagtgacttacatgcacccaggtgccaaggtaagcacggacgagtggggactggtgggccacatcccgcccaagggagcagccattacataattgtttgcaagcaggcaaacaggcataaactgaccaggtctttgtaagagaagccagaaatcagaatttttttttaatataaaaccccccagaatcttaaacatggataatgaatgtaaaaaactctacagatactccggaagctaaccggatccatccatgtgcctgccctggcctccccttaattgtcagctgctgcatatgaatccaggttcagccattcaaaagttctctgcccacttgaaaagggtctcaccttgggcagatctcatgctgcctagcacaggggatgcatccactcaccgcactggaccagcacaccagctagggaagcacagtttgagagctcctgggacctgtcctggctgtgctgcccacagcccctcctccactcctcctggcaagaggaaacaggacagctcctcctgcccaggcacagtcagaagaagctgtcccttctgggcaggcacacctcagagggaaagcaattcaattaagccctggttcacagcgagtgctaaaaacctccctctggagaaccattttctgctatagatttttaagaccagcagctggagaatcactcttcctttttctcttttggtgctgtgtctctctagtcaataaataagtgggaaataaagtatttgcaagaaaatagaatgcagtcgaaaggtaaattgtggacttaaaagcccctaagagactggcgcagacttggaaatgtttcctagtttgacacctcttgcttctctaagcccagcttctggctctccgatttgcatctccaaaaggtgatctttaaaactgatttccttcagttgcatttcattggtgtagaaactaagcaggctgttgcattacagtaataacatcaacatttcacctgccttcgccttaattatttttctctcttgcgatggaatccatttaataagatttacaggtggcaaggaggtggggtgagctggtgtgcggctcagataatcggccaagctgatttctccctcattgggtgtcaccagtataaaaacatgaactaaaagctttgcagcgcttaagtaataataatgtcagcatttcacctgcctccccttgattatttttcctccctcgttcttgccacctgaacctgtttagataagattgccacacagatagaaaccaagggctctcattctcttagataagctgctgtttttctatggtttggtgtgaaaagggagtgttgctggcagaaaggctctgtctcagatcttcctggtggggggcgtccgagcctgtggatcctgggtggaccaaaggcagcaatggagtagggggcaggtggctgttaaggtggatgtgggcactcgggtaggtaccctggcctgggagcagaggaggaaccatctctaaacatctgctctctcccctagatgcccctaggggatccaggcagggacgaatgggtttcatttgttgagggggaggggttctgattatgcagcactaggcaagtctccagtgtggtataaaaaacatttgggtagccctagctttacaactagttagctgggtggccatggggaaggaacccaacccttctgagccatagtttcctaaaaacaaagaggtggtttgctgtggactgaatgtttgtgatggcctccggctgcagttaatatattgcaactctaacctccattgtgatgatgtgggaggtaattagggttagatactgggaggtaattaagctcatcagggtggaaccctcctgatggaattagtgcccttgaaagaggaagagagagaatctccctctccctctttccctccctctccttctctctctgtctctctctctccttccttccttccctctctctctttctccctttatctccctcttcctctttctccctctccctctttctcccatgctggaacccttaactcaaacttccaggctccagacacagtctggagaaataaatgcttgttgtttaagccacccagtctatagtatttgttatagcagcctgagctaagacattggtctggattatcttaaattttaaactttaaacttttggggacttactgaatgactcctttgagaatgtgaaaccactccccagaaatgtgcacatatattctgaatattgcgtccaagctttgtagggataaaaggccccacaccaaaaaccttggcatcatctgtgacccctctctttctctcatagtaactgtccactatctctgctgctgctattccagcctgagtccctcatctcttctctgtattactgcaagagcctcttaacagaggctcttgtcttcccttgtcctcttatggtctcttctcaacctagcagccagggtgagtcttttaaaatatcactcagatcccatcgatcctctattgagaacccttccatgagtgattttctcttcaaatagaaatttggctctaagatccacagctgacttcgtcacttctatgagtctttgtttacacaaagtcagcttctagaggaaaaatatgaattgacctatatcaagtaaagagattggactaataaaaatcttcccataaagaaagccctagacccagatggcatcattggtgaattctatcaaataatatcaatcctttgtgaaatcttctagaaaatagaggaggaataaacacttccctactcatcctacaaaaccagtgttacctgatactaaagccagacagacataataagaaaagagaactatagactattgtccatcatgaatttagataaaaaccctttaagatattagcaaactgaatccagcaacatataaaaaaagattatatgccatgaccacatgggatttttatcccaggaattcaaggttggcttaacatctgaaaatcaattactgtaatacactatattaatagagtaataaataaaactatattatcatctcaatagatgcagaaaaaaacatttcacaaaacccaacacgatgtgtagtaaaaactctcaacaaagtaggaacagatgaaaacttcctcaacctgatataggtcaccagtgaaacattttctgctaacattatactttaaaatagtgaaagattggatgctttcccctaagattggaaacaaagccagaatgtctgctctcaccatttctattcagcattgtactgtaagttctagccagtgcaataagacaaaaatgcattaggttggaaaagacaaagtaaaactatctttcttcacagacaaaatgctcctgtatgcagaaaatcttaaatttacaaataactattaggtttaaaaaatgtgtttatcagccaggcacagtggctcacacttgtaattccagcactctgggaggctgaggccggtggatcacttgaggccaggagttcgagaccagcctggccaacatggtgaaaccccatttctactaaaaatatgaaaaattagccaggcgtggtggtggatgcctgtaatcccagctactcaggaggctgaggcagaagaattgcttgaacccaggaggcagaagttgcagtgagctgagattgtgccattgcacttcagcctgggcaacaagagtgtaactccatctctttaaaaaaaaatgagtttagcaagatccaacagtcatacacaaaaattaattgtgtgtatatatagatacaccatctatatataatcttagcaatgaacaatccaaaaatgaaattaagaaaatttcattcacagtagcatcaaaaataataaaatgcttagggataaatttatcaaaggaagtacaagatgtacactgagaactagaaaacactgctgagaaaaattgaagacgtaaaaaaataaagaggcattccatgttcatggatgggaatactcaatattgttaaggtggcaattaattctaaattgatctatagctttcacgcaattcctatcaaaattccagcaaccatttttttgcagatgttgacagactagtcctaaaattcatatgaaaatgcaaaggacctaaaatagctggaaccattttgaaattcactgtgggaaaggatagtctttttaaacaaatgatgtcggaacaattggatatctgtatgcaaaaatgaatttagggccttcacaaatcactaaaacttaaaatgcaccaagattaaatataaaaactaaacttgtaaaacttatgggagaaaatacagtagtaaatctttgtgacctttgattaggcagagttcttagagacaatatcaaaaacacaatctataagaaaaaattatcaaactgaacttgattaaaattaaaagtttttgtgcttcataagacaccattaagtaaacgaaaaggcaaactacaaactgagagaaaatatttgcaagtcgtatatctggtaaaggacttgtatcctggctataaagaactcctataacatagtaagacaaatgattctatttaaaaataggcaaaatatttgaatagacattttaccaaagaagatacacaaatggataattatcacatcaaaacatgctcaacatccttattcattaggggaatgcaaattaaaaccataatggataccacttgaaacctgtaacagtgttggcaaggatgtagagaaactggaatgctcatttattgctggtgggaatggatacagccactttggaaaacagcatggcagtttcttaacaagttgagcataaactttccatattatgtagccattccactactaggaatctactcatgaaaagtgaaaacatatagccacacacagacttgtttgtgaatgttcatagcaacaattttttttttttgtttttggtatttttagtagagattggattttgccatgttggccaaactggtcttgaactcctggcctcaagtgatccacgtgtctcagcctcccagagtgctgggattacaggtgtaaaccaccacacctggccagcagcattctttataatagccccaaactggaaacaatccgactgtctgccgactggcgaatggataaacagaatgtggtatatccatataatggaatactattcagcaataaaaagaagtgaactacagatacatgctacaatacagacaaatctcaaacacatttttccaagagaaaggggctagacacacaaggccacatatgatatgattctactcataccatatatccagaaaagccaaatccaagaagcactgcattggttgcctgagactgggtgggagtgaggattgacaagggatcgttttagggtgatgaaaatgttctaatactggattgtgggggtggttgcacaactctataaatttattaaaaataattgagttgtacacttaaaatggatgaatttaatgataatgtagagtttacccaaataaagctgttaaaaaataaggggaaagaaaaaggccacttccccatgaggtctattccaacctctcaacacctcctttccctaggaaacccaacccctcacactctgctctactttttttgaatagcattgatcaccttctaatacactataaagttttcttgttatgtttttcgtctaactccctccgctacaatatggttcgcggaggtaggagtttcaagtctgttttcatcgctaatgtatattctcagggtctagaacagtacctggcatgtggaaggcacatatacagatgctgaaagatgaaatgaatgaagaattctggattaaagggctccttcatctctaaaattatctaatcaaaggtttttgagggtctttctggcatcttcttgtgtttcttagcagacctgttgcccaggccatgttggcattttgggctgaacctggacgtgagacggggaagtcccgggggaccctggctagggctcagcgttgtctggaagagtaagaggaccagctctcccttgcccatgcctcgtgctgcctctagctatttcctttgttgaccttagttgacgcatctttaaaatgagttctctccagcagcctagtgacttcgtttgtgtgcgacaaaggggaagggagcagtgggattgggggtagggcagagatagtccttcctggggggtggctgtgtggccatcagccttctcctccctttcttgcctgcaccactgaagctgctgggtgatctctcagctgctaacattgtttctgacatattttcacatgaaaacctcttcctttatataaacatttataaacacctggatcgacttgtgaaagtgtgacacattttttggaagccagttttttcgggttgtgggactcagctatttatttttgtgagatggaggcttctgggtgcctatgaacctcccccttggaaaaacctccttcacacggacagaacaatttagaggctcagagtgatggagaaagacgcggcaggtggccgcccagaggatgatactgaatgggatggcaaatgaatgctgcgggtctcggggctccccaggtccatctgaggaggaggggctgccaggaagggtttttggaagccttgggtttgctcttcgagccgactccccgattccatgagccctgggatggtggaagggttcaagcagggctcctggagttcccaggggctaggaagaaacctgtttcatagtgatgattttagggggagtcaggcagcagagagagtggagtttggaaaagaggaggggcataattgagcataaagggccagggtttcagagccagaagcgactgcattcagattctcgttctttacctttcttgtgtgtgaccttgggcaaggtaatgagcctctatgtctcagcttcctcgtccgtaaaaggggacacgggacctgcctggcagagctggtcagagggcagatgaaggcatgcgagtgggttcctcagcacagtgcctgtcatagagtggcagctcaccagcgtcacccttgcccttctctcttctctccactcgagcaactcacaagctgccctttctgtgcatagaaggtgtggctgaacttagatctcctcatccctgcctagtggggcacatgcagggtgcagctcccggagtctgggaccatcaggacctctgaatgggggctttgaagctgtgtccagtccctgtctttcctagtacctatcagaacttctcatgagtgaaagccagtctcctaggcatgagcatcttatctctgatgaaccccccagctttttgctctgacatcatgccaccgtttctcatcatttcatgggatataccttctgctcctgctggggaccctcactcacaagccctgttctgcctggactgattctcaccttgctctttcacccaggtgaactctcagtcttggaatgccctcacccctccttcatactcaatcacgtctctgccaccctccaagcttggcttcaggtggagttcctccaggaaggtagctgtgttgaacactcactgcctgaccttttcacgttctgtccaaactctgagacattattttagctggtatgtaggtcatgaggttgacattaggaagaacatatcaggttctccatcctcttttttcctttttttccccagccattctgtgtgtgttcataaatgtgacattcccatgatggacccagattttgccagcagtttgcagaatggtaaagttttgaattaaagtcaacagcttccaactatctgtcactttcctgccttgtggcatcctgccaccacagaggcaccaacatatctcagcactcaaattgggcccagcgtggtagctcacacttgtaatcccagcactttgggaggccaaggcgggggaatcacctgaggtcaggagttcaagaccagcctggccagcatggtgaaaccctgtctctactaaaaatacagaaaattagctgggcgtggtggtgcacatctgtaatcccaggagattcgcaggagaatcacttgaacctgggaggcagaggttgcagtgagccgagattgtgccactgcactccagcctggactggacaacagagcaagactccgtctcaaaaaaaaaaaaaaaaaaaaaaaaaaagaaaaaagaaaaaaagaaaaaaaagaaaacacacactgctcaaattgagaactttggatctgggctaatatttcacctggggctgaaattgtctgggcagagcctgcaacaaactgctctggggacagctggataggaaaggaacatccttaaatggttctggctctcttctctctgaatcttcccctctcttgggccagcccatgacttcactcagctccagaactggcagatttgctgccatcatctcatctctggagatgaatctatttccttcctatagaaacagcatgcaagaaaactcagcttctgcttgaatactcccagagacaggaagcttactacttaactgaactctgttagttttaattgttgagataagaaatgtcctccctgacgttgtttccttccttccttccttccttccttccttccttccttccttccttccttttttttgagataggggtctcactgttgaccagacactgcaccctttgcctcttgggtttaggcaatccacctgcctcagcctctcaaagtgctgggattacaggtgtgagccactgtgcccagctaccctggctctgtttccatcctccggagctccagagtaaatctattgtgcttctttagatatttgggagggaccctattcccctacatcttctctctagtgagctgaacctcctcatttttaaaaattgtgtacacagtatctctcttatgtcttttacaggcactgcgtccctgttagacttcagggactttgcactggccatggtgctgaccaatcacaggctgcccaggccaaggattgggtctggtgctgctggagatactgactgctcaactctctctctgctgttgctcctcttcatctactcccatctcccatggcctgagttaaatcatgacagttgtcctggtgcctccagggctagtgcacatagggaagtaaatggctgaaattgggaggagaggaacacacaagggccagtggctgggctccctggagatctgcagtgctgtgtgtgtgtgtgtgtgtgtgtgtgtgttggagcagaacagagagttgttggttgtgcctccatctctagagtctgcagggatgtcaccaggtatgccatgatgaggagtggtttcaagagctacacaggccaggcgcagtggctcacgcctgtagtcccagctacttgggaggctgaggcaagataattgcttgaacctgggaggcagaggttgcagtgagctgagatcacgccactgcactccaggttgggcgacagagggagactccatctcaaagaaaaaaaaaaaagagctatacaaagagtggaccccccaggctgcctggagaggcagtcggtcatgggtccccaaacacctctctccactggacctacaacacaggtcccctcacagcagcaagataacaaagctgtggccattcccactccaaaggcagcaatgcatctttcctctgcaggacactgaccatagctgttagtcttggctcccggctcatgggcattgcgtcttctgcttctgtggtgtcctatcctgccccgaaacagtgggggctcccttaggctctggcccctgccaatcttccaggacctctctttctctccaggcttggcctccgcgagtctgccttgggttgtgtgactttgtccctaaactccctctgaggatgacacccctccgtcaccccactggctgccggggggaaggcttccatttagtggcattttcctttctcatttcatgctgtaatggagattcattgccagttttaaatccataatttgctgtgaaacccttgttttgggcctgggctgaggtcggaacggagaagcggcgggttatttttagccctcagagggctccctgtgcagctgcagctcccctgggcttcccccagggcgggcctcagacagcgtcctgggtttgacacccaggatgcccaggaagctggagctgggacaggggtaaacacacacgtgggactggctggcctgcccctccctcagttggctctggctctgttcctcctccatttcatgagatgagggggaatcagtagagaaacagggcctcatgccgatgagtctgtgcttccattacccccctctttcctgggcctgacaaggagtgagggtcagtacttcaggcctccaagaatgtgtccatttcctaacagtgactgatcccctgaccggatgttcttgtgtctttctatcagggcgacactgatgatttggctctgaggtgtgtgtgttaagtacctgcgtgcaccagcgcatttgtccttgaggcgaagctgtccatgtgtgtatccttatgattggcacataaatggggaatcctgtcaatggccagtggccagcggggcttccagactgaggatcccagtagggcaccaggacagaggtgggctcttgctgtgcttttgcaggcttgtggggatgctgaaagagatacccaggcctgaggagcagccgtatgaggggtaagtgggtgaggggcctcctccaggcagctgccccccgcatgttataggaaggggcttagatttcacttgcagccctggagctgatgattccatgtcaaatggcagacacccgaggatcgaggtcctgacttttgcaaatctccacagtctgagctcactttttgctgagcagttgagcctgctcagcatctcccagggtcacgcttggttccagcagctgaagggtatattatccttgctctcaggaggaagggaagaggaactcagggaacaatgcctctcatgccccaaccccaaaccatgagcaaatgagagagaatcacagtcaacccgtgaagtgggtttaacacttcatctctcctgctactggctccaccatggagagggcgggccctgagagattaagcatcatcagcccctgtctcacagctggatggtggcaggactggggcaggagtgaatgcgtcccagctccccagtgagggccgtttgtcctgcttgggtctggagagtttccaatgccctggggatggtggtgacacactccagaacttcccagggctgccctgaagagcctgtctcttggtgatgggggtgcagccactggggccaggcaacagcaggaggctgaacccctaccataagcagtagaccatgagtgggctcctaagaacctccccagcttcccttgtcctggtgttgggagcaaaagatgctggggggtatgggggctggccctgggcatggtcatttgggaagctacccccagatttcagtggcgagtgggcacttggataggcagtgtcgagcttctgggcccctccagaaatcgctcatggtggcactggctggggtagggtggggctgtgcattccttgcatcaggtcttctccttcttggagaggctcctgcctgcccttctccacactcaggcagggaagggaaaagatgcgctgagtttgcctccatccctgagggatcctctcttcctccgggccttggaagtcgtttaatgcttgagtgtcctgcccccacctcatttcccaacatgagggacgaccccaggctgggggagagttttgacatccagccaggctgtgatgaggatgggagatggagtgggtaaagagacagaggccatgcctgcccatggtaacatgcagattatgggggcagggagattgtggggggcgaccttggagtgcagcaggagggcagggctggggcgacccgcacacctcaactcaatggctgcaagacctccagggagaccttctatctcatctggcccccaacagcaactactcagcgtggcattatggcattgaacccacagggtggacctcagggagctataatataacttagaggtgagagactatatgtcagcctcagatacccttcatggcccccagctctgctcactttatcacctgcccagcaggtgagctccgagttagatgggaggctaaggtggtgtcagtggccaaagggagaaagaggaggggaatctgcttctggcccaggggacatgggggtagtctgggctaccaggaagggagctgggagcgagctggtggcaggggtggggtgtgtgtagggggagcgagatgtacaatagctccgacacagctcccatgtggaacctcaggagataaggatgttttctgctcctgtcttccgtctctggctcgtttgctaccgctatttgggggtgattgcagggtaatgaatgttgcaggaaacagccacatagcacaaatgagatacggcactaagaccaggccagggcccaggcaaaacacgcttaataagcagataaggaaatcaattctgcctttcttcccaggtgtgcagcctgctgggaggggcctgcaggaatcatatcttcctgccttgcttgatacatgggaaagcttctctaggaagcaaagtctgatcccccgggatgcaggggttgcttgttggtgtctcataacattgtgcaataatagcaatgatgaaaacagttataatactagcagccaatgctgctatgccttgctgcataacaggcgctattctgagacatgttttacatatattatttcattaaatcctctcttcaaccccatgaaagcagttatgattatttccctcattttacacagaaagaaacaggcacagagtggttaaataacttgctcacggtcacaccagtggcaaaatgatacagctaggtttcaagtgcgggcaatctggcttccagaggccaggcgcttagccacattgcctctccaacacaacacaacacaacacaacacaacacaacacaacacaacacaacacaacaaaacacaattgtcatccgtgtttggggcttactatctgccagactctgttctctgtcgtcagattcagtgtaaactccccctaaattttccctaagccttgttatttcaattgccatgaggaacatttactgaacacccagtatgtgattctaggctgtgctaggcatgaaggatgaaagatgctcccaggagacccggtgggggaaacagacatgaaaacagttactctcaacatagcgtgtcgagacctgtaatcaaggtgcataaggaggctgggcgcgatggctcacgcctgtaatctcagcattttaggaggctgagttgggtggatcccttgagcccagaagttcaagacaagcattagcaacatggcaaaacccggtctctacaaaaacaaaacagaacaaaacaaaaaaacaaacaaacaaaaattagctgggtgaggtggtgcatgcctgtggtctcagctactcgggaggctgaggtgggaggatcgcttgagccagggaggtcgaggctgcagtgagccataatagtgccactgcacttcagtctggatgacagagcaagaccctgactcaaaaaaaagatgcctaaggaagtgaaaaggaccacagggggacagtcaggccatgtgggctccagagaaggcttcctggaggaggagttgtctgaggtgaatcttgacagctgaacacaagttagccaagggaagaaaggtaggaagggcactccaggaagaaacacagtgtgaatgagggcccagaggcttggtgagcggaaggagatgccagctgcttgttagtgcgggagcaggttggcggtgggtctgaggctggggacacagctgggggctggcctcggggggccttgtgtggcctggcagggagcttgggttttgttctgtggggacactttctcgcccctgaagaacccctcagactgtcacctactgatttgcctttttatgtcagggtgactatggatgggtttcttgcaaccagtttctggaagaatggtttagaagccagcaccctcgaggtctgttccagctctgccttcctttgctggcagactctgagttattcaccactgttctctggacccatctccccagaagattcatggatgggagattgggggaggctgccaacgcggtgggctgaggaggccctgcagctctgctggtagagctgtggcaaagggagcttgtggttttgaaaaacaaactagttaaggacacgtcacagattggaccttatctgttttcctctctcagtatttggggcttgacatcatttaaaaagatgccctctttatttgaattgacttagtctccctcttaaataattcatgttgatttaggaagctttatttctaacgggagccacaagacagcagagttaatattagaacgggccaggaagaagagggaaatgaggagggagactgggaaaaatgcccctcttaataattaatctgatgccaacatcccctcctcccacttctgatccccccatcctgctctactttttcctttccgtagcatttattaccacctcacatcctgtacagcaatgcaatttatggtttaatccgtgcatcacttatcgaccgccttctctctgccagaatgcaagctccaccagggcaaggatggttttctctttcgtttcctgatgaatcccacgtgtctagactagtgcttggcatataacaggtgctcagtaaacatttgttgatcaaatccttggtaccatttcctccctgccctggatgtcccaacaccttgcttcccaagtttccaggaagttgaagagatcaagtgtaatgccacccttacaactctgaccctgggacagtttcaatatttttcaaccctgggattcctgtaggtggaagaaggagcagtctgcatgtatatgtgtacacaactttaaaatacaggcggggtggctcacgcttgtaatcccagcactttgggaggccaagatgggtggatcacttgaggtcaagtgttcgagaccagcctgggcagcatggctaaaaatacaaaaattagccaggcgtggtggcacgtgcctgtaatcccagctactcaggaggctggagcaggaggacccagaaggcggaggttgcggtgagctgagatcgtgcctctgctctccagcctgggcgacagagccaggctccatctcaaaaaacaaaaaacaaaccaaaaaagtgtatgacacttcactgttagagattgagagagagagagagaaagagagagagagagagagagagagagagagagagacagagtgtttaatgtttacaacaattctatgacattggtatttttaaccctctattttatagatgaagaaccagaaacgtcattcattcattcattcacgctggttatagaggcttgagccaaagaggcccagttccagccttaaggaccttgcccaaggtcacccagttagtgagcagcaagagcatattctacttcctggcccagggctcttcctaccccatgacagctctctctgcacatgtgcatgggggtcctctgaagcccaaccaaactgagtcttcggagagggctaggtctatgtggaagctggctacagaggggtggttgggggggatcctttgcagggaggaccagggtttgaggtccacagccaaggccaggaccccagggctgaacaggacttggagaggtcctatctcccagcctcaaagtgggatgctgtttaagccaccctaatcagttttcttctaagcctcggtcactgcgccaatcttggttccagggagggatggcccaatttcctaaaatagttggtacagcatgttggactccttacagtggaagtcatggccttttgggagcgagacagttctcagcgatcatcttatttatcaccacctctcattttacagatgaggaaactgagacccaggttgagaaacagggccactgtcacacagctggacactggtaaaaccaagaccactgcctctaagtctaatgctgtttccgtgacgctgtgattctccagatgttctgcaggtgaaaagacgcctgtcttgaccctgggctgagtcaagccatagtccttggcagctggctgggccacagagggcacgcagcctgaccactgattgacctgacctaaaatccccagtctttgcctctctcagctttgcaaactcaggccttcccccgtctttccctcctcatttcctggctccctccttctgcctcccgaggtacaaatgctcagctccgaagttgctccttgcctgattgcatctgagagctggaaacacaacgctaattaatgtgtctgtgactctaggcttggctgccaggccgagtccccatgccttccctagggcccagcggctctgcgagctggccctctggcttcatctgagcacgctgccggcagatgcatattttaacaatgcacatctgttggctatataatctctcgtatttgccctcctcacttggtacttcgatggaagacccccgggggcctccctctgttctagccaaagtgtttgctttgcaattttgccggaataccatctgattctgctttcgcgtcttccgcaggttctaatcaggctcttactttatttaattaaaaatctatctcaggcaaatacagactaaattaggaagctctctcattcctggaacacagggaaggcagccccccttggggaactggctgggacattttcccgggctgagatgtcacagcaaagcagatggggtcttggtagggaaggcggctgggccaaggagcagaaatacctctctcccatctgtgggaacagccactctctccattccccttccccagaccaggggtccccttccagctggctgggtcagctgctgcactgggggcctccttgcagagcagtaggtggggtgctataccccaggacactcagccaggcggagccctgcaagaccagctgggttggggacctgggagtgtcccagggagtcagcgaggactgcaggcagagtgctgggaagcactgtcttgcctggggttttagtttgctcaggatgaatggttttggtggagctgcctgaaaggctgatggacaagatgctggctgaggctccctttctggctctcaggaatttcacggaggggaccctgctggggatcatggaaacttcctctgccctccttccgctgatctccagacttgaataaaacatctcccccatacaaacccagctctgtgcccagagggcggtgtcaggccatgccaccggagaggaagggggagcgaatgccttttagacatgacctaagacaaaatcgggtctgttcaggttggatcctgaggccctgctctgagaagcctggcccctcaccagccagacagatgagatgctgctggcatctgggaacaggagactaggcaaagagcttggagctgaaaaatctggagttgattttgaaggttaattaagctgtgtcacctcctgtgagtgcctttgcctctctgagtttccattctctcatctgtaaaacattcgaaataatctggacttttaatacgttggacttttttacgtaacgtagagttgagaggaaaggaagtgtaatgatcatgtcaggactggggaagtcaatacagccttaaggatgagatgtggctccacctatttttggttcctgtgaagtcagaggagtggacaatgctcaggttcctgtggttccagcatcctctggcccctctagaaggtgtatgagtcggtagaggcagattcttctgaggatggaggggctgagccatctctgaagatgaggagcctacaacttagcaaatctgttctggcattttgcaatcctcaaaatcagaaacaatatgaggccctaattcctcctcctctcctcccacaacccccacaccacatggcagactcattctcattttagtcaccgtcttgggagaaatgagaacggcgctgctgcctttaataccccaattactcctcggaaggcccgcttcccggccatggaatcccaacttatttacccccgctggaacaggtttattttctcattcctttcatcgcaggcctggggagactcaaaggttgcaggaggtttctgaggctggccccaagtccctcccccgcatctcaagaagtcaagctccgagcttggtaagtggtcctccggggcctgtctgctgcactgcttggaataatctgccctggtgtctttggccatgtagatctgaagataacctgacatgcttttaaatatttcatctctgagcagctgtgtgctttagctgccaggagaggaggcagcaccccagctgctgaccctgttgtcgaaccttcacaacagctgctaaggggtgggcctgggctttcccacttccctcctgcacgcgtgcctggcacagactcacgtgtaagggggcagcgaggtggggcaggtagccctggagccctggccaggagcccatgggccaagctctttgcatctgtgggccttagtatctcatctggggtaacagtccctgtcccaccgagcagcgtcaggaacagcggaggtcatgtgcctgaaagagcctagagagctacggtgaactgcttggcaaatgtgagctctcatgacttatgtgcaaggcctggttctcagcagccttgatcctcggtaacatttggccagaggagggagactcccgggactgaactctaaatcagaactaggcggtttaagaggtcaccgagcccattcccctgtcttcaggcaagatgatccaggaacgctgggctcctgggaacataagatgaagaaagatcaaggggaaaagtatgatttggaataaggacctgaaatgaattttcctaggagggacctgtcagccaggattcccagggagcaatgaggggtggagaagtcacgggggtcactggtgtccacatggatactagaatcatggggagaatcgggctgattctacagagaaggtggaaagatagggctttgttagcaccggagtgggggtcagttcagaaagaagggacccacagcctgtgccacattcttcctggcacggagcctagcctagataacgtgtgcagagcatgctttctgatggaataaataagcatgtaggagccctcattagctgcctaaggcaccatcaaacacgccggggttggactgagtccgctggcattggctgtctggtttactagggaaagagccttcgcttgtcccgtttgggtgggaaggtgggcatggatattgtggaagcagcagtgtctggagccctgtgggatgatccccagaggggagtctccccatgtctgaccaaaaaaataccctcttggagctgagcccttggtgcttcacgcagtgtcccagccccgtgtgcagatggttcttacccaggactgtgaggcgtgcggggcgggagcggatggcggcctggatggcctggcactcgtacaccgcatcgtcttgcagctctgccctcaggatcttcaggtggtgctcccctgacaggtggttccctaccaccaggtactgtgggtaacctgtggagacaacaggcaggtcagggagctggggtggggtggaggggacacccatgacaaagaggcacagaatggaggacccaagcaggggccattctacaaggctggcagagcgggtgattgctcagggctctgatctcagtgcaaggagcacaaatgcaagagctttcccaaggcattgaaggtgttggttctctctctctctctctgtatgtgtgtgtgtgtgtgtgtgtgtgtgtgtgtgtgtgtgtgtgtgtgtgtgtgtgtataagggcatttggtctgtttgttagtttttgagacagggtcttgctctgtcactcagattggagtgtagtggcaggatcatagctcactgcaggctccacttcccagactcaaacgatcctcccacctcagcctcccaagtagctgggactacagacatgcaccaccacgtcggctaatttttttatcttttgtagagatgggatctcactatgtcaccctgactggtcttgaactcctggacttaggcggttctccctcctcaacctcccaaagttctgggattataggcatgagccaccatgcccggccatgtaagggtcttgttggtttcaagtttaggaaaatcggaggagccactgttagaaaggaaagagggagaagagatggaaatgctaagcgtggacagacaccgctggcttattattctggaaagtggtgtgctcagcactgtggtctaccaagcagacatgcattttgataagatagagaggagagagagagagacagacagacagagagacccaggctgagaattacagagagaagacagtcagagagagaaggaaggaaaaagagaaatgtttggaaaaggatcaagagtgactttgcaaaaattttgtttcaggatggacaggaagtagaaatctaggcccgcccttccagtgtctaggaaccttgggtcactttgagtcacagtggaccctgtctagtcattcctcctgtcccgccagaagccccaggtcctggtgacgcacttatgaagtgctcaggacgcttaagaattgggggccccttgtaccatgggcaatgaataatagataaataaaagtttgagaatataaatcattaatcagcgttcctgctgctgtgtagggttgaatataaatgccaactgaagttgtggctggccaccttaggcagatcctctctttcctgggtctcgggccctacacctccctatttctctttccatccatctcctcactgaggtctgccctcccccgagtccctcagtgtgtggatttacaactggactccaatccccgctgtctttcatctctgtcccggttcccttctctcctcagaggctgccctcggcttccactcccctctggcagccccaggctgctcctccttttgaaggaccctcaccacacagggagtgttctcagacgggtgctgtaggaggatgagacgggacacattcagccttttaaagagaagatgagggcttaagcaagtgagagagacagaacaaagacaggcagggagacctgcaagagctcgcctcaagtatttcaaagaatctctcagtgtgggttgggcatgttcctgagctcccaagggcagcaccagcaccaacaggcagaattcacatggggaggttctttagaatattctcaactgtttgaggtatccaacaaggatctgggatgccagagagtgtagtgaggtccccatcactggctgtattcaagcagaggttggatgatcgcctctcagggatgttgcagaggtgatttctacaccgggtgaaagatcagactagaggagcttgaaggcccctctcaccaccataagtgaaggttcttctggaggtggggcaggcctccctgggggtgggctgtacaacgggccaccagcacttgttcctggtcaggcgaggtagctgtgatgatcctctgccagccttcctggcatgctctggagtgcttcctgtgcagctgggcccttcagactcatgtcttcatggctaccatcctcatcatgcaataaaatggccctgtcctccccagctgtgcaggcctggccagaaaagctcacaaggccatcagctgcacccctgagagcactgcctctcctcctgcccacacttcccgccttctgctgggctttgggaatgagcccaggtaagttaagctgtctccccccagggccaggagaggggctggaaatgggttctagcccaatcctctccctgctgccgctgccttccttgtagctggctggctacccccagcccctccagcccagcctctggatcccactatcctgtgattagtccctggtctcctgcaggcatcttggctggagcttctgtttctgttgtcttgcaagctatcagcagcaggattttgctctcacgagctgctgaaaacatcagtgatgggtttgtttgtatttgcctaattaggcagtgagctgtgatgctatcccaaggactggcagcatctttgaaaatcagactcagaagcatggattctgagaaagttctagctccttccacattatcattactctctcttgctactcccaaaggaggcaaaattacttagagtctgggttctatagtcgaattgcctgggttccaatgccagctggatcacttcctagctctgctgtcttgggtgagttactttaacttctttgtgcctcatagactacttactatgtgccagtccccattttatggggacaataccagtacctcataaggttatggtgaaggttaaataggataatctatgtaaagtgcctggcacattgtaagtagtctataaatgccaatttaaatgaagagaaaggtatgtcataaggtcaggtggccaaagaggtctttatctttagaagggagagaagacagagtatctggaccctttggggttaacaggcaggtctcatgtgctgggattggttatatagttgagtcaatttctttctcagttgtgactttgtttacctgtcaaacaaaggggaaaatccttcttttctccctccggatcgctgtagatttatgagataatgtctgcgaagtacctgagcttcttagaagaaaaatgtgctatcaatatgaagaagtgcatttataaatcattttctttgactggttattccagctttggtgactagaaaaacatttaggtcttcaaggagcgtatcatttctgggagattcgggggggccacatgggtacagtaggagaggacagagatgtagcaggctgaaatcccacaaccctgggcctcagtttccctgtaggagagctttcgcggtgttaagggctctacaagtacttgctgaattgagttgagggctgtcctgcctgtttccacatcaggcaagcgagcagagttaattgagcatgtaagtatctatcatgattgccatgatgctatttttgggacaagtgacaaaatacagggcaagtattttatcaggagtttgaggtcattggctctgtatggagaggcaaaccgagtcaagctggagaggacacaggccccagtttgtcagaggccattgttctgcagccctaagcaggtaccagtcctggatcccagaaagccattcatggcactggatgctagagggtcagttatccatgctgagatgaccaccgtatgcactatccctgctgacctgagcctccttttggccactgacccagcaagaccccagtccctgacggaagttggaaacccactgaccgggaccccagacagcctccttaactagcggcagcgctcatcccagctcggagccattcagtgcatgaactattctagtttgggaaggttgtatcattcctggagtttctctagggtaaaggcgttcggagtctctgaaattggctggttcccataacagttaaactttatggcagcacagtatattttggagatgtttttgtgtattttttccatgctcagctgggctgcagcgttcaaacctcgtgcctgctattgaccattgctataatgtttcaatatacatttttggcaagacataactcacatttaaaaatattaatttcccaaccatcatgttcctgagtgcacttcgatttttattttcctgcagctgtacaccatgcgagaggcaaagttacttctcagctgaataatatttttctctcctcctccacccttagctattcccaaatcacaggggaatgacacccagaggtccctgcttgtgaattttactgtgtacgccaagcctagcaaacaaccactgcctacctgtaggacagaataatgatagctgaagggtgtgtgaccagggggatgagccattctttttttttctccagggaagaggatggattggaaaagcgtctgtatggtcttatgggatcactattcacaatagttaacaaatgatctgttgtcagcactggccagtgagttcacgtgtcagccatcaacaaccatgggaactctcactgcctgtcccagggtagctttgctgaataccagcctgcccaagccgaacatagttggaaatttatttttaatacttcctgtcttttcttcccatctcatgatggctcctaagatcaactaggtgtctttgtgagttttcagtttacttggttccctttaatgggtgagaagcctggaagaaccaggttgtgacttgtatttccttaataattgtgccttaataaatgggggatacatcttgggccaagacacaggaacacttgatttctggaaactggaatttacatgaatcatgtttgactttggagtaggtgcttgagggcaatgtcgagttaggttaggacccaccgctagaaggagggtttgcttatggttcattatgcacatcaggggccctcagagtctagggatgctgggtgcagtgcttgcctagcctgactctgcctgaggagttgcagtgaaagctagagattcgatactcagacacctgtgaagatgggtgctccctaggaaggtggatgggtgagtaaggaagtgatggccccaggcccaccccaggaggtctggaggtactcacttgagaggtccctgcccacacccagagccaagccgtccttgatccacagaacgaagccatcgtattcggggatggcgcaaagtagcgtcactggctgtcccgacaccaccacctggtcctggggctgctggctgaaggaatagacttggcctgggaaggagacaaacacaatggtcagttatctgccggctacaggggcgagaaggctcccctccagctatggaagcagagcagggctggcgcaggagactgagcctcctgaagcacctggctttcctgctgagggtctggtagagcttcctaactggtctcagccccagctctattccctcctatgggggcctggctcccagctccagcccctctgcccatcagtccctaacacatggactggtctagccacaccccagctccctatgggccatctccctccacctttgggacgtgccacttcccatgcattggtgagctcctacttaatgccatgtgctgggcatgcagtcccacaccagggcagaaacaggagagagagagagagacctctagctagaaacattctgtggtggctgtgtgttaagaagggggtcgatggagagtggtgcggctttggttaaacctgagaattcaggaaatcattttgttgtttcagtggctcctggggtgggctgagggccaagttcagaggggtgggtggtggtgcagtatggcaggaggtgtgctgaggaggcgtgccatcctaccgtgtcctccctgtccctttcttttctgcagcagaccttactccagcctcacaatcacttgggaaaaaatcattatggacaccatgcctcctcaaaacgagatggccagaatcatcgaagagagtcagttgacattattttattaaacaaacccatccacaatgcttacaagatgccatgctctgttttgaggctttaaaatattagttcattaatattttcatcgtcataacaacctaaaaatagtaggcactatttttatccccattttccagatgggaaaatgaggcacagggaggtgaaaaatagtaatgggagctgtgcttgtgaattgctcaccaagtacggcgcatgccctgactctagttatcaccgtggcaacactcgaatggggcattgtcaaccccatttgacaggactttgggaaacggaggctcagggttaactgaattgcccagggaactgtctagtgggagttggggtgggtggtgcggtgaatccaagtctttctggctctgaagaccatgctctcccctactgagctatgctgtgtgcagatccccaagcctggccttggagggagttgctgatgaagaggtgtgatgtgatctgtgtctcctgggagtccacagttgagtggacaatggaacattgacattcgctgagcatctggcccacagtacaaccagtacttcatacaacccctcctgtaatccacttaattatacttcagggcagaaaaagccccactttacaacaaagaaaccaggatcagagaggcacagtaacctgcccaaggtcacgcagctaatgagtgttagagcaggggtttgagcaggggcccatctgcattccaagccctccctttttcctacctcctgctctacagacccagacctaaccgaggcaaaactggacctggcgctccagctgctgatgctgtggcctctcctccccaacccgggagagtcaggggcagccacagacgtcctggacactggctgctgcccatcttggggacaaaaagccccaggcttgggccacacctaggactgagctctcagcaacagatgaccccaagagggagacacttggtgtgtatcaacccaggggagcttggatggcagcagagcttggggtggaggctccccagaaggaggggtgcagattcacagtggagagctggggacaggcaggaaggtggccgagttcacaacctgacaagatcttggcagggtctccgaggagtctcattaaaaatcaaattggccttgaattgtgggagtaacactttttattctgatttgagctttacaaattagatttcataggacattttaatcagctatgtatggtaggttttttttttcctctctgtctcttcaagttctctgttgtaattagactgtttctggcaccaaaacagggtagaaaaggagggaagagatgagagaggagaaggggagaggagggagggactggagagagagcaaaggagtgaagtgaggacgtgggagagaagaggagagggagaggaagaggaggaagcaggggaggagggtgaggggcagcatggagagggagggggtgggtggaaaggactccttctctggctccttttactctaatgatgatttcacagctcatccttttatctcaaaatctttcttacaagaaggacagagtcaaggcagctgcagtaactgccaaagattgtgctatcagagagaattatcaggttgtcaggtggacgtggagggggttataatgagagccccttaaatgaagcagtgcccgagccctctgagatgtccattattaggaagcacccacagtgggtaaccgtcccggtctctccccgtcctgtgtcctcttggaggaaggcgcgggaggtactgggtgagggcccccggggaagtggggtgcaagaagcatccgagggccaagggtaagttgtggaccggctggagcccccagggagaggagggggctatcaccatggaaaccaggctctggaggaaggcaacgctgggaagggggatcagttgaagcaggccatggaggtggactctgagtggccacagacccttttggtgggtgtctcagagccaggggtggcagcaggcacaagatgcctggaataagacctggggtctgtaggaaaggagcctgatgggatggggctgagcgggagagggccttttgagggggagcatctcccgatgccatctgagcaggcttggaggtgtaggatcccacaggttgcagtgagccaagatcgccccactgcactacagactaggtgacagagtgagactcggtctcaaaaaaaaaaaaaaaagaccttcctagagcctctcgcattctgtctgcttgatccacttggcttttctatggaaagactgtttctggggaagatgagtacacaggaaaaatccacccaaaggacatgatttacaaattattatttttggggatgggagacagtactctaattgacaatgtcccttttcagtccaattttaatttttgcacattacatttgagtcactataattacttttctcttttaaaccaatgagttttttttttttttttcaaatgaatcttaaactgttactgagtatctagagtggataaaagttgaggtgctttggatgaaggtggagatggagggatggaacccacttttttttttcatccatctgacagaccttagggcctctcctttgggctcaagagcccctcagagcacagcttttgagccatggatgtaagttattgccagaagaatgctcctcacccacccactctttcttttcttttgagactgagtctcactctgtcgcccaggctggagttcagtggggcaatcttggctcactgcaacctttgcctcccggttcaagtgattctcctgcctcagcctcctgagcagctgggattacaggtatgcaccagcatgtccggctgattttcatatttttaatagagacagggtttcaccatgttggccaggctggtcttgaactcttgacctcaagtgatcctcccacctcagcctcctgaagtgctgggattacaggcatgagccaccatgcctggcctctacttgctttattttccccattttcttttctactccaaagaagtgaaatgcaagtgagcccaaggtcattttctgcagcctcctggatagtgccttaagtagacagtgagctcctgagaacctgtttcttccacacacacactgaccggaccctgctgtgaggcaggcactgtgctgtctggtgaggagcaggggaacaggcctggccacccctccaggagctcgcagctgtgccccctccccatcacacctgggcgtctcagatggagcacagagtaggtgcctcacaggctcaggtcctgctctcagtggagatgtgacacacccagcaccttccaccggcccagggtttccatcttctccgcttcgcattttccctgatgatgttcccctggtgtgaagccttggcggccggtgcaatctccccttcccatactttatttttatttttcttttttttttgagacggagtctgactttgttgcccaggctggagtgcagtggtgcgatctccgctcattgcaacctttgcctcccgggttcaagcgattcttctgcctcagcctcttgagtagctgggattacaggcactcaccaccatgtctggtaatttttgtatttttagtagagacagggtttcaccatattggccaggctggtctcgaactcctgacctcatgatccacctgcctcgacctcccaaagtgttgggattacgagcgtgagccaccatgcccggccccatgctttgttttgagtctgtcaccatcactgagcctagcccagcaggctgtacatctctcagacttcccctttcctctctattcccactgctagcacccaagttcaagctctcgttgcctcaacctgggctcttgccacagactctgaatgttctctttgcctgatccattaatgtgctgaacctggattttccgtcttaattcaccacttgcttcagggttcccctcttttaaggggtgggacctctcatggctctccactctctgcgggacaacgcccaacttcccatgctggattctaatctccaaaatccagctccttttcttcctgggagctccacagcacccccgtgctggctagtcactaaggtcacctgcctcgagttctcctcgatgtttcattgtcctgggatgcactgcatccccccacccaaggctcccccacccaaggccccccctaagcaaccccacctatcattgaaggcccagttctctccccaggcagctcctgtgacccagatggaatcttcttttttctcgtcttctctctatattctcatcttgcctctttttcatcaatttctccaaacctttattgagcacctactatatgtcagatgctgatgaaacagaaataaggaagaaacagtgtacacttcttgagggcaggggccacagctatcttttctgtcttgtgttcccagctgtgggtgagcaccggttacacgtctgtcacatgtgcctttgtacttagagtttgcctgctctggttggtctgctgagatcggtggtcactacaggaaaattgcttttgcattatgaactactaacccggcagatactgttcagagcacaccacacaggagaaaggtgagaaatcacagggtgggctggagtctctaggaatcaggcttgacaggagaaaaaaataactgctgttcatggaagatttacttgatgccacatctttggctgtatacgttgtttctggcatgcagattagctgtaattaaccacattttatagatgaaccaaggctcacagaaatgcagggacttgcacaagttcacttgattagctcaggtgtcactcaaaccccaatggtctgggtacagccctattttctcaccactatccgatgtaggttgttgaatcaagggtctcaagcccagattttgattcttaagcaagtactcactccaccaacaaggcagcctactcagattatttatctatttttatatttatttatttatttattttgagacggagtcttgctcttgtcgcccaggatggagtgcaatggtgtgttctcggctcactgcaacctccccctcctgggttcaagggattctcctgcctctgcctcctgagtagctgagattacaggcacctgccaccatgcctggctaatttttgtatttttagtagagacggggtttcaccatgttggccagactggtgtcgaactcctgacctcaagtgatctgcccacctcggcttcccaaagtgctaggattataagcgtgagccactacacctggcccagatgatctaaagggaggtagaagatctttagaatgaaaagtgatttcttggtttttccctcagtttctgtgtgtaggctcctcttcacctattggtcagtaacactgaaacggttgagggtaaagtttagtactggccaccataggaagattaaaagaaaggaggtgtactagttaccattacttataattattacttaaaatggctatttaatataattatattataatatagcttataattatgtatcataaatatttttattgctataaaattagtaattgctaacttttctattttttaactttttgtagggacagggtcttgctatgttgcccaggctggtctcaaactcctggcctgaagcaatcctcgtgcctcagccttccaaagtgctgagattacaggtgtgagctaccatgcccagctagtaataggtaacttttacagaatgtcaagcatataataaaagctttacctggattattttattgactcactaaagagtcctatgagataggtaccgtatcacacctacgtgaagatgaggttgtctggggcccacagcactggcagtgagaagggatatgagcccagcagtctggttccagagcagcctctttgcgtccttatttggacttcgcccactgtgcctctagtcctcgcccccaggaactcatagaacccaccttagacctccctctcccactgcccttggccagtactgaaaagtctcaaggaaactcaggaagaataatgtacactagctcacttcatcagttctgtgtataatgtcctcatgaacacagttctctgggtggatcagagttgaccagctatccaagagtgactgaagcctatgttcaccttctttagctccctgagaaggtgagcgcagacctgcaggtcctccagtcacccttgaccctcacaaccacatcactcactccaaagaacccctctctcccttcaccatttggactggacaagccccttgggatgaaggcagatagtgcagtggtaatgaatggggctcaggaatcagactgacctgggtttgaatcctggcacttccatgaacttgctgagcctccattttcctatctgtgaaatggggacaataataccaccaccttgtggagatagagaggatgcatctgggccacttgactccggggctggctcacaacaaatgctcaggggaaaccgaccttcttctctcaaagccaccctctgtcctgaacaccaggccgcaggctgagctccatagggctgggcgacgggaagcgtgacctggaatggcaggtggctctctattggtgtgaaagggggaggcaagggtggacttttaattactatccaatgacttattgaagagacagttttcactaaagacaaggatgtactctctttgcaggaggacctcagtgtagcatccatgggttctcaggtgggtctcaaggctggtgtttgtggtaggtgagctcaggtgttggaagccttggccagctgctgtgagccatgccctgtgggggagaagaggtgggagaatgttcccccagggctgcaagggggctactggggtggaaggggtagggggcgtctcccgggccaatgagggctggcttggctccgcatctgactggcgctgaactagcttccgttagtagaaaaaggctgcgtgtgcatgaacctgcctgggcatggcagaggagcaggcctgggaaacacagcggtctctctcccacattcgcttggttaggtggctgcagaagcaccttcctgctcgccgcctggaaggtaggtcatgttcctgaaagcgggaggctctgcggggcagggtcccagggttctgagacaaagccctttgtctctgagtgagagtccctgtctgggatgcttgcccccagcctgtgcgtctcccctgcacacccaggctgttgtgacctgcaggggccgagagagcactgcgccatctgtcccgggggccctttagaccactgggtaaggcagctgcttttccctttgaggagagtggcagaatcagaggagagcctgggtctgccaccccctcgtgccaagttctctgccctacctgagaaggtagaagcttcaggagtgggagcaggaggtcgaggtgctgagcaggcagggccttttgcagccttgtctccaaattgcaggaagcagtggctgtttctggctgggaacaataaaggggaggggggcttggatgaaccctgtcctgatgggccacgtggcgtccctgagtcaggacagctggcactgttgccagtgctggtgagtggctggtgggaggaagtgtggaggtggcagcagcagtgacaggtgtggcctggcctagggaggtgggcaggaggtggagcatttggtggccttttgggggctctggttatggggcagagctgggagcaggcagatggcatcctcagatcagtggtggggctggatgtcttccccagttgtttccccaccctcctccatcgggactcctcctgactgctcttcccaaaagccccctctagatttccctcctgcgcttactcctgcctcctgtcagcccacccggcttccaacctggatgcagcgccctcatcttaatctcttttctgggactcgcagcacacattatcacggaatgaaccatcaccatctggctcccaaagtccccaccaacttccagtgaaacattgaaatgcagaagaccccatgtttctctatgacttgcacacctgtggccccattctgaggttgcccctcaatccctaattatttcctgagggggaagagtcattttgccatggaaggcgcagattacaagggccacgtcactcggtgtgatggtcttagggcagcactgcagggtgctgggtcgggtgtgtgtgtgtgtgtgtgcacgtgggtgtgtttgtcagattaactgaattggcctcaaccccaccttttctccagccagacatttgctgcttctattccttatcaagcacttaagattttggttgagggctgggcccggtggctcacgcctgtaatcccagcactttgggaagctgaggcgggtggatcacctgaggtcaggggttcgagaccagcctgaccaacatggtgaaaccccgtctctactaaaaatacaaaaattagcgggacatggtggtgcgtgcctgtaatcccagctactcaggaggctgagccaggagaatccatagaacctgggaggcggaggttgcagtgagccaagatcgcaccattgcactccagcctaggggacagagtgagactccatcacaaaaaaaaagattttggttgaatgaatttttctaggagaatccatagaacctgggaggcggaggttgcagtgagccaagatcgcaccattgcactccagcctaggggacagagtgagactccatctcaaaaaaaaagatcttggttgaatgaatttttcttagttttacagaatgttggaaagcataggccctggcagggccatcttggggaactttggaaggaacagtgatctggttcgtctttggggtccaaaggccttggtactatggtgtgtgtgtctgtgtgtgtgtgtgtgtgtatcggataggaaggtggcccagtatcctggtgcccatagaggctgggatctgactcagaggagccgttgcttactcctccctgccacccacaactgccaaccctaaatcttctagggatgcattctggaactccactgtcccaagtctattgctaccccataggcacatgtctctgcactgtggttccacagtggtggtgagaggcacagatctacagggcagcatggactagtacaaagagtgtgggatttgggatggttgtgtaacaggggagataaagctttgatgcagactctgccctggagcctgatgtgggatcgggggtgctgagtatcccctcatggccctgggcaatgctttttttttttttttttttttttttgagtctcgttctgtcgcccaggctaaagtgcagtggtgcgatctcggcttcagcgcaacctccgcctcttggattcaagtgattttcctgctttagcctccaaagtagccgagactacaggcatgtgccactatgcctggctaatttttgtatttttagtagagacagggtttcaccaagttgaccaggccagtctcgaactcctgacctcaagtgatcttcccactctcagcatcccaaaaggttgggattacaggcatgagccattgcacccaacccctgtgcagttctctttccatccatgcttggaggcggctcagaggcaggcaggaggtggctcaagggtgggctcaatccctgcctcccctttctccactggttatttggcctggcctttgttccagcagcagattgaggggacatgaccactccccttaggattaaacccagtcagacctggacaggaagtgagggtcactaatataaggatggaaatgcttgtccttgcttctaaggagcctggtgctgacacatgcacacacccgcctgcatgcctgtgagtgtgggcagcccagctgaaaccctgcctgcacccctcaactctcaggacattctgtgaaactcgctgagagtcttggatggtcacatttgaccacaggttactggattacaagggataaagtggtctcatagagaagtcatataaagcttttcaggggtttaagagaatcttgcttcaagcaagggagttgtggggaggaagcagagaaggcatcctggaggaggaatcataatatggggaaagtaatggaggagaaatgtcattctggggtaggaaaaaaaatataagcaaaaacatgagtgatgggtcaccctctgtcacctgcctggagtacctaaccgatgggtcacctgtcggagcctgggtcctggacagtaggaagaacacagggtcagtcagccctaggaaggaactctggccctgtacctagcagtgtgatctgaggccagtgactcaccctttctgagcttcagtttccctatctgaaaaatggggatgacacgcctccctggcaaagctgctgtgagcatgagaggttttatatgtaaatgatcttggtagacaggtgtttcacaaagggtcattcttactttcgtcactatccacaagtctttcctgagcttgggactgttaaaacaggagccagaggagcacctgtcttgcggagtcccagagctgagaacggaggctttgcaaatctgaagttgcacccattagaatgctgcatgggtggtgcaggagacagtgggtgagccctcccattggctctgcctctttcttgagcttgggactgttaaaacaggggccagagcagcacctgtcttgcagagtcccaaggctgagaatggaggctttgcaaatttgaagttgcacccattagaaacctgcatgggtggtgcgggagacagtgggtgagccctcccattggctttgcctcttctgctcatccgggttggcttcacagcctcctggagtgttgtgtcagccatgcaaaaagggctcaaatgtcaccatctgccttttattagtgaccaattggagaaggcttaagaatacttatactggggttatttattgccggctttctcccagcctggagcttgtaaattgcctcttatgagattaagggaagctgcccctccagagaagcaagcaaataggaagaagggaaggagagaagaagtcagctcagtggctcctggtgacatcagaacaatatcgggtagggtgggaaagacaagggcagcgtgactcagttcatacctcgaaacccaagtcttgaattctgctgtgttcctgctgctcagcacagggccagcatctaacacaggaggatcagctttgagaaatttccagaatgcccagttggtgacctgctcggggaacaggattgggggtgatagagtatgttctgacccactgactgacggataaaaatggatttttatggaggttctagggggtttcagtcactgtttcagctctcaggatgccatggtgcctcaggcatgagcaggagccacctcagcaatctccaagtccccaggttgggtgtggggtgtgcaggaggggctgatatgtcttccgctgagtaggctctggagctgcggggaggcaaatatgtgcagaagaaactagaataaaaagctctacaccataagcgtcagagtgaggcacaaagtcccaaagaaggagtcacagaagggttggcttctgaaatggccaggatgaagacaaggtgggaatgttccctggaatggggaacagcttacgtcaagtgtggagaacagatgtgttcatggaataaaagcagcagtgccacatggtctaggcttgatctctgaccctgccattatggctgtgggtccctgggcaaattgcttagtccctctgagcctcagtttccccattggtttagcaatcaatacttgttgagttgtttgtgagaatgaaataggtcattctctgtgatgtgcacagagccctgcctgccttccataatggcagctggcagtatcattacaagcctagcaggctgggtgcacggagcatgtgtgtgcagactctcttagtacagcgcaaatctagaaagtcctggtgggtcagaccgtgtgggcccttgaacgtgtgccaagaagtttgtacttcatgagaagtcatcaaaggtttttgacccacatgctcagatctgagttttagaaatatcacggtgatgacagggaggaggatgaatgaaggaggataatctgaagacagggagactgatcagcaaggttttgctgtcatgaggactcaggctaacgctgcatcaatggaaagaagaaatggatttaggagccatttgggggtagaactgatagtacttgaccagggatgaggaagatgaaagtgtgaatggatgatggaggagccatttgctgctcaggaggagaagcgcgcttgaggtgaggcagtgagttcagttttaaatgtgttgatggagaggggtccagaatcccccaggtgatgctgtcccagatgtagttgggtcaatggttctggagctgggaaggaggtgtgaagaactcacactgactgagcactacctatgggtcaggcagtaggagaagtattttcaggtgtcctctcacttggtgttgacctgataattcaactccaaatatggaaagttatagatgttgttgtgactatctaagagggacaaggttactccagtctgggagtgttgggagtagctgccttgggtgaaacatctaaatcttgttgaggtttgcacaggttttgaaccatatcgggatggcaagagatcatctaacctaatcttctccctttagactgggattggaaatataaacagagaagccagaagaaccaggcaggggtagaagacagggccttttctctattgtctgtttctccttgatttctactgggagagagacaaagaaacactttccatcccagcatcgccacctgcagccattggtagcttgattctgatacacacgtaaggagaagcttgccagtctcatgaacattacagaaattgcactagaattttacttggacttacaaaaaagaggctgactgctcttcccagggctggatgagggggtggaaagtctgagggcacattcccctatgcttgttcctcacccgggctgagccagtgtgggcagcctgtgattctcccagcctcgcacttctctcccaggacacaaaatccaccaaggttgtcctggacagtgtgggtctttaacgaagagcaatcgggctggccgaggcagggtgagtccaaagtcactataaatcctttgcctactgatgatcaggctcgcggcccctgccaaagcctgcactgtactcattagtggcagggagagggattcttccatcgatccagccaaggcctggatgccacgaagacactgataagtgctgctggaaatatgggctcttcagtgcccatggcagagcccatccatccctgcccgaggtcacctggaggtctaaatgagacaggacgggcatagcagagtgggtttatggtgggggagtggagatgggagatgctcgacagcgcatgaagcagagaccctggctgtggtctcaggcctgttgctggccagccatgggaccctggctaagccccctttcttctctgagtctcaggctcttgtgtcttctgactggaatgtgccctcactgagccggcaccttgggatgtgttggagcagcatggaaggaagagagtggcactaaggggcagggatggaactatgccattagctcaagagggagctgcaggctcggctatgggcaggctcggctacagcagacagagtgcccatcaacccctctcagagggcgtcagcgtgggcaccaccaggagaggctggaggctaggtcatggattggctgactccaagatgcccagcacctcttgctcccatgtctaaggggtactgtatggacacatgaagctttgtccttgtcctgggcccagaaggtaccagttgatgctgcctctgccacctcttagctgtgtgcccttgggcctgactctttaactaagactcagatgccttatctgtaaaatgcaaggtttaagcgccttcctcccaaccctaatgcttgatgttctaacttatccaaaatcctatttcgggggtggggggtggtcctaaggttgaaaataataaaatcaaggtgcaaagaagtgaaagcaagtctctcaaggacacttggccttttgggggctcagatctatatcctaaacattaaaaaaagtaaacaaaataatcatttatgctgctatagccttgtcagtcagagacggttctaaaacttccatgtgcatgaggatcacctgggggactggctaaaaataacagtttcctgggctccaactcagagattctgggatagtggctctgagctgggtcaaggaatctgcattttaatagcttctgggtcatccttctgcaggcggtttctgggccacatcctaagggcactgttgtgtgcccacagcacgggcttgtgggcctgggttatttctagttcaggctctgtcactgggtggccttgattaagtggctgtctctctctcggggtgcgcattgatgttcccactgcacagtgaaggcattttcacaccttttgaaagttcatgcaaccctttttgtcagtgaagtctcacagggaatcccagtgtataaaacggtggaggcagagctgaggcagcgcgggaaggaccgagtcctgccctcggcagccctgcagcgggccctcaggaccctctgtgcaatgctcaaggattccaaaggccctgtgcagttttgatgctcttcaggtgtcctgtgaaggaccacgtggctatatcccactgacggtgtgaaagcaggcccacccggcgtgcactgagtgactcaggcaggctggtctgaagcacgaggtgccttggtcttgctctctgagcctgcatggagaatcacagctcagacctggtgcttatagaggagtcttctcatggttcctggagttgttcccaactggacacagaccatcttggggcaacgtcctgggtttctcccctcttggagaccaaatacaatcaactcttaattatctttgttagtggagaagagcagggtgtgtataatctagaatgatggacaatccaaaacagtgaataatcctaagtaacattcattttcgactttggaatgcattttgatattcacatttgaatatggatatgtttgatgttctaggaatttttcatacttaaaaaaaacactcaacccaagggtggggctccctctctgcctcctactcagctgaggggagaacatcacctctgggactggcccaaagctacagtcaggtgcaccccaccttccccatctcctgtctttatggctcacaccttatctaggaagggagggggatattaacagattttgcctttaaaggacttttattccctttggaccttatgcaaataagagtaaaataagaagctgtgaaatgttaacagaggacttcattaagcaaacttggtgatagcatttgccaggaatggggacaatttgccaacagatacttgagtgctgactatatatgtgtcctaattaaaaaagtgatacttctcactgccctgggattgtgggccgtcttctggtgggtttgggatattaaccacaactaactccgatacaaagcacttcacatacattatcttacctaatccaccttcatagcaccccgtggagcaggtcccatcatcagcccccatgtagagacttgaatatcacagctccaagccagatgtcccccgtgaatataccctcccaattctgccctattctactccactctgcctctcctgtcaccccccaaacagaggccctgcaaagcctcagctggtctgcatcaatcaaagagaacgaagcaaaactaacttgccattactgccctagtctctctgattgttggaagtagagatgtttcaaggagaggttttgtgctggaagccccttgaaaggatggagagggagtgtgaggactgccggagacgcccagcctaggaggggaagctttctgcttttccagcaggacagaactccttagaagcaggtgtagccctggctcatatccaccatcctgagaaatagaaaatctttcccattttacggacaaggaaactcagagaggttaactaacacatccagggtcacagggtgtggtagaggtagggtttgagccatttgactccaggcctggctttttttcccccaacagtagccggtcagcagagggtgtttgatctgtgtggtttcctcttcagaaagcagagactcactactgtgccccctacctgcccccagctgagctccaaaaacagctataaagctgatgggaagccgataggacagcccctgcccttcctgaagaccacggaaacctctcccatggtgcccttggggctgagatcagctctgtcaccaatacttcagggcaaaagtcgttggcaccacttttaatcctaatcctgtgtggccttattcagaagccctttgcaaaggccgatccctagccatagctctctctgctcggccttgggctgggtgaataatgacttccatttcctgccctgctggagccttgggtctttgccactgccaccgtggtgctgagccacttatttgttgtgagatgacccaaggaggaccagccggtacctgctaggcccttctgctggggcacggggtcagggggcagcacatgggcatgtggccccactcctgtctgctccccaggacaactctattttccagcatggagtgcccctggaggtggcgacagctcctctaataagagagttactcatggcttcactggagagaagagagcagctttcaacccccctctcctaaacgcaacgatatttggtaacatgcggcatcttggggagagcattcatgtctgtaattagttactgtatatcacggttagtactctgctcagaatttacggggcaaataccatttaactgcacaataactgcaggtccttgctgcttattgggtaatttactaaggctggaagaacggggcaggagggattctgaatgggaggtattgtaaccccttgaatcaaactttatgagtttgggtttggcagggaggcagctgcttgcagccagttctcttctctttgttttgcagagttggctggcagactgcttccttcccttgatttattgcaggatgataggtctgggactgggggtgggactgcccggggctacctggggctatggaagggactttccatagagggtctttggctgagagtctgcagcaggaacccagagtcggtgtcctgggggctccatgcaggacagcaaatgggccctgtcatttatttactccctccacggggctgctttttgtatctgggccagtgggtggagagtgcagggagctgtccttggttggcagcatcaagataatcgcctaagccctttcttctcttgcaagtccgttgctgcctgggaagcagccattcctggacacttggccgacattcctggccttaatctgcttgagcaaagtctgtctttgtttggccatgcactgtctaaactcctctaacctatttaggccacagagaggggagaagacacaataatgaaaaactcaacgtgcaacattgccttacgcaatctaataaattacttggtacccggctgccagctcagactaagcccaatattgcctgcagtaattatttggatcaaatgcagtttatctgcttcatatttgtgcttctgtgctcagtgataacttataaatgtcattgtggtgtttatttgttataatgaaacttaatggcattggaagccaagagcagaactggtggggcggcaggtttaaaacaatctcttcatctcgggagaaggaatgagccaagataacatgaaactgccctatagggaagagatttgcagagatagtggtgtcctcgtgctgtgtggtggacgggagtgagccaggagctttgagctggcaccaaggggagccgtctttgcctccagagatatctatctggatcggggagacatggctgagcttcaccctgcactgccccatctgtccttgctgctttcaggggtgggaggtgttcagtctttataccacctgatgcctgcctgggataagagatgaatagggatggaaattagagtccctgggccaggcacggtggcccacgcctgtaatcccagcactttggaaggccattgagggaggattgcttgagcccaggagttcgagaccagcctgacaacatgtgagaccctgtctcaatttttaaaaataaaataaaataaaataaaataaaataaataaaataaagaactcctggatgactgcattatggagaacaggccttcagggagaaggaagggagcagggttggagaataaaggaggatatcatgagggcccagacagaaggtggcaaggctttctcttctggttctggagggcattggtggtaggaagcacagagcatgagcagaacagggaagagctttcaagggttgcagggcagggcccccactggcgctgcagaagtacctgaggcaagggccatttaatgtagaactcagggttttggcttcatacagtcctgggctctgctatttcctagctgtgtggctttgggcaagttatttgtctttcctaagtttcattttctttatgtggaaaatgtgagtgataatagatacctctcaagattctggtgatgattaaatgaagtgatgtgtgtaaagtaatgactgtggtgtttggcacacaggatatatgataaataaggggctgtggcagtgattggcacatagtagatgttcaataaatgttgaatgtatccatgaataataacacttcccacttgtgtgcattacaaaaccctcctccaaacagctgagcttggatttagacctcacaattgttcagggttgatcttctcattttacagtgggaaatggaggcccagtgaggttatggtaacttgcccaaggcttcccagctggtagatggaatggggtcttagttctcctacctcccagggcaaggttgctgccaccagtccaccctggacagctcccaatctgtgctgggagactgacctcatccttcctgatgagctgcccctgctccttggagaccaggcacagagcctgtgctgacctccccagcacaacctgggggcagaagcaagcgggccgctttctgtccatttcatcttaatacaacattcagcattcactcataaaatattcattttctctcctcggtgacatgctcatgcaagtctcctaacatcataaatatggatgaagactattagtcatttttatttatctcactagccccttccctccccagcacaccttttgtcttgatctcagcacaaatgggactgaattggggctattaacccggatctctgataataaagccttgcatcctgtggtgctttatactttttttcaaagcatcacgcaatcgtgatgcatattttctccttacaacaaatgcgtggaggaaagagggctagcatcatgagtatacccatttcgcagatgagaacatagaggtcaagagagatcaaggtcaaagtcatatactgagacaggaacagaactaatttttaaaaaacattattattgttatttgtttgtttgacctccaaggaaaggttctctgggacactgagtgtgtttgcttcacacaaataaataatctgtatagtattttacaagtttataaagagtgttcacccatgttacttggtgggtccccacaaggcaggtatgatttactcttgtttgacaaagctcacacaaccagttagtggcagatctgggctctaaaacattatttcccaaagtggatttcagggaccactagtcctgacacatgctgcaggaaaaatgttttgtggtcaaatgagtttgggaactctgtgagtcatatcccctttgggtggcttaccatggcctttggtgtattagtgtctctgagaagttctgcaggaaagactctcattttgttaggtctcatgtagcttctccccaccgtgtctaatcacgaaggctgcatctgacggaaaacctattaacatgctacagaaatgctgcctgtgtgtacgcgtgatccctcctcccccgtgtgtttggaggcagtgaggattagagcgtggctgggagaggagcgtgcaggggtaaggacggggtaggggacccactgctggggactactagagctgaagctcccctcctcaggctgtgtcctctctttccctctgggcagtgcagaaaattcactcaatattaggcacagtcagcccagcccatatctggggcaggatcagaggggccgcctgagtggcggagtggggggtctgtggtcagtgaatggtgggagatttggggacggcagtccttggccatggggaaaaatcaacagggacccacaataggggcttagtcaagtctgccctggacgatggtggggaagtcaccctatcctcgtcgcccagacacaaagctcccgaggcagggtggaagtaagaaggccaggctttggcgttcagctggcttactctaacatctgtgtgcctttaggtgatgatctaatctgtctgagcctctgtttcttcctcctcagaatgtggataacactacccactttgtgacgtggtgaggattagatggtgcaagtgtgcaaaagtaccctccttggccctcgtctttgtgtgtcagctccatctctcttcccctgcttttttggagcccctcagtcagaacaaatagcttcccacctccagtcctccacgagcctgtcatctgtacctctctttagttctcccatcgccctgccttctgccattttattatatgcccatctccccaatggacctgaagttctctgcaggctgctgctgactctctcagtgcccacttgtatctgcaggcccgaccatcccgcgtcttcaggccaacctcccattgccggtgtctggaccccttctcttgagggctttctctttagttgcggaggccactgtgccctcacacagagcaggccagacctgctgggagacaacaccctcacccagcagcactccacccatgccctacaggagctggtgcagaaataccccaccgcttgggtgccctagctgtgaggtggtgttcaatagcacttctcagagtttcttactgggactgggctctggctgcccatagtggtagcaggtttggggtccccccatgccgatgcctcctttcccatgtcaatttccaaccctcccgctggcacctctgcaccttcatgaggaatgactacactagcgctcttgcttagggcctgcttccaggggaacctgaggtaagataagggcatcctccaggtgtcattcatctctgcgtacacagtgggtgctgatgaatctctgaatccagcagaaatgagccataggaacagcgcaggggtgactgtcaatcaaggcaatgacgtcagtgggctcaccacgtgggtgggtcctgggagcaacgagatagaatacctgctcccttccacatctggaagcatccacagccacactcacacctctgtaccttccccacctaatgtttagtcaaaccttggcaggcacagaggagctgaggtccagggtcctttctctatgagctgagaacaggttagtgttgtgttttgagatccttttatgaataatggttgagaagtgctgctctttagtactaagaatagtggttattcctagtgcatttgactcggagatggggactattccattgctctatttgtcccacactcggtacacagttactgaaactgtcaccgtgtcctatattccataggccattatgtgtatttcaaaccgttatataaatggacttgatttggcacttctgaatgtcattaaactcctcccataccagtaacaacacagtttccatagaaacgaatacatttcagaaaggaaggcacagggaagaaagcagatggagttagggggaaaacgcggccccctggttcctacttccagagcacagggcccggcactgtgacatgagcactctgtggaggtggggcaagctccttcaggtttttattgactccctttgataaaagccctggataattcatctcagcctgaacctgctcattccagcgcacggctctaaaaactttatggcaccgcaagccattaagcgccttcgtttattccaacttctctggggctttcttcagaccctggggagagggctgggggagggtctcagcactcaaagaattctgtgatgaagcctttgaggctggctggggatggaaggaagaagcagagagaagaaaggaggcctccccggtgcagttgacatagtggagaccccaggatcttgccagtggctgctgtccaagtcactgggtcccctcgtcatcagtaaagctagaatgcgaaaactgcagcctcctggggtggaagcggtgtggcgtttggagagcctggctgaggagctgcccaccgcctcggcaggctgcaagtttcttgtctttggagggattcaagcataggttgcaacagcctcttagaataaaacatctcacagggcttatttctccagaagccatgctggacactcctctcctggcctacagtgtgattggattctccttctctgtttccaatagctacttattcatacccggttaccgcaactgcgacattgtattgtagttgctgacgtgtttgtctctccccgcaagacagtggtatccttgggggcagggactgtgtttttacatgcacagcgccaggcacagagcgggtactggacacatggttggtgaataaatgagcattccgccgtgttcacagtctttacacacactggtacttggcagggatatggaaccagatgacctttggtcccttctggcctggagaatctgtaatgataggggtctaagcctgccctgactacacccgggatttgaatctagatttctcctactcctaagccacagggttacgttaagaatattagtcgcacgcctgtaatcccagcactttgggaggctgaggcgggtggatcacccgaggtcaggagtttgagaccagcctgcccaacatggcgaaaccctgtttctactaaacatacaaaaaatcagccaagtgaggtggtgggtgcctgtaatcccagctactcaggaggctgaggcaggagaatcgcttgaacgcgggaggcggagcttgcagtgagctgagatcatgccattgcattccagcctgggcaacaagagcgaaactccgtctctgtctcgagagaaaaaaaaaaaaagaatattagtcgcaatgataaaaggaaaaccagaaccaaaacagccacaaaaacagctgggtgtgaaatgttggagaaaactctccccaactgcatttttcctctacactcaccacaacagtccacacaggagacctctgtggccaaacaggtgggagcagcggacaccagctgggtgtcctccaattcaattctgacactgtctacctggagatagtgtcagatcccacaggctgggggctcagtccccaagacttcccccacaccctggcacctgtcacaagttcaggcttccagaacttctggcagacccgctgcaagttgggggttcccaagaccttctgtttgggtttgattaatttgctagagtggcacgaagacctcagggaaacacttacctatgtttacagtttattctaaaggatattacaaagaatacagatgaagagattggggggaaggggcaggagcttccacgccctccctgagtgcgccaccctccaggaagctttacatgctcagctgcccagaagctcccgaaactcagtccttttgggttttcatggaagcattccttcccctagggtgtgaggcgggactctctcagggaagggtcttaagacccacaatcagaaagtggtgaaaggttagagtcctgcgatggggcaggggaaaggagggccggagagagatcctgtttcccgaggcctgcccctgaggcctaacacacccaacatatggcaaaagactgtagcaagggctatgggagttatgagccgggaaccgtggatgaaatccccccaccccatgcgcctctatatagaaacatgtctagatacatcatcacgcctcaggccatgccctgactttcaaccactgatcccttacagcaaaagaatatatatgatcatttaacaattagtccagtgcactgtattgcatgaatgtctcccagggtgaggccactcaggtttgcaggcttttttttttttttttgagacagagtctcgctctgtttctcaggctgagtgcaatggtgtgacctcggctcactgcaacctctcctgggttcaagcgattctcctgcctcagcctcctgagtagctgggattacaggcatgcgccaccatgcccgactaatttttgtatttttagtagagatggggtttcaccatgttagtcaggctggtcttgaactcctgacctcaggtgatccacccgccttggcctcccaaagtgctgggattacaggcgtgagccactgtgcccagcctgcaggctttctttagatttgaagaaaagattccaaaaccaggagtggtcccagcaaacacagcttcccccttccaggcatctggggataccaagcaaagagacaatgtcctcttttggttcgagactctttccagttgttaatgtagtattggatttccttcattttataacccatttttcgtttctttactctcaggtattattcctcattttctccactagtcgtttattttttacctgcacttttccacctttggaagggacattgggttcggccactgtgtggtccagatggctgctggcagcactagtccagccagtgcctcccctcagtccattaccattcatacccgggaaggttacgtaagttccaaacgagtggactattcttaccaccaggccccctagttggatttactcttagccctaattttgctagacagggtgaaggcacctcccacccccatcagggccctaggaattctgacataaggtttaaaaacacagtgacagttttttgcttagaagttatctctgtttccagcacttgtagttgcagccctggtcccgggatcactgcatcacacaggggagagagaaaagtttttttttttttttttttttttttttttttgagacagagttttgctgttgctccggctgaagtgcaatggcacaatctcggctcactgaacctctgcctcccgggttcaagtgattctcctgcctcagcctcctgagtagctgggattacaggcacctgccaccatgcccagctaatttttttgtatttttagtagagacggggtttcgccatgttggccaggctggtctcaaactcctgacctcaggtgatccacccgcctcagcctcccaaaatgctgggattacaggcgtgagccaccgtgccaggccaagaaaagcttttttttttagctgagttgggaaagaaagaaaaaaatagtcattataccagtgtactccttccttagcaagaattgcatagttatctagcatccttcccacatcctcttccccagatcagccagaaaaacagaggaaaaagtctagtggggacactagtaccactcatggtgtgtgtgagcacactcgtgaaggcgtgcaagccagcccttcatgcttttatgtccccattttagacaaccaatatttcaatagcctgttgtatttctctatcaaattcttactctaaggagatctctctgaccattgctggacattatgggcttacagtgtgtcccttggtctgaagaaatgatggtcagctgtccaaatgcatacaatatcttctgttccatttttttttaaatgacactctgagcacttctatcttctactgagtaaggaaagcccactccagagtcagtgtctattctaggcaagacccatttgtagacccgcagcaccagtctcacttgctagctgtgtttagagccttcccactagggaatcttccacatagccactggcagtctctgtctctcttgctggcagacagaatagctcttactggcattatgtgcctgagagggtgcaaagggaacatgtccagattcagcccatctctacactgctgcggtgcctccatatctacccatttcatgagcccaggtggccacctcaagggagcagctggggctatctgcgtgtcgattcccgtcaccttctgaaccttgaagggagttcttctgatgggaactgacttgttctgctttaatgcacccctcaaatttccatagggctgtgctccacatgggcatcccattaaaaggccaggtttccattgcccttctgcctggccactcggccaggccattggtcactgcccatgattcagtaaaacctaaacacagaggcctctaccattgttcatttttttccatcactattaggaaaacagcatgcaattcagctcatatgcagacctgtatttaccttgtctgatcaaagtagtaaccttcgaaacaggttggtgtccattcacattggaactgctgtctgtcaaccaaacagctcctgagtcaatcaagagctgttcataatgcactgtccacgtgttgatcgaatccagcagcacctcacacagttccagagtcagttctagggggagaagaagctccctgcctgagagtgtcttgtccttgaattccacaggcagcatgatcctctagaaaccatttccattttatgtactcttctgggcactgctgtccccattagaatgtttctctgacatcaccgaagacaggatgagtatttcaggtgggtcctgcgcacccaccttccaagacagctaaggtttcatagcaaggcagtaaatgccctcaagtggaaattctctagtccgaagtcctagcagttgctgctgggaggtgctcagaggtgtttgccataagccccaggaattgctccatagaagtatatggagtcttcccaagaggaggtaaactttctggggaccaagacaagtgcccgctgcctgtgttactctggatgaatcacatccctttcctgagtcttggtttcctcctctccaggtgactgccaatgtttcttttaaaagtctatgattgtcaaattatccagtcccagcatcttggagctactgactaggggcagagaaggtcactgtcctcactttgctgacaacatctatgcaaacactgtgttgggctcctgggatctaatggagaccaaacagagccaactgactggtaggggagacaggtgttattaacacaaaataactgggctcccagctaaaccccacccttaagcctggaactgcagcccttagtgaaaacaggtgactcaatttttctcccaattgttgcttttttggcctgccacatccctatcctgtgcccatgaaaagacttcagctggcagagtaacacaagcggctgagcgtcagggatacaagtggctgagtggtgagcagggcagcaactgggcatcggagactatggatagacgaggctaacttcagacagtgcagcttcagggaatgattgccttcttcctgcaccatcccctttccaactcctcattccgccaagagccccttccatctcccaataaaatcctccgcatacactacccttcaatctgttcatgtgacctgattcttcctgacactggacaagaagctgggtgccgagagggcaggagcttggacactgctgtggggccgcacagagcctgcttctgccagagatgagtgactggccggttccagcgttcattccctctggttcctgcacttgcttgctcacacactccctctctcaagcagtggccagaggtaggctgagtgaaacaagccactccagttcccacccacaaagagggtcaaggttaagggaattatcccatctcattagtaaataattgcaatatgaatgtatatgtacaaactgaactcagagctctgaaaggaaggatctggttctacgggagcatgtgacacaggaactggatcttgactgaggagggatgggtcagtggaggcatcactggagcagagacttgagctgtgatttgaaggatgagcgggaattaccaggtgaagggtttggggatggggtgagcgtggcaagcagggtagacacagggagcagggtagacacaggccctatgacaggggccctgcttgaggagcagcaggaaggcccatgtgactggagcgcagggtgtttaagggggtaggatgaagtcagaggtaggtaggaaccagatcacgtggcaccttgtagaacatgctaacaatgtgagcattttttttttttttgagacggagtctccctctatcactcaggctggagtgcagtggcacgatctcggctcactgcaacctccgcctcccaggttcaagtgactctcctgcctcagcctcccaagtagttgggattacaggtgtgtgccaccacgcctggctaattttttgtgtttttggtagaggtggggtttcactattttggccaggctggtctcaaactcctgacctcaggtgatccacctgccttggcctttcaaagtgctgggattataggcgtgagccaccgtgcccggccttcagtatttttttcttaaagccattgaaatattttcaaaaggaacatgacatggtcaaatttgcatttcgaaacactgctctggctaaagtgtggaaaacgacctgggcatggggattgggcatgatagatgcaaggagccagttaggagagccctgatgcagtccaggggagagaggctggggacagggtctagggtggtggcatgagatggagagaggagggtgggtacaggaggcactcaggagataacatccctaggacttgctgaggactggatatgagtgtgagggaaagggaagttataaaggaactttggctgggtgcagaggctcctgtctgtaatcctagcactttgggaggcccaggtgggaggattgcttgaggccaggggtttgagaccagtctgggcaacatagtgaggcactgtctctacgaaaatttaaaaaattagctgggcatggtggtgcatgcttgttcttctggctacttgggaggctggggtaggattgcttgagcttaggaattggaggctatagtgagccacgatggtaccactgcactctagcagaatgaaaccttgttttggtgaaaaaaagaaaaaaggaacttggcagggtctgcagcttaggggtccacagtctaagagaggcaggactcctggtaggaggtaggaaaggtggctggaggaatgggctgagaaaaagctttggaatgttccctcagatcctggctggagagtggaaacggcaggtctcttgttccaagacactgagcgaaataaataacaatcataaagtgccctgtaaatctgactcttgccataaataataaacagggatattatacaaataacgggctttgcagccccagtggaagaaaacacatcagtaagaaaaatgaatttagaaaaaatgcaccccaaagccccaactaacaaaatgacggtattagccaacatcccgggggctcggcaggcagtggaggaatgggctcaggaaaatgactgtggcccttagcgcgagccagactgtacggctgcaacagagtgagaagtgctgccggtagcagggaggcctgctcatccctgggtcaggtccccaggccaaggaccctggcctgctgcttcccctctgccctgagaaaagcacagctcatcccacaggcctgcccgactctttccctgccacccagcatatagctgatatggcctgagttcacccttaatgacagatgggagaaagaaacacggatccaccttcagaggctgccaaggaaagccagtctattgacttttttgtactggttcctttggtgaccaagacatttaaaattatgggatgggctgtgagaacagggtgtgggctgggtgttgagatccaagatagatttttgaatcatcacattttagagacatacaggtcatcttatgaaacatgattccattttgcacatgagaaggttgagatcttagtgtctagggacttgcccaagctcacacagccggctcctcactcttaagtgctcctcccactacacatcccagctgtggggcacctctctttctatacgaggaaacagtagaagctttagactcatttttttattagtgtacgagggtgcataaagaacaggctctcacgccatcataaagaactttagagctgtcgaagaaatgagattctcaacctcccagggctctgactcccctgtaaggctgggaagtgaggacaggtgctgtgggggaggggcatttgcacacagagcctggactgggaccacagtgctgttcgggagctgtgggccatgcaagaggctgctagttatttatggaaccagctttccccttcctgggtgctccagctcttcccacacagggtagaggtctccagtcagcaaaagctgcctttgctaatcactcacaagtatttcgtcctgaaagatgaaagggacagcacccagaggcatttctgctctcccttggtctcttgaagcagacatcattgcaatgctgaaagtccacggaaaccgacacccaccctgatgggcagcccaagaaggcaccagtgtgagggaggagtaccctcctgtgcaggcccccctctgccccaaggggatggctgaaggggaggtcaaaacttcggtgcctctgcttcttccctcctttaaatatcctcttcctcatttccccttctcaagagtcctgtggcctgccagcttttctggtcccccaggaatggtcttctctggtctgtgtccctcactccaggtctcccctgattttctgcaaatcaactcaagttttccctgtgttctgccctttcttctccctgccttgccacttcctctctttccagccaccctgaaaaatgaaaccaagctgaagtgttagaggctttccctctgctcatggtctcagcctcctcttccagaagtctaagagccctgggtgtctggagccctgggctgtggtcctggctcttccagccacttcatatgggccccgggcaagttgctgcatgctcttgggccatgctgtgttattgggttgcactgtaatctctagagttgttgacaggtctaacatagaggaggcctgagctctctgaggcaggcacagcccctcccctgatacatgtgacagccttctactctgcctgggaataggatcaggtctggggaagccatgtgctttgagaaggtgagtggtctggatctccaggagagagaggtcataaagggggagggccaggaaggggaggtgaaggttgtgtgcgtgtgtgcacacatgtgggtgtatgtgtgcatgtgtatacatgtgtgcaggtgtgtgcatgcatgtgtgcatgtatacatatgcatgcaggtgtgtgcattgtgtgtgtatgtgtgtgtgcatgctcatgtgtgtgttggagatgtggctgaggaaccagtgagagtaaactggatctacttaaagatgtcctgagagcatgggctggcagtaggtggggtgaggaaggagagctggtacagaaagaagggaaactacccctggggaaggcctcctcacccagccctgcttccacgacttgcctggaccctactcccaggaaggggctgtagcactggaactggaagaaagcctgagagtgagcaccaaggtagactctaggaatcacccaaaacagggagaccattttgtggactgttccacatctgtgtgctctatctgaggcgctccttttcaatacctacctgacacctgtggggactttgtacattcctccattgtcactcagggccctagttaattacctaaatgaaagttgagcgactactccctatgtgcaagacactgggcgaaggcccagggagaggagaggaaggaacaggagtctttgccctcctccagctgattctctacatgggactgacagcacatgaggaagcagaccaataaataatcacacatcatgataggtgccactcgatacacacaccagctgctgtgatgagcacagggtgcagggagagggtgtctgtgtaatttaggtagatggaaggcaggatctctttgtggaggtgacacatacactgagatgtatttttactgtgagctccttgagggcagaaaatgtgtcttactctacttttttttttttagatggagtctcactctgtcactcaggctggggtgcagtggcaggatcttggctcactgcagcctctgcctcctgtgttcaagcgattctcctgcctcagcttcctgagtagctggggctacaggtgcgcaccaccaaccctggctgattattattatttttttttgtatttttagtagagacagggtttcaccatgttggccaggctggtcttgaactcctgacctcaagtgatctgcctgccttggcctctcagagtgctgggattacaggcatgagccatcgtgcctggcttgtgtcttatttttatagctccagtgcttagaacaattctggcacttgtaagaaattggtattatttttatggtattcaatgactgtttgatgaataactgaatgatcactcatcagcagttcctatataaagcacatgtgcttaatcacatgaagacaatgatctcaaacaaatgtgatattgttatggctagtctgtctttacttcctcctttcttgcctgccctttgttgatttctgtttgtatctccttttgatggctcaattgtgttgggtccacacagtagaggacacacacgcacacacacacatacactctccatatattaccaaccacctccattcctgcaaagactgcagattctatccacgaagctattaagcactcccaaatagagcaaacctctcattgactatcacgtgcctccttaaatgatctttgaatagcattttctttttattgctttgtgtagtttaacggcaccaattgcaattactctaacttatgataaaccccagatctataaagctcctgttcattcattattttcctcttgctccttctcaagctgttattttttggaatgtagtgaggagggaggagtggagagagaagaaaataaaaggacaccaaattaacaggaaaacaaataaaatagggaagcacttctccctgggtgacaggcaccttattagatactgttaaacagaacaaatatgctttaatacagcacaagtaggtcttttatatttattctaaatgggaaatacaatgatcatcaacttatctttaagggaagaagaagctaattgttctaatatctcactaatcctagcaactgggagaaaaataattgtttttccctattttaccaattgttcaatttataccaaggtgtgttgtgtagcatggacagagatttctatttcttgatgtatgtcatggctgctattccattttaattattaatatgtggaaattataattattttgagtattggtatgagataattataaatataaaacagctccgcatgctttctgatgcctttcttatctgcagacatgttggagtttgggcgtatgagctttagagagagagaaatgtataatgtggtacttagggcagcaaggctggctggagtggaagaagaggagcttcctccctccagagccctccctctccttcacctctgccttccagctctccagagccaaagctgacccacctgtgtctctcctctgccccactgcctcaccctcctcttaccctgtctctgagttgttagttgagatttctaactcatcacacatgttggctcagcttgcatcccatcccctcatctcctcagccacccagaagctgaggtcagatatctggagctatgggtttcaattccagcccagctcctgactttttggcttccccaatccctacaaacctctttcgagcttctctaatgagcatcgccagcaagagaacatgtctattcagcaccacggacagaggcacgctgtcagttcccacaaattagaagttactgcctagcagtcttgtcaaggcagtggtgttggggagggaaggggaggctgagaaagagaaaagtcagtaaaggcaactgactagcaggacacagaaaatgcggcccccaactctggttgtactcagccatggggttcctacaaatgggaagtagctttttgatgctgttggcttcaggcaggcagcaaatgggggaggtgatcacttcctgtgcttaattgtgctggcctaactcttgtcagattgtcaccatgatgggtgctggaaacaggtccacagctggcaaagtctcaggcatggggagcgcatggggatgtggttgtcgtggtcggggttgggaggagagacagctgaggagcttggaaagagggcactgagaccatgctatggggatagagatggtagaaagaagcttcctccttcttgctggaatgggaatgaggagacatgggccctgggccctggaaggggaggggtccagcccatggcaagcatggctggtgggagccaaggcttcatttgtctgactttaatgaataaatggcatccccagccattgtttatctacttttgaatcctgacaaatagtctgtggcatctgatggagagggttattagctgcatggagacagatggctagggatggagaggattggttctttattacagcagacccgtaagtgacagcactcctcctcccagcctctatgccaatgtcaacacgtttctcaagccttcagtgacccaatgaagccagtgcaagaggaagacagaatggcctctgagtaagagggaggggtagggtcagtggagttgggaaagggggcaggtttcctagggtaagttctttgggaataaagacattgccatattcttctttggtattctcctaagtgcctgtatagtgctgtttattcaacaggcattcaagaaacatgagtgatggaggaggcaagtagagaggtctggattagaaatgaaaataggagcagatttaattgggctggctgtggggtggggtgcggaagaaatggtagggaagagagaggaagagaagtaggagacacaaagggagaagggaagattgcataaagaaaatgcccctgaatcagcatcctgtgtttcaggcattcactatgcttccccatgtgattgtacaaatggcttcatggaaaccaaactggtcttcccactgtccccttctgagaggtcccaggttcttattcctggttcctctgtcctgtggctgtaggggagagcttcctccctccagattactcccgagacaatggggaggttctcactgaccttcattcattctccgaaacttgtccttggccatgtagcccagcaccagacagcatcctctcttctggaggcccagctctggaagagaagcataggtgggtgagttgggaatgggaacaggtcaggcattgttggggggccctctgcagggggctgtggagcttgttgctcttataaacagaggtgcttttgtttagccaacatttatatggaaattgttatgttccaggcataagtttaagccagcaattcttcattttgattctcataacaaccctgtgaaggatgtttccccattttctatcatccccatttatagatatatgaagttagtggcactggatgaaagagctagcaggtggtaaagccagagctttgaacctaggcagtctggctctgagtccatgctcataaacataactctgggttattgaggccctttgtatctcaggcttggggactatgctcagatcaacttgggactgtggccagacctgccagggatgatgcagaatctatccagtcgtgtctaggatggaacagtgcaaccagacatggtgggtgactcaggaggatgaagtgattgcgtgagtttagggcagcggggcgacacagaggttaaggtataggcagaagagctctctctaccttttggagagggtgcgtttctggtgctagagattcctgtgccttcctatatcaaggcccaatttagcaccatcatcaagcacttatgaaatgtagacttagagcacaggggtcgagatagctgagagacacggactccacagggctttgacccagttggaaaaacaagatggaataacaattccaggtagcaaatgcaagagataacttttttatttgcacagtattttgtaaatcagtgtccattgtgtgtgtgagcattaaattggagtccatctgcctcacaagaaggcaagctttcctctctggtatttgtgctttatcctgattcatcttaatcactttatggatcctgaagcaatagcacactaatttttttgacccccctctacccccaaacaactcactgaggtgggcatatgggccactgcaactgacattatgcagatgggaaaattgaggttcaaccatgttaaatgacttcccacgattgtcttagacccccaccccaccttgtagcatagaagtcttacaaatgtgtcagctgccacaaacttggtaaatagataaggaatttgatttctggaagagggaatatgactgcagctcttcctggcccttgccagggtttctgggctcctccctgctccttcctttgatttctcagagaaagagggtcccaatgagtgatgcatcacagcaccttctcccacgacaccgactgcctccctgaacccagccagtcagtgtctaggctcaagaggatagacggagcgggtcattcctctttctcctcttccatccaccgtctgcagcccaggtccacccaccaagcatagcaggatgaaagagagtgcagggcccatgagacacagataagtcaagctcaggggctcttgccctagagaaaaacaaaacatggcaggaggtggcagaacgccacggcccagggaggtccctggctttgatctcctgattctttaaaggggtttattgactatcagtaaagagcagagaagcagatctgagggcactgtttccaaaggcactcacttctcttccttcccctccacactggcgtctgaaggcttagccaaaccgccctcacttcaaacggtcttacatctcaggcacccaaattgacgatgttaagttccctcattcaaggccttggccctttcttcaggggctcctgctctgtcgcaggcctcatggatcaaagcccctttgatgtttacttactgtatttgtggattctttctaacaaccaccttcaagaggcaggaatgcagccttccaggagggggccagtggaagtacaagctgcgaggaggtgctgagctccctggaacaatagcctctcgagggagactgtattgaaacctcaacacgctgacgacaggcagagttaaccagcccattgtaattgcacacgcattgttcatcattagaatgatacaattgctgacaattcctattatatttttgccattgacttcgtatgcccatctaaagcacatcagcaatggctcctaatgagaaagggagtttgggctcctggactaagcccaaactcaatccaggagcttgggagggaggcaggggagcactgagtagggagggcagaagatactggatggatttaggccaatgttccagctggtcttctggactgtgactgaacgctcaggcaaatggaagggcgaacaattctcttacagatttagagagtgtgagcaatctgttgactctggattgtcttagttggatagagaactcaacctctcctatgccacatactaggacaccccccagggcaactgcttgaggagaggctgtgtggacaagtggttatgatataataactaagagtctcactgattatgtttgatttttgcaaatgagcaggaaaagaagttttaaaaaacctgattaataaaagaaattgagaatgaggcaatttctcaatgtatttggctcatttaatttgacacgcgtgggttagtcttaattatttaggcggctacgttacaaggcgctaataagcacactgcagaaatttattaagtgcgagggctctctgactgagactttgtagagaagtggggagaagctactgggatctttgcaagaacgagcaggttggaggatgagtgaagtgagaattagttaattgtccatatatgaaaatttgggatgtcctttggagagatttgcaaagctaaattaaaggtcattgggttcacatgagtgtgccagcagggagtgaagtgggggaagggaggggatgctggaaacccaagtggggaggtgaatattgtccaagctactaaccacagagagaaccaggaggaagcaggaggcaattgctttggcttggggagactctaccaagccaaactaactaggttattaggagagagatgatagaacatgacagaaagaacaggaatctctctctttgtgaggtagatcagccaccaccagactgtcaccttccttgtcccatagcatggagatgaatgggagagtcagatcacagatgcacattttggaacagtaagatgatgggatcttctccaagtaggctttgggggtgctgtctttggctttatcagtagcagaaacacccagatactctaaagctggctatggaaaaataattaccatgaaaggagtcagccctggcttaaaaggaaagttcatagcaaggaagtccagggtcacctgcagatggggcagtggagggcactgtcccaggaacaaggaaggtttaggaataccacctgtgcaaggaaaaatggattggagtagggtatgtttcttagggagaagataagtttgcacccttgggaactcctggcctctggactctgagcaactgaagtgtcaggactgtgccttctcctgctctgagcccgtaggaccaagcacagtgcctgacacatggtaagtgctcaggaacagtctgctgacttaatgaaagggctggctacaaaatatgggactgtgaagggttccttctgactcgggtcagaatgaaaataagtgggcttcactgtagcacaatgggtttaggttagcagaggttggttgtagagtgaatgaaacttgtagctcattggaagagaagcctagataacatagtgggatttcctcctgggagaaataaaaggggatggctttttaaatgggatgggttttcttccatttcagagggtgcagatgggatgttttctagccttagaattccttcattcttactagtaatgtagtgatacggtggtattatttcatatttgtgggatacttattttttaatgacgctgtcatattccctttctctttagatgctcacagtaagtagctctgtgacacaggcaagtcagaaattatctatttcattttggtttcacaaactgaggctcagaagtaaagtgacaatttaaggccaacacactagctggtgatagtgcccatgctggaacccatggctgatttttggcttggttcttagggtaaagtacggggtcgcagagctgcagatgctgcaaatcaagacagaccagagactagagcacagatcagcggtgtgggctgggacagtgctataggtcgaattcctcaccaattctgtgttcccctcctgcaccaaattcgtacattgaagtcctaatcccagtccctcagagtgtgaccttgtttggagataggaaatttgtagaggtgatcatgttataatgaggtcattaggacggacctttatcctgtgactggtgtccttatgaagaggaaaatctagtgatagacacatatacagggagacgctgtaaaaacttgaagacagccatctgcaatccaaagagggtgcctgggacagatccttccctcccagccctcagaaggaaccaactctactgactttggacctccagtctccagaactgtgggacaatacatttctgttgtttaagccccacagctggtggtactttgtaacagcagccctagcaaatgaatatagacaggacagggaggagtgggtcttctctgaggcctggcaatttccactggccatggttctctggaacccagcccccagagcacaaagctgcctgcagggagcagcatcacactctgctaaggagaccccagggtggctaagatctgttgggagtggcggccacaagtgacaggaaagagggaaggtggggagagaaggctggttacgtgtctgcatgcctggcacccagcggcaagctgggatgccattagcattcctgcttccagggtgaggaccgtattggccaggacagcacttgctggttgcctggttgccctgttcagacattaatgtgccctcaagtaactgcagatggagccggtgacaacggataggcaccagcctctgctacctcaccatttctgaggccatcaagtgcatctggatggctgcttgtagaaggccttcctgtcctgtccccaagttgcccagtcacaacagttcaggtgtgcttgctgaagactaaccccttcccacctgaagctagtagactcgagcacgtctctggaagcctatcaaacaagaaacagaaattaatggcaggcagtttggtgtggctgtagcagaagaaaaaagatgagacaggagatctagccagggaccagatcctggagtagccaatgagcctcacccaggagtctgggctctctcttaaaggaggtgggagccacgcagaatgctaggcaggggaaagacaggtgagacttgcatttcataaaggatcccttcagcactggtgcagatgatggatgggagatgagctcagagaagggaggctggctgggagaccgctgccatactccaggtgggagatggtgggcttgcatctgctgcttcttcctgctctctgaagatggccagagatcagaaagcaagggaaggaccctcagttttatcctgacattcatccctgccacgttgacatagagagcaggggaggggctgaaaaaatagctcccattccccagacagtgcctgagatcatctggaggagacaccagctgggtttggttggactcacagggaggccacatggggcaggggaggtttcagaactaacagagctggctggagccatgctccagcacttaccagtgagcaactcttaggcttctctgagctttggtttcctcatttataaaacgttgattctaacggtaagaccctcctcacatgattcatatgaaaagcaaatgagccaacacatgggcaaaagtgcccagaatgaagtacctaataagggtgagttcaataaatagaaacaaaataccaaattctacccccctcgtttttttctttttcagatatgaaagtggagatgcagagaggtggagtgagctctccagggtgatataatgagctattaggttgcatacttcccaggttagcacgtagccaacagtgacatggactggaaatgtgaggccagtcaggaagaccagccaggtggctgtcatgggagaggccaaggaaccagagagcttgggaatggagaggaaatgatgaatcagagacattccaagaagagacagtggtgctaagtgacagagtgggtcaagcagaggaagagggcaaggatgaccccagtgtcttttgtgggatataatggacaaagagacatgtctgtatcagagtagggtgatgacaaaggaagcctattaagtcacaggtgataatggtacatttctggacttactgtgttcgaggtgacaaggttctaaagtgaagaggacttggatgatcatgtgagaaggagttctaggctgaagaaatatttttaaccagttgcgttgacctcagagggtaaacattttgttgggggaaacagcagttggatcctgtgggtagactctgctacaagcattaatcctacccctctggaaccaggacacattaataaatgtgactggtgtaaagtccaaggcacagacactcgcaaagaggccactaagtgctgggcactatgtgcaagagaaaaaaatagtaggcaaacttcctagcccaaagatactataatccagttggctatacaagacatatacttaagaaaaggtaactaaaagtcagagacaggtaatagttcggtaaagaaagtcttgaggcagcacgcaagttatttctgcatgaatggcaattcttactgcaggagtccccaggaggaaaagacagcttcaggctgtgggatggtgagggaggtccttgcaaaaggccttgaaagctggagattgtccctagttttgtcttagttttggatgtctaccaatggccctctcattggtttttgtctatcaatagccatcagtagccattctgcccagcgatgccattctgattgcagaatgatggggtcttctgtttggaaagttttcactttgattctgctaaactgctttctgcatcggttctgcctactcctattttcagcataattactcatatcccaggcaataataatgcccatacatcatgcaaagatcataattttctgatcaacctctatcataaagaggactgaagagtggagtagcaaaggtatattaatcctgactagtgcctggccctggacctccaggacgagtgataaatgtttaattagcccaataatacctgttttataatttttggatctcattgcttgctaattctaagtttactaaataactataaactttacgttgttgtaaagacataattgcttcttcattgcttatttcatatgagttaattatactagaactaagtttttccccattcatattatcaattagttgttttaaactattgatttgtatttaattaactatgctattacataccaattaaattcatataagaggaatctgaaacagctgtggtcttaaattacgtttttgaaataatgagttctataacatttcatgtcaagttattgtcagttaggaagagttgacaatcatttgtgataattccaaaaacttgttgtgacccgccagcccatctcaccagctccagcaggcagcaagcctccctcacacacctgctgatcacgtgccgatcagcaccttacagcttggtaagcagtggcagtgcctaacactgggataaccctttgccagccctgccttctccagcctgctccagccatgccattatttggctggcatagctctatcccccatgcggccaaggcaggcattatcagcaactcctcaccaccagctgtggggtctagaattatctgtgctgctatgtctcagatcctgtgtgcctgcaggaaatctacatgcccatgtggtcatctatccttcggcttctccaaatctctgctcactggcttaagtctgtacatctcaggtgggaaaaaagacagcagtcatttgctgagctgcaagggacatttaacttttctcatctcgtttcaccctcacaacacctttatgatcacaggtgttattctccttgttgttatttagcgagagattgacactttagaggagtgaggagtttgtcctgagtcccacagctggcaaatggtgaggcttgccgtacacctccatgttggtgcttgttggtgcgtcgtgccatgctctgtctccattctctgtgagattcgactcccaaccaattcggagtctcagccctttgggctggctttttgataccttgcctagctcttatcatctttctctccttggagggctgggttcctcccctaccctcagacactgcctgggatctttctcccaactgatgaattgcctggaattctgacacagccatcagctttctctggggcacttggccatcaacatgggacccaaggttggcagagctcaccccactcctctgtacactgaaagtgggacactggttactatctttgggggctgggtgcagcccagccttgcccctctcccttggccagcatcaccaagtgtctgccacctgggaccaggctcatgtagttcaccatcacaatgaaagctgccatgtgctgattgcttatgcttcattagtctctgggctgagcactttgcatgccttaccttctttattcctcatcaaaactctataaggtaagtgctgttattattcctatttgacagaagggaaaccgaggatccaaaaggttacaaaacttccccaaggtcacattgctagtaagtgctgaggttagtaaagctaatcatgaatgagattctttggacttccagtataatccgtttgtgagaggggtggggcggggggatgttaaataatgttggttaaagaattttacgggaaacagttttatcccatgtgcaaggatgcctcagcccgtctctgatttaacgtatctaattccaatgagttacttgctaggtgggggaacagagaaataggatcatgaaggccattcctgtcctccagtctgtcttccacacaccctgtgaggaacaggggctgccaaaagccatatgcctgagggctgttagacttttcctaacagaaagttggaagtcgtgactagtgtttgaatggggccagatgctcgacagctatgtgtcctacccctggggaggctcagcctggtccattcagtccatcatggctgggaggccaggcaggaaaaggcatttctgctttccttatttctagaaggaccaagagttcccaaaagactaagactgaaggcaataaggaggcaggcaaagtcccagcctgcctccaagtattcccttccccagcccctacagttctcttgaggccaagatctttgcaaagccagaggcccaataacaggttatacatacaagactgatttgtgaaattagtctttgcccagattagtgaatgtgtggattattagctttgctgtacaggtgaggctcagggaagccaagcaattttcctaaagtcacacaactgggaaatggacgacccaggattagaacccaggcccatttggttccagagcccaggcttgctgtgcccttcttccaggatgtggtcccaatgtcatgcacacagcccagctgaccagcagagaccccagtgggaagaggggaccccccccccgccaagcaggtgctgctgatggagtcacaggcatcactgtcaggtggtcaggagcactgagaagcccttgtgggagtgaggctcctggagagcccctttctcagggactggagaggcagggaggtggggtgaggtggggaagcgtggagaatgcctgcctactcagggtgtgcaggcagcaggggcggggctgctatttagtgatgggcttacaaaccttcttgtcacctatttatggcccacataaaactctgatcactgaggattaactgaagagggtcctagcagggccacacgctgactttaaagaattgatcactggagtcaggcagtcatgtccagcccctgccctcaagcccctcacatgctgccgaatgagtaggggtagggggagatgtctgctctcacttggcacaagggaagggggcagagagaagaacaaaatgtcctgcgagtggggagtgcagggtttttaggggtggagatgtgtgggctaaggtccagtgggctgggaatgccccctccacattctgggtggaaaagcggcacaggagggaggccaggggacagcacgtccttgcccccagccaagtcacagtcacagctgcctggttcacagtccagtgggcatgcgttgcctcgcggggtgggtcctgttcacccaggaatgctgcgcaccttcactggggtggaaggagggagggctctccagctctccttgctgtctctcctccctcacacgtttccgcagagaggactgtcctctagggcattgtaacttgggccaccttgggagctgaggctggtgaggagcagaggatgaggaactggtgagatctccccaacagcagagccaagcccaggcagctacccgcttcccccacccaccccagcccacacagcaaggagggaaagtaggcggtggggttaggagaggacccagcggaaaaggcagggaaccccgctgtcctcccattactgaaatcctccttgagccttacataccccattacgacgctgtatcctataattaaattgaatctgccagttacctctcagcacggcagcaattcaaactcattggaggctttgtttattttcatttatttatttatttagtaattatttatctagctatccagagagctagatggaggccctagcccaatgtttcttttgtcttcaaaaacaagaaagctcaaatgcagtctctcccacttcaggtcaagagaggaaaggaataacagagaccacagggtggcagcagatccgcggggggacctcttgctggggggatatcgctgggacagggttaaggtcaagattgcaggggaagttttgtctgcctgccagtcatggtctggaccctgctcctgattctacccattctattcttgtcagagatactttatggaaagtccacacattccagaaagctccatggaagccccttacaggccccagacaaggggcttcattctgagggactagaacatcggttgcggaatgtggaaaccaggttaactgagtattattggcaactaacacacctgcagagctttgcagttgaagaagtaaatacatgttcttctttaaccctaaacatttatggaggacactgaggatgagagaggttccacaacctcccttgctcaaaatcaccctgctgctaatggcagggctaggatttgaccacaacgcttggggtaaaaccaaactcccccacctccttcagagccccatatccaagctggtggcccagcaacaaaaatcaaagctcttttcttctctttaatgataacctttcagcagtgagtgggcaaaggagagcatgatggctttgagtatggaatcaacctcaaacaggtccaggggagcgattctgagccaccagccatcactcaataagaacatgaaagtttatttaccacgaggccagcccagtgggaggcagattgctactattagcatgccaaggactgcacagaccctgcacgtcaatagctgagccccagagaagtgaccccttttggggttatccaatctagcagccccaccagagcaaaggacgagggtggctgggatagtgtgtgcttacatgtgtgcacgcatttggagaaagggaaggaattccagacttgagatggctccttagacttaaatctcccttgaaaagaaaatgctgcttatgaaccacttccacccttgcctacctactcctgccaacccattcatttgtttattgatgagctgcttaatacttcttggaataggaatgaatagtacgagaaaatacctgggtccacactggcaattcctgggtctattctggaacaatcatgcttacaaggttttcggtgcacatgggaggtggggatcagtgtgtctctgggacctatttacccctatgaaccactggggttcttgactcaggctctgtcagtccacagagggtggttatggcaatgtggaggaggccggtggcccagggcctgaactgcaggagaatttatacttcttgttcatctggagaaagttctctggccagaggacacagtgagggagcctggtttaaaaaaaagaggcttaagctaagaagcccggggagtaggaagttctatgctaccctggcttgaagctttggacagtcggggcaggttctctcttggctcctgaggccaagagaagccagcctaggaaggttggaccattgatcccacagccctggggccttctcacagtagtgtgggtgtcacaaccacctcttagctcttgatcagagatatccaccttcagtctcctcaatgtgtacaatggagaggtcttgggctgcaataaggactggagataatgtatgtacaatactgggagggaagggtaaagagagttgtgttcctaaaccctgtctaaatgtatggaaccaaggccggacacattgtaagcccctataaatggtacttacttataaatataatatattattagaaagtacaggggtatgctaaaagtcaggaaaataataagatactctaagattagcctgaggaatccagttctgtagcttgaatagagactgctatgttgttggagttaatacccacagcagctcaaggaacagctttgttcagctctcagaggaaggggctgcctggtggctgtcctggggccgctgttccttctatcagggattctcacacccctctcaagcatcacatttcattcatagttcaagagcccccaagaatctcctctgtgtgtggccttctccacccctacccttgcagatgggcatcccctcctctggacaccaccccccgccaactgccttattcatacctcttcattcattcatacctttgctatgagactcccttatagatgcgaccacggttttgaatttttgctccaaccctcccagactgtgaggtgggaaccatctctattaatctctagaacctggctcagagccaggcacatagtaggcactcagtgcacatgtgtatgtgacgagtaactccacagacagggatgatctactctaatgttcaacagattaatatttgatttagcactgtgtgtcccttcaaaattctgggggccaagatgagggctgaggtctgagatctctgctggtttgagaatgggacttcctcctaccttcatttgtccttccttttacagaactataagtcagcctcaggtatgggtcagctttatgtagttaaccttccagtcattcaggtttttatctttgagtttattctaatttcattcattcattctcattcattcattcattcattcaaggagagctcactctgtgtcagttctggctgttatggatattgtgatgaacaagacagagaagaatttttgccttcccaagcttccattttagacagcttctatgtagttcctttcccttacacgtaatttagaggtaggaagtttcatgtgggtttgggcaaattattaaacatccctggacctcagcatctccatcttcaaaatgctgtcaccaaaccctctctcaggctggcagtgtgccacccaccacagcttggccttgcatggctggtgcttggtaccaccagttggtttgaatgtgggtgcacgtgcatgtatgagttcattaatttgcttcctttcttctcaggcacttagatttttgatgcacactgagagggtcctttttaatcagctgaggagcaagggattcctgagccacaaatgaggctctccctactggaatgcagaaggaaggacaagagatgagcctttactgagatgctgctatctgctgggcactttacacacacacagttatgccatttagtccacactgtaactggggagggagttgttgcttcctgtgcttctcatatgagaaaactgaggctgagagaggctcaagggctcccataactgaagacccgtgccttcgctgctgccactcaacctctgggtgggggatggggtgctcagtccacgtggaaggaagagagaaatagaatgtcacagagctctctttcaataaagggctcagcaaaatgtttgtcttagccgcgtttcctatcgacccggtgtgtggcacatggattaagtatgcagtttggtggtctttaaaggatgaacattttctctaggatcaataagctgagtgagtttgggtctgaattcatcaaaatgtcacctgaaacaaattcagtatcaggacttctgcgctcaggtcaggtcgatgggtgggggcagagacaaaacccagggaataccaggtctctgggaaaaaggtccagggcatctgttggacaaatttgggtctgataactcagagtggggagggggtcctagctggcaaccagcatcctagaaactaaccgctggcctggtacagtggcttatgcttgtaatcccagcactttgggaggccgaggcaggtggatcacctgaggtcaggagatcgagaccagcctggccaatgtggcgaaaccctgtctctactaaaaatacaaaaaaaaaaaaaaaaaagattagcggggcgtggtggcaggtgcctgtaaccccagctattcgggaggctgaggcagaagaatggcttgaacccgggaagcggaggttgcagtgagctgagattgtgccactgcactccagcctaggcaacagagtaagactctgtctcaattaaaaaaaaaaaagacactaaccgtcctttctctggtctagacgtcatccttaccttcagagagaatagctgagtgagaagctgtgtgaaactgcccagttctagattcttcgaacaaaaagtgtttttgaggttaatcagtgccattctcacacccagtgctaaaggattccccctttagcaccttggagaagtagtcacactggtttcccttggatcgttctaaagacagggagctcattactttggaagctgtggttttcatttttggagagtttaaataattttagagttcttctatgttgagcttaaatattccctacagccttgcaactttgcctcattagtcccaaatttgcactgtgaggcaacacagaatgagactaatccctcttccacccaactactgagaagtttaacagacaatcttttcttttccaaaataaacaacccttaggatgtttcggtcctgggatgcttgcagcccaggaaatgctccctccctctcccctccagcttctctgcaaatgcaagactctggcttcattccctggtccttcctcagtatctcacaaagaaagaggagggcaaaatgggaattcattggaagagatccttggttcacacgctaggaaagaaaagggatgatcttggtcttggcgtgaacttccacatgaacgtgactccgtgcctacctgctaataagagcgggagtgtggattgtgcacataggtggggacggggtgagaacttggggtgtggcgtgtccctgtgggtggacacattgtgaacagtaagtatcatgaatgtgtgacagcatgtggggcacgtgggtgagcgtgtatgcatgtacacaggctgtctgctcaggtcctgggggagggactcagaatccgcctcacacccatggagagttctcgcaatgggtatggcaaacttcctgaccaacaggcttctggacttctgactcagcaccagtcctgctccttctgtctcaatgactgtcccctgtccctggagatgtaaaagttccaggctctcctaccacacctaggctggacttactgattccaaggtgaaaataagccatcacgtattgaccatctgtcagcaagtatctaccctgcaaaatacttttcacacactctctcacttatcctcaccatgcctagagatgggactttgtctccatgtgacttatgaagacactgaggaccagcaaggcgagacaactgtttgaggccacacagcaacagaaccagacctcgatcaaacccaaagcccgtgctctgtccgtgtgctgcctccgagaagccatggccaagaaaggtctttgcaccagagctcaccaatgtctcggagaggtcctcccttcctgccagccattgatgatcctggaggatgaacgggtcgtctaaaacagatgacgctggtgcgggccccagggagttccaccaagagccttaggatttatcatgtgggagggtagttagttcccaaacgcaggtgagtataaaatccaatttcttaaattgcatccagggccaaggggtgcaagctgctctgtcagttatgacttcctcgggtacctgagactgtagctcctcatttcctaaatcctcctgcttgttgtctgagcttttagccctctgatttacttattagatttctactgtgccttttctctgcagagtgctcagtgtccccaggaaccactctctaatttaacgaataacttctctcatgagcaaatggggtccgggttcatgcaagaagccagtggaagaggagaactggggagacagagagtgagaaaaggggcagaaaaaacagggcagggtacaaaggaggcaaatgcaccacctgtggccctagagtggggagcattgaggttggatggcatttgtatctagagttgcacctggatctggacaatgcttccaggttaccactgctggtaagcaatgtgcccaaccaccctctctgctctcatgaccccctgcctctctccacctctgcgtgatgtttttctgttcgcctgtctgtctccttgaattgtgaggtccttaaaagagggagccaagtcattttttttttttgaggcagagtcttgctctgtcacccaggctggagtgcagtggcacaatcttggctcactggaagctccacctcctggattcacgccattctcctgcctcagcctcccgagtagctgggactataggcgcccgccaccatgccaagctaattttttgtatttttagtagagacggggtttcaccgtgttagccaggatggtctcgatctcctgacctcgtgatccacccacctctgcctcccaaagtgctgggattacaggcgtgagccaccacacctggcccccagtcatcttttaacacctggcacttgtcactgtgtctggtccacagtaggaatttaacacatacttgctggagaggccagttacggggcacagctgaaagcataaagatgcactgtataacatttcagcccccagaggacccacagttggggagacaaaggatagccaaagacaccatggctgggctggccagggaggtcttcgtggaggaggctggactatactgggccacctagaatgctggggactggtgaaccggacagcaggaggacattctaggaggaggaatggcttgagccaagggttcaggttgcgatgggcaagggggtccctgagtggaaggcaggacctgtgcagggaagtctagaaaggtcagtggaggcataccgtggagggctttgagcacagagggtggagcctggaatttcttctcctgtgatggagcctctagttcgccctggcccagccccatgtgctgtctggcacatttgtgcactgccctcctgcaggagggggcctggcacagtttctgtgcaccctggacaagcagggccacgtgtgggccaggactgctctgccctgtcttctcctctgattcaggaaggaagaacttgccctggactctgtctgtctaaaataacctcccctccccatccccacatggccctacctgttcccggaatttcctgttttttttttttttttcttccttgactttacagtctccgggttgcacttgaatctcaatggcatcatcccctttcagtctttgcatgtgcttcataaagaaatgactcttttgtgcagatccactgcctatggtgaagtaggtgctcatgtaaatgccaggtcctagctctggaaagggttagacagcccttctcaaaccatgcctgcaatgccagtttaaagaacatggaggcaggacagcagccatgggaatgaagggtggcagataaaatcagtgccccagaagctctggggcctcctctcattgattaaattttcaaatataattttgctatagttagtggggggtttagagctggtcacattatattgaatttttttttgagacagagtctcactctgttgcccaggctggagtgcagtggtgcaatctcagctcactgcaacctctacctcctgggttcaagtgattttcccacctcagcctcctgagtagctggggttacaggcacccgccatcatgcctggctaatttttgtatttttgtagagacagggtttcaccttgttgaccaggctggtcataaactcctgacctcaggtgatctgccctcctcagcctcccaaagtgctgggattataggcgtgagacaccgcgcctggcctatattcaattttaaaactttcatttatttttaaaattgaaactaaaagttgtagatctatttatggtatacaagacattttgataaaagcatacattgtggaatgaatacatcaatgaattaacatatccattacctcacatatgtatcattttttttttgtgcatggtgagaacatttaaaacctattctctgagcaatttccaattataggatacactgttattaactgtaatcaccatgtcctgtaatagacaggagtctcctcttgaaccagggttatgtctcagaaccagagtaggaggagaagcacctcacacacgagaggctctgctgtcctgacgtggcacggaagggaatggaagggacaaggggaaggtgctggaaaggggccagctatgaactgagcacaggtaacagaccacacctgacctcctggatccctagttacacaagggcatgtattcattgttccattccacagatgggaaaacagagactcctggggcttaagcagcctgcccagggtcacacggctatgtgacagaagggctggaacctagatcctcccaccccaaagccaggctcctccctgtgatctggccctggttttgcctgtgtgattcctctggccttactgggtgatactgagccaatcgtggagcctctctgggcttttgtcttctcatctctcaagcgaggggcatactctcaactgagcattctttgcatggcctgtcctctcagtcaggccagaccaggaccagctcctgccattgtgcattgcaaggatgcactgcttgctagtgggcctgagattcaccagtggcaacacagaggtgccttcaccagccttgctaagctctggtttgtgtttctgcctctggtgtttggtatcagaacgcattcccctgatgctgccggaagcaataatccagacacggttcgggggtttagtggaaatcctctgctatagcggaagaaaatgaaacccagtgaagcaaggatttcggcagatgcaaaaatctgcccatttacctccccagtctgaattccacggcagggacagctgagaagcaggcggatggatgaccttagctgcaggtcaggtggggaaggggtgagaactgagttcagaagactggggcttctgcaggtctaaagccccatgaggatgggaggggaaggtcaccgagtatttgcaaacatgttgtaagatcaggattgaccttaattgagtgctgactgttaaaggccagtgcttcgtgcagcaacatattttccttttaagcccttgcaacactgacgtattgaagaagtactaaagaagtattatccttaattatctgatgcactgaagaagtattatccttaattatctgaggtactgaagaagtattatccttaatattggtatgagggcttagatagcctaagtgacttgcccaaagctacacagtcagtaaatggcagagcacagcagaaatgctcactgctaacagatggacactgctatctgttcttgatactcagaccctcccatctctcccatccacaccagttacccaccatcatggaaacatgtggttccggatgtggacagctggctccccgggccccatacctcctgtgtgctcctggagccttctccatctgacacaccatgtcagatgtggtcctggaccttcctgctatcctcagctcactgtggactgtttctgagccaagggtattgtgtggttaccagggaaaatatgcccccgctctaggcctgccagcagctctagggcaataagccatctttctaaaatgagatttcctatttcagggactctgaaatctccagttctgccaaacagcaggtcttctcctcagcttaagatagctgggatcatggctgaggttgagctggtcacagaccatcccccactgaaccaatgataacaccctgccaagggcctcagcacgagcaccaggagcttctctgttcacatatttacatatcaagatagaaaatgaatatacgaaggagtctagcatgaggaggacgggatgcgctgtggagttagacacacttaggttcaaatcccagcgttgtcacttattaattgtgggaccccgggcaagacatttaactcctctgtgagcctgcttccttctttgtaaaatgcaaagaatgatcccatctacctcgaggagctgctatggggataaaggagagcaagccctcagtacggtgcctggcacgcagcgaggactccctaaatggaggctcctgctgtcacgaccctcgcccggggaaatgcctgtcttctccatttagaaagtgacagctgacggcaggcccgaggcagccaggtagggaggctgcctgtgtgcaacccgctgtggaggctgctggtggctgcaggctttcagaaggcattacaggccattgttttaatcaatactatattatttcctccgcggcaactatccccatgtttattatgtgtaaatagggtttttcaatgatgtgaatgtgttagcttaacgtagctgacattcagcgtgcacaatctggtggctgcccctcaggacttccaggaaaatgagatgatgtatccgtcacaaagccatcctcgtgagtaaaatttgagcagtggcagcagccagggcacccgatgaattctgcaggcgtgggctgcgtgcttgagaaggaaaacagacatcaacatagcctgggagcacagtctgcaggcagtgtggacagttggtgccccggaattagggcgttggcgttcccatctctttgctgccatatctagatcctatacagcttattccaacacctctccattgcctggcgagcgcctgtggatgcactcttctgcctactcctggaacttgtcaaggtttgccctctctgactgtagctcctcactctcctggactctaggatgggcccctttcttccccatacaaagcccccagtagtctgaaaactcatttttgtctatgctcctcagttcagcccaggcatgtgggtatgaccgagcctggctgcaaaggcaggcagaggggagcaaaggtggtctttctcaatgtcccatgtgggcttaactttcctcctcctgtaccagggcactcagagtaacaccaccaatgacactaccagcttctctctggtgtctaactggactgaaggtgaagcaggtggggtgtcgtttagatctggggcagagcttccccactgtgacacccttgaagttgcaggccagatgccactaccacacatgggtcactgtcaacaggccacaaccccaatgatgggcacttaactcaataataccagatatcagacaactgtggcttcatctgtagagctctctggagtgcatcataaaggaagtaacctttttcttttttctttgcttttctttttttttttattttgagacagagtctcactctgtcgcccaggctggagtgcagtggcgcaatctcggctcactgcaagctccgcctcccgggtttacgccattctcctgcctcagcctccggagcagctgggactaacaggcgcccgccaccacgcccggctaattttttgtatttttagtagggacggggtttcatcttgttagccaggatggtctcgatctcctgacctcgcgatccgtcagccttggccttccaaagtgctgggattacaggcgtgagccaccgcgcccggcctctttttttttttttttttttttttttttgagatagagtctctgttagccaggctggggtgcaatggtgcaatggcgagatctcggctcactgcaacctctgcctccctgattcaagtgattcttttgccacagcctccccagtagctgggattactggcactcaccaccacgcccggctacattttgtattttcagtagagatgggttttcaacctgcgggccaggctgctctcgaattcctgacctcgtgtgatccgcccgcctcagcctcccaaagtgttggaatcacaggcatgagccaccgcgcccggccaggaattaaccttcaccaggatagtttgtggaattttatcaagaggcttcgctcccatctcctgctttcttaacagagtttggaagcagcggaccggataggaaaactgcttagggttccaccctcatgccaagtggcagaggccccgggggaagcctcctgcggaacgtgggaacaaagggatgcggggcctagcactctacgccggtgtctgttcgtctgtccagaaggcttgtcacactctgggggggcatctagctaaaaggtactccatcaatgtaaacgaccgtcgctctcgttaagttccatctgtgtgtcttaaagctcccgcacggaacgtgattggagttgggcttcagcttccctgtgctgcctgagacagaggagggagatgtttttcttggcaaataaatatgatatcataagccctggcaggattccagcctgagtaatggccgtctgccttcctaattccctcagcagcttggaacaggaacattactctttacttcctctctttaaaaacaaactctctattggagcgcattactcagccacaggatccctccccggacgtggcggcattcagatgatgggaggtgaggaatgagctcagattacagcgcacattagggaaaacacagcaaggcatttggcccagaaaaggcacctgaggaccttgaattagagcggccactcctcatgtgtccttgttcatgaggaacatagagctaaaatcaataaaaatcacattgtttagcgctgccgtttccctggtttaaatcatgaaggagtaagtaggtaattaggtaatccagctcggactggatagttaccttcaagtacgaagcggtcttgctgagaccctctcactgaacgcgagctgggggaagggtctcgtggcctctctactcacaggagcactgctgcctctaagcacataccccgccctctttctgcttgtcattagttcttcctaacaacagttagaggcatcggtgttgttactttccattttataaacccgaggctcagtgagactaattaggtaactcgttcagggccataaattatacatagcagaagtcagagttgaactcgggtcttttggcttcagattcaatgtttacaacgccacatcaagcctcatcactttctctggcctgtgaggacttgggtgctgccacttgtcccttttgaagtagcggatacaaggtggcaccgtgaaggcactgggtcaggagctgggacacagctttgcatcacttgggcactgttctgctggggcctccttggtaaccaaccatccaggtgaggataaaaactgacccagcttgtagagagatcttgaggcaggcatgcagcaagggccctaaaattactgggagaagggcaagtcactgttcgaaggcttgggatggtgaattcagccaataaacgtcctttgaacacttactatggctaagcatgggggcacaactgtaaaccagagagagtccctgcctcagggagctgggagtcagtgggagagatgaataaacaggcaacgacgatgcagtgtgatggatgctccagtggaagagtccagagcaccgggatgatgtgtagggagagccactcaccagacatggcagttcttggaaaatgtccactggggacatgacatccaagctgaaacccgaaggacaaataggggacagggagatgaagacgggggctgcagagcgttccaggctgtggaggcagcgtgtgcaaaggctgggaggtcagaaagaacacactctgctccggtgatggcatgtttggtctggcctggagcagagctgcaggggaagctgtgaggcatgaggcagagaggtaagccaggagtagtttgcagacccctggctgggcagctttccaatctggaacagtgggtcatggagccatcacattcccaaacccacagcgcttccctctcaccaaccctgtagcctgcagtcttcactgtgctctcgactcccccagcctttcattgtatgtggaagaggagccagaaatgcacccaaactgaaagaggagcacgcagcaccaatccctgaatcaaaataaaaatccggctgcactttatctcgctgaaggactgtaatctgggagatattcatttaacatatttctgtctctgaatggcttttacttttcactaaattgaaaccgcagtacaatatatgtgaatgattaggttgtgtaatacattccagcaaatttagattaggaatgattatgacttaagtaaaatagttgaacacaattcttattgccatctatcttttcacttctttttagttttcatgagagtgagtgaatgcaaggaatgaatgactctaaggagagctgggccctggtacagggaggggcagaggtctgtctttggaaggctttaggaagaagggagaggtggactggaagactcagatctagggctcgggggaaagcattgggccatgaggtagattggggacaagtcctatatctgccgtttgctagctgtgtgacctcaggcaagttacttaaactctctagtcttagtttcccatcagcaaaatgggctttattgttccccggctcatggaatcattgtgggacacaatgagatcagggacatgagagtaacactggccaagagctcagatggggagtcaaagtcctgatcaaagtctggctctatcacttattagagctgtgtggccttgccctttgatactcagcttctctgagccccagtttcctaatccacaaaatgggaataagtgtactcagccacaggtatccttgaagagaggcttaaataggatttttttgcatgttaatagtgctttgcaaaatgcaagttacctgggagggctatgctggctgataggggtgggaataggaattggggactcccctttcctgggatagcgacctggaggggtttgggtggagccttgctgcgggccctgaggcagggaggggaaggagaggaggagtccttgccaaaatttccctttggagtcctaagccttgcacgcgccctgggcactccaatcctcctcactccactgctctattttccccatagcattgaacatgctgtaacattctatataatttaccaatttattatgcttttgtttagaatctgtttccctggttcaaaggtaaggcctacaagggcagggagctgtttaatcccctgataaatcccaagcacctagagcacagcttggcagttaggaggcatgctcaggaaatatacgtcaaatgaatggatttatgagtagggctggaattctgtctcctgagaacaagtgagctgaggtgggaagaaggtggcggtggtggggggaccaggggagacgagggcatcagtcactccagcagggagcttgctgcagggagaaagagagaacagcaatttgggccgtgaagcctggcactcattcttcaagggggctgcaagcccccaggattttcctggaacccagggcacccgcacactagctgcctctcccggtcccttccagcaacctgaggaaatgccttccaatcagagcaattactgctgccctggagccgctgcctctccaggtgtctgcctcctgcggctctggctggagacaatatttctcctctgttcatcacgagaacagggacaacaaataacacaatggcagatgaagggccctccaagccctccagagctgaaagagtctgggctgttggcagcgtctgcgtgcaggggaacagaagctacaacctgcgtggggtgtggggatgactgactcttcctggatgggggcactgtggccagctttgtccgggaactgtgctgctcctggtccaggcaggcagggctgtggcagccgccctccgcccgcccaccagcaggcagggactcagggcaccatgggcttgggaaactgagagagagctatgtgtgtcagttgtcttgttaagttttttccccttggtcttaaccatgtaggtactcttgtgttcaaaggaggaaatggaatctcagagaggctgagtcactggtgcatagtaacacagctcatcacacagcagtgctgggataagtgctcccatgtttctgaacccaaagcacatctcgtcgctctggcactgagtgatccgtgacacagatgtacctatagggcgtgagtgcagccccttacctctcagcctcagtttccctactagtgcaccagtcactgaagcttgggaggtgtgtcagtgactcaacccactttatcctgccacctcacctgaccttgctggcatttcatccctgcctcctggggctggggctggatcttgcctagtgccccagctgctggctgaggctctactcagttactcctgaacgctcctctttctactgtgccccatccttaggagcaggggctccctctgaataccagccagggccactgcagcagaacatgccacagtcctttgaaagctgatctcaacaccagtatggatactaactctggctttcattgttgagcatttgttgagctcaaatgtaaacccaggaaccagattctgagggctgcatacctaaccattatacaggcctgcctcttcctcatttgacatggtcttttgaccttaactaccttggttattcgttttgttaataccccctttcaaattgatttctagaactgaacccaaaattccagatgtagcctgatcaagcaaagcctagaagaagaacatcacctccctctgttttaaaaattgctttgcaattaatgcagtctaagattacacccactttcctgggcccccagctcccagagtcgactcctatggggctcttcagccagccctgtctacagggctctgccttaaatccctaagtcttctagaaactagctgctgtggcagaccttttgtgtggctgagatctgcaacaccccagcggtccccacctcaagggctgtgtctgccgtggctgcatgcggccctgctgtggctcactgtggacacagcagacgaaagagaacatggtctcagctaagtggggggctggaaggaggagaaatggtctgtgaaggtcactgccactgtacggtgagtgatctgtccccatttcagcctcagtgggagagtgatggagggtgtaattagggcttgagctgtgcctgtgggggctgctgcaccaggctcaaggaggctggggacacagctggtagtctctgccctcctagataccttggtagcgggagccgcccttcttgggaccactccctcgctggccatcccagccaggtcttccatccctgttctccccaccccttctctcctcaaaatttgtcctgtatgtctcatttcacccattctcttgaggatttgccttattagaaagtgatctggctgggtgcggtggctcacacctataatcccagcactttgggaggccgctgaggcgggcagatcacttgagcccaggagtttgagaccagcctgggttacacggtaaaattacgtctctactaaaaatacaaaaattagctgggcacggtggtgtgtgcctgtagtcccagctccttgggagtctgaggcaggaggatcgcttgagcccgggtggaggaggttgcagtgagccgttattggaccactgtactccagcctgggtgacagagggagatcctgtctctcccacacctgcaccccaaaagtgatctgattcaaatgctgtattaagatgttaacatctaacgactggctggacgcttgtaaccaggtgtattccacaggtaacaatccttcaccaagagaatcccttaacctaaaggcatacatcccttagggtgaaatcctgtgtgttctggtgggaggtttgtgcaaggttggccccggctggttataacagccagggcattactgcacatgtaacctgcacttcccagtgatgaggaaatggcagctcagagggcttctacatcttgcccaagatctcagacatgctcttcctgtccagccttgtgtataccagccatgctctgccttgcacctggacctgaggtcagctctgggggccccatcagggtggtagtgcttctagaaggatctggctgttcagagaaagctctctgtcctgaaggcctgaactgggtgaggaacaggagcactataaatattgctacaatttcttcatcacctgccatgtcctagatactaagttaggctctttacagctcataccgtgttgtcatacgtatgaccatgctctgttttaccagtaaggaaactgaagttcagaaagtttaagtaacttacacttggccactaagcaggaagtcctggcagggggaaaggcaggcctgagtcagcctgcctttgggccctctcaccacccctggagcccaagcaacataggcctctcatagggccaacagctcccacccctatcacatccttcagggtgcagtgccacggctgggggtcgcttgcctttggactctccagagaggagtccctgggacagctgaggccttgctcacagccctaggtgggccaggaaataacattccagggccttttgtcgagcccctgggatggggacttgcatgtgctgggtgcctatgatgcctcaggccttgttctaggtactttccgaacagttattgtcgtaatccttataacaacaccataacttaatccttataacaacacaatactataaaggtatcattgttccctttatatggatgagaaatactatgtcttaatccctataatactatgtcttattatacaatgctaggtctgaatccttataacaacacagtactataaaggtaccattgttccctttatatggaggagaaaagcaaggccaagggaagtctaaagttacatagctaagaaagtggaaggagctgagatctgacagtttccagcgattccaaactcaggctctttctcctacaccctgtagcttctccaagaagattggggtctaaaggggcagagctttctccaggagcttctggtccattgagggagatggaatacatcaggatggaaaggaccatggcaaaaaacccacacagtacactctgcatgcctgctgtgcgggaaacagcgcgcctggggccagagggaagggaggagggagccagggtggggagcccaggaggcacatcaggggaggccttggggaagatgtgagtttggcaccagtcgcaggtaaggcctttttctgtgtgctctgggaagagaaagctattgagctgggtgtggtcacagcagggaagggctgggagcaagacactctcagctcaggcagaaaaggcctgttgttgagagaaccgatgcaggctgccgctgggagcagagggctgggcgtggcgtacctttctttcctgtgagggggctaggagctggctggggtgggagggctgaggggagcaggcacatggtccagccacgttaggaggcttgcacaaagggcttctaggcctgaagcctccagctcccaccccgtcagccgacttgcagattgtctgaatgggtctccaataggaaaaaagccagggctttggagaaacagatgcttaccacggaaccaggatgctgtcgtctgcaggtcacccctgtgtggatacagaccgtgggccaggaggctcttcagagcagttctcccacagctcatcctgtaattgactgactcatcggtcactgcttgcgcgctcagccattgttaactggtgacttgaaaattacctttatttagcaccgttatcgggaggcttcaggggcgccagcatttccacgccaccagctctctctggctgatggcagcaagcagcctcatcacactgtccccagctctaagccacagccactccctacccactgtggggaccagggaggggccctcgtgctaagtggatgcagtaggcaggccagtacctcccaacctgctgtgaccccctctgggtacaggtgggcaatgaacacccggctggacctgtggcctgctgtctgttctcctctgacttgcttgtctgctgatcatttctccatagccacgttgccctgtatgcatgagacaatctggaatgggggtcatccatggggtctgggcctgcacggagtggagttaattgcagaacttgtgcaattccttaattctgagtgaacgtgcatataagccttagggagagagaacattcatagcttttagtagattctcaagaggatttgtgagccctaggaagctgggaagccaggttctgagtcatggttctcagatcacccctccaggaagctgctcaggttagcccattgcaccgttgccatcactgcgagactcagggggtccagtggtgcaatacaactgtccccctccacccagagggcaaggccaggtctgtactctgctcagtggtggatgcagatgacaaatcacaaagagagaacaaagagatgacatttgcagaaactcctgcctttcactttctgctttattggggaaaagaaatcacatccccaggctcccttccctctgtccattggcacagtgtatcctcctcccatcctccacccctccctcctggtcacaggttctgccctgagatctgaagtaagctgtgggactcatctacctggagaagaaggcaggcagaagaggaagggagggaaggatggaggagctggtgaaaactaacagtaaggtgaagggtagggctgggggctgggtcggagccacaggattcatggcgtactgtgatttttttgttgttgctatggtcctttctacctggatgaattccatctccctcactggaccagaagctcctcgaggaaactctgcgccctttagactccaatcttcttggagaagctacagggtgtaggagaaagaacatgagtttggaatcgctggaaactgtcaaatctcagctccttccacttttttcgctgtgtaactttagaattcctttagcctcgtttttccttctttctttccacatagcatggggccttcaactgctggagggtctgggcggtcatttatccttgctgggcctcagaggcctcatgagtggtgcctttaagagtgcaatgaggccgcagcagaaactatctctaaggccagctcttaaattctctaacccatgctcctggccaactctcctctgtccagccgcaggtcctcatagaaaggcagagacactgaatagaacatagaaggggttgttttcctaaagctcatataaaattctgaagcctcagcgatggaacctgcatttgggagctgctcgatcttttctgttagcatttccgccacgtgcttctcagcgttttgccccagttggccttccgcccctgggagggggaacaatgtctcctggtgaaagtcactttgcagctgccctgggccctcggaccctcaggggccttctgggttgtgaggcgtggggcaccccgtcctgagcgtgccctgaagatgggcacagagctcccccagctgccgtggcactgtttccatgcagctgtggggatggtgacaaggcctgagggctgtcagcccggctgagagcactcaagagccacttcaccggccttcttttctctttccaaggctcttaacccacttgtggagggggtggcgggtgaggggctgaagagggtggatgtccactttgggcagacaaaggagctgcagtcagcctcctctccagcctggctctggagaaatgcagtcagcctcccctccagcctggctccagagatccggagctgagggcagtgtaggagctggcagggcccttggcaaagtggagcccagcaggctagttgtcccaggtttatcgcccaggattggggggctctgtgtggctcctgtcttagctgatgactcagatcttggactatttctcccttatcaaggtcttcctcatcctaaacttggccttgatttgagcctctttagtttaccaagtgtttacctgaattatctcatttaatttcacagcaaccggtaagggatgcattgtgagcatcatcttactgaggactcagtggctatgactcaggactgtgtcctttgcctaaggaaggccacacagctagtcagtggcagagataggactagaatgagttctttttctcccagggagacccagtggccagaaggcacctgcagccaggccacaccgcccccttaggagcgatgggggacagcaagaactgacaagccctgatggcatacaaagcctccaggtgaccagcagtgacagacgccagccaggacatcctttccagaaccttctctagctctgctggcataagcagcacctggttttcaaaggctttctttggtgtgtgtctatggtcataaagaattgtaataaacaatgattaagggtcacaatataggctggtgctgtgtttcctcccttaggagcagaggaaagtggttgaggtctccaagcaggtggggagcccttggcccctaggaaggcaggaaagtctcccaggataaatctgtctgttctaggctctggtgaacccaacggaaagccctacgagcctggctggtggctgagctgccttctccataggctgttcaccaatctcgagagtcacctgccatgaagtcccaggagttctgacatccagtgttcatgcccatggagcaaccaacaagaatgttctgttcactgccgcatccttagatctaacacagcacctggcatatggtagatgttgagtacattgtcaaacaaacgtaagtgaaaggaaacctacaagatcatcatctgcagataagtcacaaattattagccctatttttagaggtggtagtgaggcccagagaggtaaagtaacatgcccaatgtcacacagccagttagtgagggaagtgccagactctaggtctcctttcactatactctgtcccttctgaaggggggaaggtaggaatgtgatgacctcggccccagggccaagatatgttcttgccatgtttcttagctgcattgagttgacagtgatctgatgtggctaggtaatgaagagatggtttttctctgggaagtgactctgctccctgacttctggcaggcatgcgggagtggggaggaggtatctctgtgtggagctctacattctgtcttaggagcacaaagctcttcacagctcacctacgcatcttgagcccagctttcttcttccaggaagggggaatgaaagcaactattaataaggtaataagaactgaatcaaccatccagcctggtcttccagaagagtttgatggcctctagccttgggcaagagagacagagcccgggctgcagtttcctggcctaaaggatgagtgtctgcagatccatctaccagtttctagaatctttaaagcagcaggaggaagcaggatggggcattatatgggctctagtctctttacaaagtcattcagaggaaaacagggacctaggagaattttggagtgtggtagccagacagacctctcagaaattcccttgatttacactagccatcaccaaaatccctgtgtctccattctctccctttggagggccgttcccagcacgagttacccagaactacccacccaatcagagcccttggctctctgtggcagggggccctctctggtcaagagcagcctcgctggtcctggagcctgggccagagcccgcctgtcactctgcagctccgcaatgtcgggacaccaaagggcagtgccagtagcccgctgcaagctgacaaggctgagttcacatcagtgctgaggagtcgacaggaccatctgaattaagtggccaagtttagtttttaattaagtccccgtggtcttttaaaaaggtcactgacgacaccatcttctttaaggccaatatgaaaagacattcaaagtcaaagttctgagatgggagccttgtaacttgaaatgtcacaggaagaaatttggaaacagggaaagaggaagctggtgggaaggacaaccctgtcacattcttttgccgtcagcttcacagttcccacttggagctccaaactatttcggtctcaaagggcaagtggtcccaaggttctctcgagtgccttccccgacagaggattgtggagcctcttgtttgctgtgccagtgaaaaacagagcccttgtggtccctgacacggaataaaagttgatagcaatggggcagaatgtggcaacttacccctgatggctgaggaattaacaaaaatgtatgcaattggtcaccatcctctgcacccattcctgtcttcacttttctacctaccttgatcagtactgtatcatttggaagtacagttctgtctaaaacagagcacagcagccacttaagtcacccatagcatcctatgaggattgtacagtgagagcaaagacctgtgcctggcttagacccctaagagaagtagagacttgaggtaatttgagcagagtggaccacacctcctagagaagagatttggaccagccaatagctaatgagcaggcgcaagaatattttcctggagttcttggctcacgccaatgtctgaagagcgggactttctgagtggtgaagcgttcagtgactttgctagggtcagaggggttggaagtgctcagtagtgtgtgtcacattttgttcatgtttgcaataggccatgtaggaagtggaaagaattttggatttagattcaggaaatttgggtcttggggcaaagagtgctatttgcctacctaatatacattctcccatttatttaccattacagtactttcattgttggtgtggcaggttacccaagttaaccaaatatggatttcctagccttccttaagaagctagaggtgattgatgcgaatattcagagatcactggtaggcttctttaaagatggctgattcacctgggaggtgcacctcttttgtcctttcctcttgtttcttcttcctgcctgaaatgtggggctgatgactggagcttcagcagccattttatgaccatgaggtatgacccaagaatggaagccagtgctaaggatgggctgcccatctactcctggtcttcattttatgtgagagaaaagcaaacccctaatttgcttatgccacttactttggatctctgctacacccagttgaatgccaaactgatacacattgattgcccactctgtcattcactcctgagggactttgggcaagtcacttaatttttctgggcttcggtttccttacctctgcagtgggaataataattctggctttgtcttgcaagcgttacttctgacctgtagggctcactcttaggcttcctagaatgttctcaaccccagtctgaagatcacgtggtttttgtgcctgagcagtggctgcctccctcccattgtttggccagataattgttcccaaactaagaaatgtgcctgccttccgacttcaatggctgttataaagtccccttgtgggctcccattttctagagacacaatagcttttcctggcttgcccaggcctcacccctccttgctgggtgcagagacatctgctgtttcaagctgctaaaagagaagcttcaaagaaccccacattggcccctcttagggctctgactcatataaatgtttctagaaatcctcaaaagccttattaatctgttaagacatcccagaagcaggagtctgcacacccaatttccacggcttttcagctgcttccattgtctcagccgcattgtccctgctcggtgtcttggcccctaatggactctctctgaggcaggcacgctttcggctgcacctgctattccattgcctgactcttttcttcttcttctctgttctctttaactcttaaaatgaaaaggtgaccagctcttcctgggctgtttactcctctagctcccctgtgcgggtctctgcttcaccccctttctcttctggcatgtggctggatctgagtcagagacatagaggcccacatagaaagtaggggcccatttgtcttttccatcaaatggaagcctctaggggtctgtcattcctcatgcctagccaagataccgggtatccccacaagcctctgaaggggacttgcttacagctcttgcatatagaagctctaatcaggcttctccagaaactccctcatctctggtccatacagtaatgaccctctgatgtgtaaccttcactgtggttgaagggccctggagaaagagccagaagaccagggctctgttcctgacttgaccccagctggtttccattttcttagactagcatcaggggacttaacttgacagccaaggtcccatggtgggcagcttgccaattactcctgcctcctggttttcagacccctgtgtgctcccttcccttgagtatgggctagacctggtgacttgcttctaaccaatagaacacagcgagagtgatgggctatcacctctctagttaagttataaaagactagtttgcgtgttctgtcctgttggctctctctttttctctctgtctctccttctcagatgcttgctttgatgaagaaagctgctatattggagaggcccatgtggcaagaacttgagtgtagcctgtagccagtatccagtgggcaaatgaggctctcaatccaacagcctacaaggaattgaatccaactgacaagcatgtgagtgagcttggaagccaaccctgccccaggtaagccttgagatggtaaagccctgacttacatcttgattgcagccttgggagagaccttgaagcagagggcccatctaagctgtgcccagattcttgacccacatatatttagaggtaataaatgtctgttgtcttaaactgctaattttaatacagcaagaaataactaatctaggtccttattagctaagaagaaatgtgtttcttgccttgttcctctgtatttaaactctaggtccttaaacctttcatacccacgagctagccacttgggttgtgcatgtgcaccacccaactccaccaaccaccccactccaacactcaaatctatgggtggtgcaaatccctttactcttactccaaacatacatgatcagaaaaaatggaagaaagacatagctgaaatagagctccaatgagatgattcctggtttctactaggaatataagtaaaatttgaatttttgccagaatccaaagtattcaaggaagggctccttatacacctttgatcattcacttccatgtctcatctttcaaagcttggcttaaactttcctcctctgggaaaaaagaccctgacttcttcagttagggttactgttccctctcccagtcacccatcagttttgtccatatcagagcattctattttagttatttgcatattcccttctctctctcacccctccacggatctcctaccccaggaaggtcagcatccagtgaccttttcaggaaattacccaggatttcacaatcttagtcagaagcgaaatttaaaaccctttgtcccccgtcctcccagccccccgatgttccaggaagccaaagcacagagcaatctttccaatctaggaagcaataaagaaatgtatttatgaaccagcctctatctaagggagagaatttatgtctcttcatgctcttgttgacaataataactgattgctgcatcaatgtgatgcaatataattttaaaaccctccagaacaaggatcagaaaacaactggcagagagactgagcggcagccgtgggcatcttgggttttgcagctcagccctgggcctgctaatgccctgaggcgatgggaacacagctctgggagcacctgcaatctcatcttgtttctttccaagcaccagggaagaaaagcaatttgtttgctctcatactctaaagatgaacttcccgtgctcaatcaaacgttattatcccaatgtaagtcaatttacctttgaatttgaaggctattttcttcctaaatggctaattatgggagatagatggctgtaaacagaagtcttctacctcaacactccgccaggttttctccttatggcacctgagagaaccagagaaaggaggcctcacagtgtcctggccccctctgcccacttgccgcccctcctccattcttctcatgcatcctgcggtgccattcgcccaccccgcctacattcctggacgcctatttggagtttcatccccctgaattccatcccctgccgcgtccatttctaggagctccattccctcgtgccatctcccgtttttaaggactggactaaaggtggaggtcttggcctgagaaccgtgcatacgggacagcatgagttttaggagacaaggggtcctgtgtgtgtttgagatgaaacaaggtcacctgaggccgcctctttgatttgcctgacagagtcacagaagctgaccgctgcgaggcaggggctgcggccttttcccgtggcatgatcaacacctcgcaggaactaattgaatggccgagtttgtttactgagaggaggagtagccccctcctttctcgcaaaacaaagtctttccccaggagcggtggcaaagaggtcagccctggcagcgtttctgttttgccttttgatgaaagcctactctggctgctctgaagaagggagctcattgtgtgctcactgtcagaggtggctccagcagggaggccacagccctgggggctttttgggtcttggggttatggagcctgtggtgtgtggggttatctacagggactgagctttctagctcttctcccagaagtctggcctctggtcctctgccctttccacctgggccccagaagccatagtaatagcaacctgcctttgtccggtgcctcgtcgtcgtttatgcaagtctatatactttatctcacttgatcctcacaaccatcctgtgctgtcatcctcccctgacagatgagggagaggcccagagaggtcaagtgctctgcctgaggtcacacagctaggaagtgacataactgggacctgcctccctttggcttgaacgcctctgatctctcccgtctgtcacagtcccatcacagaaaggcaggcatgtggccccgtggttgaagccctgccccagctgtggatccgcatcacctgggccaggcttccaatttatgatacttactgagaccttggcaccacggccttgataaacccctctgccctgggcttgagcttgctgttctgtcgggggcagttcgcggggctgggaggacaggtaagaagggaggagcttttcatgagctgctctggaaaagtttaaggccatggtagggtcagctcaggaaagcacagcagggcaaggggcaggtaggcctgtccaactcagctaatagctacagaggtctcaagaagtaatgattggaggcctgactgaggcatagagaccaataggagacgctctctctcctagctcagaccaaggaaccctagaacatgctcctccaagttcacccaccgtcaccctgcaggggaggggtctgccacactccaaaaaagaatcaatccactgtgtgttctgtggactgttatttagagatgcccctacagattcctggagctgctgggccccatgccagggcaaggatcccaggactccctgtttagcatagtactttgattaaaacaataaattcccattgaataccgatgggcaggcaagtgggggctcatgccagcctcggtgccctcctggcatcatctcacagcaactcgtttggggagaaatacctccctccgctgtgatgagaaccctcattcccaatgaatgagggggcagaagctgcctgggagcctcaggaatgagggcatcatgggcaggacagggtaggactggggcagctgcagatggcaccaaggatatgggggccttgactaagcagggagggccacagaaggggagagggggcacacagaaacctcaatggctggcccctgtctggtcctcacctcctgaccctgtctctgcagacatgctgaactgggaggaacatgcttgggtcttggccccctgagcagctgtgctggagccacgcctcagtgcccagcgctgctgcatctgctctctggcagcacatggctgcatgtttctctgggccctgcctggtgcgcagcagccatatcctgggcaggtgtgctggggctgttgcctcacctggccctgggatgctggtagctccggattgaccagggtttctgatgggaagggatgtatgggagaagccagggagtggagagagaactcgtgttccccgatacaaggctttttacccatgtctccccaaatagccccccctcctcccactagccccgaggctggagatcaacatcatggtcccatctttaagaggaaccaggatctgttttgagatggccaatcagccaaagaatgccataattcacgttatccattcacttttcagttgacttccttccttccttcctgctttcctttcttccttttatccttcctccctcccttctatccattcagtaatatttactgataatccttcacatgaggcccgatgctaggctgtggaaatcaaagatgaataagcaatagcttctgtccttgtgctatctcctccgggtgtccagtattatgaccactgtatttctgaaccgaaaacgaggacgcagagctgacaggggtgagtgtacacgtgggaatgggcaggaagaccaccctgaaggtctgaggcattctgttcctaagctaggatgaaactgagtattccatacatactggctgcattgcatttttgtctagcattctttaataagaacagtaagagctgccatttgttgaacatgtaccatgtgccaggcttgtacaagataatgtgtataccatatctcatttagtcttcaccacagccctacagagaaattcactgtccagacagggaaactgaggaccaggccgttcgcagttagtgttagtacagtccttcttggccactctaaatcctctgctgcctctacagctggagggttctgatccgttggcttacaggtgtgtcctgtgggccacatgggggtgggtgggtgttcacagcacactgcctggagccatggtgcacacagcagggggtctgaggctgcgcagaatggcccacttctaaacaagcgtgtctgagctttgccaggtgtccatgtttggaacacaataaaagaggaggtcttcgaaaggaggtgactcagagaagcaacgctagactcaccccagagctgcaacctgctaacttcacagagcctcacagcagaattatttaaccccaagccccctctcctcatggggacaaaagagaaatcaggctgatgctatctccctcatagcacacttaggaggagcaaatgaaacggcatatgtaaaagtgcattgtaaattgcaaagtggcagatgagattattattactgcttccttcacctcaacaaagacccataatcacagacaatgcatcgagcctggtgagggtgtggcctttcttggccctgccctttctccttggctcctcccacgctcttggcttttctcctggattccctgctctcccatctgcagcaggttggggccccatggataactatatctagggaccgactcctgggatcttaccaagtcacatttgcagttggtgcctccttagtcactgccaggattccaggcaggtataatgtgctgcacttaatgtagaggatcagggtcccagtgagcagcttcatcttcaggcgtcgggagtgggagcaatggagcacccatggtctccaggtctcaggccacttgggtctgggatttgaggctcagggggaggagtcctgcggtgactgctgtgaagtggtgtgggggctcaggatgggacctacttcatgggacatgatggatgagactcaggatgccaggagggaggcacagcccacacttagcagcttggcgcacgcaaataggagctctgctcacagcctgtgctgggcacttcatttcccagagacaaccggcgcgttttaataatgtctacttgggttaatgaaagttgtcggtttcacttaataaatacattgccattcttggccacacatatccgtcatgctgggcctggagctgtgcgtcccgcctgagttgagtagggatgctgggagtgggaatggggtggggaaagcatggggcatatgggtagagagtgaggtctggagggcatgggacatggtccctcttgggagttaagcagagggagtcctctcattgcatctttcctctgggatcaaattagaggcacaaagggcagaagggaaccttggaggttcctcctgttcattctctgcctcagggaagtgacacacagaatggcccctttggcagggagcagtgagccatagtgtggtccagagggacgcaggccatcttgggaaggaatcccagttgaccactcattatctctgtaactaagtcaattattcaatctccctgagcctccatttcttcagtaaaatggagctaataatcatatttgcttcatagagcctgtttcgagcattccagcataagccatgggaagctcttagcaggcacccagcatctaaagcactcaaatcagagtcactagtattattaatgttaaaatattatttttatgaaggcacagtttagtatggtgtttatgagagtggatctggagtgtgggtttggatttcgggtgtatcacttactagctgtgtcactctggagaatttatgtagtctttctgtgtttcagtttccaagtctgtaaaatacggggaaataatacctaactcatggagctgtgaggagtgagcagattatgacatgtacatcctttggaacacagacccaataaatgttaagaattattaagttgtcgatttcacagggccatgggggagggaagtccgggctctctgggaactgccttccacatttccccaccttagggtggtctccagaccacatcccagatgaccttacacaccccaggggttgataccaggccgagaccctcgacattccagggagggaaccggaggactccagtcagtttccaagctgcataacttggttcaaggttggcagtgaggggagagacccaggggagggatcatgcttaacattcttgggacattctccttgaactctgcaggggccttaaaacatccctaagtgccatacctctacatgctggccttcttctgcactctttttttctttctttaaaagcttagactgattaaagatgggaagggatttggggggtcaagggaggactctggatgggaaaggggagaagctcagatgatgggaaggggcgggggtggccaggcagtgctttctagctgaagtaagcagctttggaacctgcctatcacatggccgggtattccagggtttttaaattgcatgccacatgtttatccttattaagcagttgttctcttccaaggggctctctctggcagccaagaaccaaccacagggcttgtcgtggggcttatgagtagctagggcctcccaggaggtcgtcagagtggatggaggggcaaagccaggaaaatacctgggggcttccactccctaaacccagggaaacgatggagtagctgagccgagattggctcacctccttgtacaggaagaaaaactgcggccagaggggcaaggcgaggaagtcgccataacacatttggtgtggttttgggcagacagaacgggtttcttatggctggggctgctttctaatgtgaatatgagtactcttggctgggagaggaagggctggaggagagatcaggaaggagagatccacatctggctccgagctgactctcggtgaccatgaccacctccttccactggagggagcagcctctccgcaggtggggctgtccctcaggagcaggaactgggctcccgctggagagaagcagcgctccacgttcaaagaccattattgccattattaattgatcgctgttattatcatgtaggcattaagtggcttcctctgccctttgagttgtaacacttagggcagctgctagcgaggacaaaacaaagcttccctactgcaagagctttatctgggtccctgctgctgtgtggccttctgcaattagccattttacagatggagaaacttagtcctaatgatttgctgaagggccgagttgcttagccctgcagggtacacagatgaatagggagcgttgctgagcacttgcaatcaagacagagttgccacccactgcaaggacgaacatcactactgggtcagctctgcagctgcaagtctggggaaaagggatccacccaggcactagggcaactgctcagccccatcgcagcaagggcccgaggaacgagcacgtcagctgtctccagggcctttctcatcatctcccgtgcctgccgtgctgtctcttaccaacccaggagggagggttggtggctgctgctccatcctcaccctttagaccaccccacaggtgggacagggtgggcccaggtggagtctgagctgggtgccaattccaggaatgcagctggaggtgggggcgggccatggtgggccaggacaggtgggagagaaaagcaggaggcagctgaagggggcggtctcagaagcccccgctgggagcctcctatccacctggcaggcgtttggaacaacgtgctgaataacagcagcatttgtgaaatctaattagtgcaggcccaacttctgacttcctgtgcgggggctcctcctctagccccaggctatcgagctgaattaagctgcctaagatcacctcattaaattcactaaccttgcttttccaccaggtttagcccctggtgcccttcctctgtctgtgggaggtgcgcgtctggcattcctccagtgcgttcccaggcaggtgttttgagaaactcccctcctcttccctcctctcccctccccaaatggctcccttaatcacgagctgctttcttctgagctcaataatcaccctggactaatccatacacaaaatcctgtggctgcagtaggagcccccttcccagccctccctggctaagggatggtggtcccagaggcactgaggactcctcctggaggcaggcagggggctgtccagaggcagagcattgggcctgctggcaaactgctaactggcacaggtgacttgcatttcctggggcctaactgctgggagtgcacttctggagtggagatgggcaatggggatgcctgatgagacctatgtccaggacaggaggggaggggatggagaagcagctctggagcccagcttgctgttagccctgagaaacaagtgacttcctgtgggtcagagtacagggtgggtagcagaaacaatcaggccagaggggtatttgttgcagaagagaaatgtgatgcaattagtatgctaggagaatggaaaactaacccggagacagggctaaagttactgcccactcaactctgcatggaattgtgctgaattgaggagcactgcagcgagacctgaccaccgcccagcccaggttgggtttgttttccccgctctgagaccggacctcaggaaaggggtgcggggaaggttgggttcagaaggagagactctccagccacacctgtgaagctccaggcagtttccctaatgtctctccttagcctcttgcagagagggctaatgtatgtcttccccccgggctggtggctgggttaattggaccttgtttatgtagcatctattatttatgatttcctttcgtctctcctgagtatgacaactgtggttaagcaaccagagttattcctgcctcgggacatgtatgaggacggtctcctttgcagcctacctgaagtgaatgtgaggccgagaggcttcgtgaaaggttaagtgggtgggggacctgctgggagagaggggcaggggaatgtgcctgagatcagacagccttgcactaagctcagctcctttctggggggacctccgatgcatgctcacttgtataaaatctaactggaactgggatcgtgttctgggggttccgaactttggctgcatattggaattatctgagatgtctgaaaaacctgacaaccagagattccagattaatcggtatgggggtgtggctacaaggtttcagagctccccagtattctaatatacagcaaaagttgagagccactcgcagctccagcacattcttactgtgtcagtttttttctgttgattatgaacaacagcagctaacattaatagaacctgatgatgcgataggcaccgagataagaattttatgtggatgacttcaacgaatcctcagaacaacccaatgttgttggaaggtgcaatgatcatcttccttttacagatgaagaaactgaggctcagggaggttaagtaaatgaggccgaagtcacacattgtttcagttaccaagttaggcctgacctgactccaaaatctgtgctgttaacttttttttttttgagacagaattttgccctttcacccagactggagtgcagcagcaagatctcggctcactgcaaccttcgcctcccaggttcaagcgattctcctgcctcagcctgccgagtggctgggattacaggcatgcaccaccacgcctggctaatttttgtatttttaatagagatgggggtttcggcatgttcgtcaggctggtcttgaactcctggtctcaaacaatctgtctgccttggcctcccaaattgctgggattacaggcatgagcctgcttgtctgaactgtaagaggattttaacagtttcccaagcaatgcttcatattcacaaatgaacacattaggctcaaggacagaagggacatacttaggatgatagactaacctggcccagcctgcaacctcatgggaatgtgggataatgagagagaatgtttgcattggaggtctgtgggcgtagagcactcaacaaatgccaggcactggggctataatcacatggggagaaggagccaaccgtgcatgtctgaagcaggtattctcttccctgcaggtgccaggactacagacagggcaacggagagcaggggcttgctggagaaatccatccttccctgggatctcttggagggctctccatctctcttagagcagtttctttcttagacagttgaagctgcctcagtggtctccccagatcatgcaggtcggggcagaagcttctcactcagagaactgagaatatcatttttcacagaagtctaaggtggaatttagaccaagatattcttggccttagcagtttgactcgggcgggggtttgaagctggaacttttcaacatacatctccaagcttcaggaggaagctagacacatctgaaagcctctgaacaacctgcgatgaagattcttgaaaaaagagaccatttgccttaggggctaagagtacaggtgcaagagacagaccgcccacattaaaatctgactccactcctgagctgtgtgactttggggaagttcctcaactgaagtcacaaagacctaatctgggaggtgggaatagtcatagaaaaaggatcgtggggaaatgaaacgagagaatacatgtaacgttcttggctcacagcgcccggtgaatgttagctgctattactgttgttcctaccaccgcaccctctcccattcctttccttctcaattctattgacatttttggtgtctaactccttttgagagatcatgacttttgtagaactaggctgctttcactctttgagggtggtctttctgattgatccatcagtctgcattctccttgccgtccttggtatgcacacacatgcatggaagctatattcctccttcatactggactttgaggacaacgttttcatgtttcacatttcccacttcatctcctttgttttccacttgcttagtttcctactcttccctttatcctgaggtgtcgtgagggcaatggcctgcagagtccaaaggtggctgtcatgtcatttgtccacgtttgcattcccgtgccctccccacagatggctgctctctgggctgcacgcacgttgggttcactgatcgcagagtctttttctggctgccaagaacatggtagcctcccagaggctgttggcatgtggatgctgcctctgtgatccacagccccgccaggctgatgcttcaggaatggatcacaccttggctggacccatcaggctggaacaccagattcttaatcaactgtaggtgctactgtcgctctaggacctgccgatgccctctgtccttctctggtgactttgtccacgtggatcttcagttccttcaacatgtgtgcttgttgccccttggagcccacctcctcaagcaagcctcccagcccagtcagcccctgtgcactctcatgttacctgtgcatctccttcacaactcacgtcactgatggacttacgcagttgggtgtgtatttggtaacctgtcttcctcctgctgaaatatcaactccaagagggcaaggagtgtgtctatttgttcactacagtattatatgaacacccctggcatataataagtgctccctcagaatttgagtattatatggacacccttggcatataataaatgctccctcagaatttgagtattatatggacacccttggcatataataaatgctccctcagaatttgagtattatatggacacccctggcatagaataaatgctccctcagtatttgaataaataaatgtggtgtcaatttggattaattttcttgatctcatacttgtgttctctatgcatcctatcacctggctctgctactaactgtctcatgaacttggaagctttaggggttagtcttttttaagtacattcgttaaaaaagagatgttgttcatataacataacattttcccctttaaaatagacagttcagtagttttaagtatatttacaacattttgcaaccatggccatgacctcattttggaacaatttcatcgcccccaaaataaaccccacacccatcactccccatttctgtccccgtcggtagccattaacccactttctgcctctgtggatttacctatactggacactcctacaacatgtggccttttgtgtccgtctcctttcacgtaacaaaatgctttcaaggttccatcccagttgccacatgcatcagtactttattcctttgtatgggtgagtaacattccatggcatagctataagcgcattttgtccattcatcatctgctagacatttgggctgtttccacttttcggctattgtgaatactgctgctatgaacatctgtgtaaagtttttgtgtgaacgtatgttttcagtactcttgggtatatacttagaagtgggatcactgggtcatatggtaactctatgtttaatttttgcagaaccgccaaactgctttctgaggagtttttatttgacttttttaaatgaaaggccaatttagtgtccacccccttacatttaaatttttatttgataaagaactcctttagaaacatattaaaaaccatggaatctccagataaatgcatatgtgtgaatatacatcatttcaggggtcccagaaccatcagaaactggctgtggatcccaaagttcgtgattacaggctcgcacgcagcagtgttttaaggttagatgattttctccaacacagaactccagctacagttttggctttttcacacggatattggagatggataatttggctaatgagttctaatccatgttctgatttgcatctgggatcagaacattcagcagccatttagttgccttaattttttccacccactctgcaatcatttgattgatgtgcaattacctccccctgcttggacacgtgctttcccctgctcatgtgtgtcatccaatgcctgataaccttcattttttcccatttattttgtgtgtgttggccactgtttgatataattatttttgtaatcatcttctattaggtgaaagaatattgcagtagagaaagaaggaaaaagaaaataaatgccttcctgacaagttctaatattttatgttcacaaatctcccaatatcagagcaataatattattttctcgatgtgcatttattaaaatgtaaagtagctccatcacattgggaacgaaaacccttgcattaccttggccagaaaatatcacttatttatttcagattgcatttctggaatgttaatactgttgcttttttttttttttttttttttatttttttccccatagcctttatctagcaggggagtgaacctgaaggtctgatttctaaacaggccttgctgaatgcacaggaccttaatttggttttaagaattgcttttggctcttgatttatgatgaggttcttttctgtgtaattcttttggctgaaaactgaatagagttctccctttgtgggtggcattttgacatcacattttaagacagggtacagatgtaagtggggagtagggaagatttataaaagagaagggggattaacatgtgcgctttaagggttggaaaagttcgatctattgtcgatttctctatggtatcaatggcataccccttagattccagttcctaagtcagaatgttaatttccaggtagcctagtaaaagagatactagattggaagtcagaagccaggagttctaatcctatttttccctctaagtaggtttgtgaccttggacaactcacttccattctttgcgctgttttctcaagtgcaaaaggaaaggttgaactaagatggatgggttttaatcttagctgcgtattagaatgccctggagagctttgaaaactacagtgatactcaggcccttagatcaattaaatcagactttctcatgagggtgcatggacctgggcattggtgtctctactaaacactgcccaggtggttctatcatcaagccagagatgaggacccctggtgcaggtgatctcagatgtccctccagatttctggttcctcagtgttatgagctgggcagtgatgtcagtccagccaaggctggtgagatgtatttgcagacaagtgggccgcaatcacaggattgtgattctgtgctggggttcgaggtgtctccgctgggagactctggggagatcctgaatggaattgaatttctcttagtatcaggtctgggttggggcaggtaaatcttcctttctttgtgggctcatggtgctgagaagatggatgagctggggccggtaaaatagctttgttccttggagaaagtcatgtagagagataaggtaggcttattatttttcgagtggaactgggactgtttagcctagaaaaggggggacttggggagaggcgtgatttgcggtcttcaagaggctgaaaggctgtcatgtggaagagggattggagtgatttgagatgctctggggggctgaactcaggtctgtgggtagagagtcagggaaagacattttggtgcattatgaggaagaattgtaatgtagagctgtgcttcatattccccgtgcatacctctgccttagcacctgcttttatgacagtcttctctacaatgagacgacatctttctcatctctgtattctcagcacctaatccagttcctggcacagtcctcaataaatgtttattgtcattcctgtgattattaattactgtcatgaatgcccactatgcagatcacttttcttgctttatcttgtttaactctcctaatgctttagaagtaagtatatttattaccccactctacagttaaggaaaccagagctttgggaggttaaggaatgggcaaaatcacagccagtaggtagcagaggctggatgtgaaattaggtctgtctgactcaaaaacctgtgttcctaaccatcctgcccaccaggatcctggaggtattcaagctgaagatagacaaccacttgggggacctagttgtgccatggcaataagtatggattgagttaggacagtcccagatgatgatggagccaggagctgagtagatttttagagtctgaggtcacccagttactgctctatcagccacctaccccacattcctccagtgaggtgttggcccggtccagaggcagagccttactacctttggctacataggctctgggatggcagtgctctctcagcagttatggtcttttccaggtaataagtattgcggcctcctctgccacttgcctgcattaagccttttggtcatatgtctggggagcagacttctttgtatgcccccggggacaggacaggatggagggaggagccctgggtgtgtgtgtgtggggtgcgtgggtggggagatgcatgactgctttggttatgaaacattgtgttagtgtgtccgttcacttcacatagacacagtgattgcattactacgcggccgagcatacgtggcagagggtggaagcagctgaggaaggagcaggtgctccaaggaaatctttcatcaaagtgatggcatagctaaaggcacagaaagaaatgcattactgagatggcgttgcccgttcatgggcggctgcaaggaaggctgaaatggtggcttgggagaatgaatgggagaggggctggaattggctggaaagacaggaaaaggaaagagggggagaaacaagttcgtgggaatggtgattcctttcaaatggggtgcacagcctgacaagctgtgcgttcttcttaaacacagcccaaatcaagtcttaacttgaaagaaaattaagtcagattcagtcatgaccctcctgttagcctggttgggcatagaggctttccagaaaactctctctggaggggttaggtggtggttgtagcagtggtaagcacaaaaaagggagccagcatttgagaatcaagtgcttaaaatacatcatcccatttgtttctgataatgaacacacagagtgggtgataggattttccttttacagatgagaagactgaggctcacagggcttttgttgttgttggtttagagataaagtcttgctctgtcacccaggttgaggtttcatggtatgatcatggctcactccagcattgaattcctgggctccagtgatcctcgagccttagcctcccaagtagctgagactacaggtgcacaccactgtgattggctatttttaattttttttgcagaggcagggtctcactattttgcccaggctggtcttgaactcctgggctcaagtgatcctcctgccttggcctcccaaagtgttgggattacaggtgtgagccacttggcctggcctcatagatgtttcaaagactaaattataagtgaaagccagagagtcttacttaaacatgacttaaaaattgtttattttaccacatcatgtgatcttccagttttccatcagagcaggcaggttggaggttgggggcttaggagtttgctttcacagcctcactaaataaattttggggaatggccacagattctagtgggcctgttagcctgacgaggctgaggttgcagacaggacccacagaatgggagaagctgagttacttgcaagttggaaaggtgatgtcatcatgaaacaaaatggatttggttggtgggcttgcccacgcagttagatggcaggtggtgaagaaacatggcctcttctctcttataactctgaggggcaggaggagagagctgggaatcactagattcactgcagagaagtttggggctgtatctaggtcatgggtaaactgataattggaaaagaaattcaaggttggacattcattttgatttttggttttcaaagtttatacttatctactttcaaaaataattttaagagacatactattttctcaggaaaagaaatatatgccctctaaatagttttcttccttgaatattgccagcaaatcagccatctcattgaatattgatggttgtagagcaaatcacgaatgctgacctagagctgccatttattgagttcctactagggatttgactctgttttaggtacattgcacatattagctttataaacattccccacaacccagcaagataggcatttttatccccatttttcagatgaggaaactgaggttcacagaggttaactgacttgctcaaagtcccactgtatataagtagcaaaactaagatttgaactcagatctgtctgacttcaaaatcaggtgctctttctactctgtgacatgaggctatgaacatgtgaatctcagaggtaaaaagcagagttggatatggtttggatctgtgtccccacccaagtcttatgttcagttgtgatcctcaatgttggaggtggggcctggtgggaggtgattggataatgtggttggtgttctcatgaatggcttagcaccatcccttcagtgttgttctcatgatagtgagtatgtgagatatcacgagatctggttgtttaaaattgtgtagcacctccccactcccctctcctcctgctctggccatgtgagacatctcgcttctcctacaacttctgccatgattgtaagtttcctgaggcctcagctaggctgaggcagatttatagttacgcattggccagggtggtgctaactcactcatgagaactcacccacatgatccaaaccatattagtgagccaaactctaccttttagctctgagattcatgtgcgcagaaaccgccatgtttcttgtacggcctatggaaccaggagccaattaaacttcttttctttataaattacccagtctcttttgtctttctttttttttgtttttagacagagtctcattctgtcatctgtcacccaggttggagtgcagtggcacaatcttggctcactgcaaactccgcctcctgggttcaagcgattctcctgcgtcagcctcctgagtagctggtattacaggcatgcaccaccatacctggctaatttttatgtctttagtagagacaaggttgcgccatgttggccaggctggtctcaaactcctgacctcaggtgatccacctgccttggcctcccaaagcgctgggattacaagcatgagccacctagtttcagatatttcattatagcaatgcgagaacaacctaatacactcacccttacctcttcaacacaaagagtcttcccagagcatccctgctaagggctgtgacttgaatcaccctcctctactaatgaaagactcgttaatgactccacgaggtgtcaggtccactgtttgatcctgcattggttcacccaaggaatatttaatacgtgtccactgtgtgtcaggtactattctagaacctggcaggccagacaagggcctggttctcatggatcttgacttctagttggagaagcaagcccttgaaaacaaagtaaataacaaagagtttcaggtgctgataaatgcattggagataatgagacagcggtctagagggtgtctggccatagggatccctttagatggaataatcagggaagattttgctaaagagatagcaactgagttgagatctgaatgacaaggatatgccttccaaagatctgggagaaaggggatttaaggcagaggaaacaggagatgccaaagctttgaggccagactgagtttggcacattaagtaagcccaatagcctggagagaacaatcaactagggggagaatgggaggagatgagcccagagaggaaggcggaagccagatggtgtagggcccacctgccatagcgagggctttggattttatcctaagtgtggtgggatgccatcggatgggtttgaatgggaaaatgacataatctgattcacattttaaaaaaagatcctatgtggagactggattgcaggaggcacttctaattgttggaaggactgttctctcttctactgatcaaagttggttcttcaagtaatgacccttatgaaactgtcctcacaacattaatgagaattacaaaccagactttaggcggatttgtagttaggcattggccagggtgcactggtgcactttgacccacttcctagcagctgctgactgaccaagagtcacacagcatgctgaccacctgctttcccattgttcctaaagatagaatctctgacactggacctttttactcaagaattacttaagttatttttcggatcctgaaatccagtggaatggctcatacccaccagtcttaagacccccaatcaaggaactgacccagcacaggcatgcggtttcttcatctccctgtcccatgacttcattcctcacttcttgaccaattagtgatcccctattcccttacaaaatcaaactccttaaaaatcccatcctaagtttctcggggaggcagatttaaggtttcctctcatttggctgccgtgtgattattaaactctctctctgctgcaacttccactgttttgctgtttgcccacacagtgggcaatcgaatctggtggtcttataacacttgaccaaaaaccaaacaacaaaaacaaggctactttcttccttcttaaaatttttccaatcagctattatagttccctttagttctttctaaacttcccttgttctttgaattgatccttggattctagacccaaggtggattctagacccattatcttgatcattctttatcagcaaatctcttgcttgtccatgtccttattaacatgtggcatccagtaccaaacactctttcaccagcccaggattctgaggggctgtgaattccaaggacatccattaatgaaaagtattagactaagtctttgttgagtagtaattcttaatgtgaggctctaggtccatgaaagggcccacatacaccacacaccattgtctatggggtgcctgtgcatgtgtgttgtgtatgcatttctaggaggagagtccatagctctcattaaagtctcaagcagagcctcctccttgagaaccactgccctaggaagttaaatcaaaggatttctctactaagcagatgttacaattagttccttcctggtcccacattcattcccttgctgccttcttcaatgcttttataggtctcttgatctcttcttcctgcctcataccccactttaaattccttctttagcttctaataaatcatccaaacccagagaagataacttctgctttcttcttggagcagcaactagtgaggaaggccgtaccccacttgctggatgagaacatactgacaaataggcctaagaccagaggctttttgttttttcttctcttctctggactcataggtctttggaactgacctgtgtgcctgacttgcagacttcttaagagcagggcacagagagactggaaagggcttgagtgtaagcgaatgcaaagggcaaagtcatcttaaaagaattattattcatttcccattgcagttaattttggcaccttcatcagggtttaaattctagtaccatatcatatcaaaggaaaaaagtatttgatgtacgtgttaattactgctaagatgtagctacttaaatcaagagtttaatcttcatttgactattcagaacagctctgagtgggggatggggagaaccccttttgatttgggttactttaataggtgatgagaacttcaagcaaaatggctttctaatttcagtatttggatgtcttgcaattagtacccagctaaaggaaaaataggaaaatcaggttcctccaggaattcccaagtttttgcttgttctgtgaagtggaagaatgttctgaataatttaatttcatgtgctcaaaggcttgagaatctgcagagtgatagcctaatggtaagtgatatcttaaaagcgtgtgagaggcttaaaaagtagatccatgtataaaataataaactattatttaaaagcacaaattgtcaaaatgatactactcttagatacactctttataagaaccatcttggttgaatcctaatgtgcattttttttaataccacgaaactataaaacccattgaaacaccacattatttaccaagtgattaaatcatagtcatctattatagttttactagaacattgttttcttggaattccaaggctttattgcctcagatataacactttactcctaataatccctattgattttattatattaccttatatttttagatttgttttaatgccttgcattacattttagccttaatgtgctatataaaatgagatacatcatcatgtttctcaaaccttctgaaggtaattatcttaactaacatggataaaaaaatgctcattgttggctgctgacagtggtgggagtctgggggtggggaaggtacattgtagtctctgggactgttggttgtatttctggacagttgaggtgctgcccatgggctgggtgaatggtggtgggtgtggtaatggggcattgccacagattaggtatctcatttgtgtcattattttgctatccttgcctctcttgggatttgtggctcacactgcatttacaaggtgttttacatacagtaattgttcacttgctaaatcagccagtagagaacttggtattcttagagaaagttgttgcacctttgggtgctgttttaattactttttcaaggtgccttctaaatgttaaaaatggtgacacattttatctcaagttgaactttgcatccccattctctggatttggggtcattctcttgccttggagtctggagggaggagaggagtcggttctggcttgtgagccatggtgctactggtccctctggaggaagggtagctactgatgagccttccctgcagcaattgtgtcccaagatctgacacactcttatcagggccccagcaaataactcagcaccttcattacaaaagttagccaggtatggtggcatgtgcctgtaatcccagctactcaggaggctgaggcagaagaatcacttgaaccctggaggcggaggttgcagtgagctgagatcacgccagtgcactccagcctgggcgacaagagcgaaactctgtctcaaaaaacaaaaaaacaaataaaaactccacaaaacttcagtggagactagattcttgactactaggaactcaaactctaaaaggagaaaataatcacaccagctacactttttacagtgctaactatactttttgtagagttaactacatgcacaattttatttgctttatctatattaattcttttcatccttatgaaaagcagatactatcattagctacatttcataatgaggaaatggaagtacctagaggttaagtattttgcccaaggtcacacagctagagagtggtagaccgagaattcaaacccaggcaatctgatgctcagaacctagactcttaattacactaatatgatatttacaatttacaaagcgttatccactagttatctcactgattttcccaagagactttggctccactttagacataagaaaacagaaataggtcatcatttgtctaaggtgacagagcccaaacccactaacaggacagttttcttcaccttcaactcatctcaatgggtggaaaaacctacccacatgctatgaggatgggaaaccaaagtgtctttgcacataaacagactgcctccctggaaaccaggcctgtccttggtggtgtatgagcaggcccctgggatcgacacatggatgaagggagccctctgaattctcccacatctctgggcacccctctaatgtgctcttctcagcttgttgctccttcactgtaagtccaagttctttgaaggaaggaactatgttggtattctgtgatgtacgcggctctgtgtgctggtgagattttgtagccactggaatgatcagaaaaacgtctgtgtgaatcttgcatgatggaagaggaaaccaggtaagagtgagcaagcaggatggtaaaagggataacagctgatgggccagcaaggatgcggggaggatacctgtggtcaggaccaggttgtgtgcagggcagctctgattgctttcttagcagaaagcacaagaccaggcaaagcaggcgaggagaaagccattgaataaatactaagctagaaaacaaagatatacatagaaattctaggttctcaagaaaataaacaaaccaacttacagaaaacccctttccctgtgttgaggccctctgttgaacctggcaataaacgttatgcctctccccaaccccagtccagaaggggctggcaggtacctctttttattcattgagaaagtaacggtgagcagttttgtgaattctgtgaattacccttgaactggtcagaaagatccaacagctcagacaaggagaagggaagagctaatctcctcttcacctgtgatgactgtttttccacctgtggcttgggaaggaccatccttgctggtgatggatgttgatttagtgctttgagatccctggaagacaggtcaggcaactaacaaggaaaatggcattttgggtcaagtcactaggaatgaagaactagaatacagggagccagggggtggcggtgtggcggggaggaggccagaatgaaagataggaggatcagagaatggtgataagtttgtacaggtgggatcatcagttattctccccaaacagatcattcttgtcttctcctctgatttccactaggaaaaaacaaaacaaaacaaaacaaaacctgaggtatttcttagaacacgaagcatgaatcacttacaccagagatgagaaaagcaccatcaggtgcttaaaacacaattataattggaaagaccaagaatttgtggttcatttctagcaggtgaacaaatgtatgtttataatggtgtaaaaaccctggtttccccttcccattcccggtgccttcccagtgtgcttggaacactctactgtgttattcacctgacggattaagctcagcagaggcaagctgcctaggcatgtcgtgtaattcagcattaagtatcctattgattcactgaagtgctgccatggatgttaatggagacaaatattgtggctgtgatttttcaaagggctgagtaattcccgagcatcaataacgtgtgtcatgatgtaatgcagggagacctccagatgcttgacttgaggccaactacggagggcagagctgatggaagggcccgttggatactgacccagggcttggggagatagcctgcactttctccagacctaccatcagtaaggatggtggaaattggggtggggcagggactgctgatggcgtttcctagtcactcatcacaaggtcactgattgttggatggcatgggcacgcttcccattatggaagcttgctgggccttaggagcttataccataccctgtttcagggaacagggtgggttttctcccctctccagttggaaacactacatatccctgatgataatgcagcaaaactactatctaatcttaacagcgtctaccctgtgccctacttgatctgagcatgtgaccacttcagtgcacgattccagtgactgctttcagagaggttacatgccttcctcaaggtcactcagcttcctcaaggtcatggactaggctacaatccaggtctcaggactgcttcccctggtctattctcagttacctttaggtagggtctctggaaatcatttgagtatatggcctgaaacaagcgacattttcttccaaaaaggctctgtaaaaatctcagggttggtcgttgtaaggaataaattattcccaaacaaatctcatttcagtcaaattctgcagactgcccaatctttcctacactccaattcattctccatactgctgcttacattatcttgaaacaagacaaatccaatcttgtcactccctagcatgaagacttccatcagcccctctctgctgacaggataaactccttgcatgatattcacaatctctcccccaagcctgcagtgtgatgtcctgcccctcctgtccccagcacttggaacatagcagaccactttatgctctttgccccctgaatattttatacaagtgattcctggtgtctagaacatctttcccccacctgctgcccagaaaacctcagcccattcttcaagagccagttctactatcccatcccaggaaaccatccccacgtctccagggtagagttatgagtggtcctttctctgagaccccacagaacactgcttatccctttattacccctgtataatgacagccttcctattgaacttactgatttattttcttgtgtatcttcctgcattggaatttggatttctgcggttgggggctgtgtctttgtcatttttgtcctcttgttggcatgcagtaagtgtactacataagtttattcactgaatggatgaatggattctggaatcagaaccctgctggggtagggactatcagtagggtatagggcaaataaattggccctgtgagatacatgtttctatagtcctgggtctaggagggacccttgggggcttgagaactggaggcagaaaaactgtccttcaactcagcagcatgctggggtcttggagagagtctctggggctgggtgtgccctttaactaccatgtcccttgaaaatggtagccctgagaacatatgcaaacatgtattcccttgggaaacagagtctgacattctaatgaagaaccagcacacttgactttgatcaacaccagccttataagcagcatggatattgaaacattcagtaaccagcatggcatgtgcatgggtcagtcagaatgcacacaggccacagggctgaagcagaggtctggagggctccattgtgccaaccattaactctttagtagctggacagtagggggtatcttggaggagggtctgagaatagcaggagaaacatgagtaagggggcttgcagcggtgactactgaccagccagtataaaaatatttcattattttaacaaccggccctggtactgctccaccggtgcctatcagcccgttgataagtcttgttaaagaataaccacagttttggctgggcgcggtggctcacgcctgtaatcccagcactttggaaggccgaggcgggcagatcgcctgaggtcaggaatttgagaccagccttggccaacatggcgaaaccccatgtttcaccccatgtttctactaaaaattcaaaaattagccaggcgtggtggcgcatgcctgtaatcccagctactcaggaggctgaggcaggagaatcgcttgaacccagtggggcggaggttgcagtttgcaccattgcactccagcctgggccacaagagtgaaacactgtctcaagaaaaaaaaaaaacaaaaaaaaaagaataaccacagttttgaagcctcaaaggaaggtgtgtgtgcatgcatgtgtgtgtatgtgtgtgtgaaggaatgaggcagagctctataaaggcagtactagagtggaatctttcatttttagttgtatttcaatataagcataaggaggtggaggtgagagaatttcagactgaggaactgaaagagccagggcacagagtgtgaaagggacctatttgggagaggtggctgtaggatgctgaggattcctgggggagatgaggaaggagacagaggctggagcaggtggccaagggccttgaaaaccatgttgaagcatggtgacctggtctgtgttcctataggccgccctttaggcaaaccttattgcttaggctggcttttgggtggtccttgctgggacaaccagtggcgtcatcttcaccaagtctagggtggtcacctggtgatgggaacaagcttctccttaattaagaatgtcatagcagcctccctggctccatggtgactgacgctgccagtccagctgccatgtggccgatgtgtcctaccgtggtacatcatctcctaattaacatgtcttgtcaggtccagcggttggctttagtaaatatgcctcaagcagctgtcactgggaccctgcgtggggcctgctgcctcattagctccagagaagggagatggcattggcggcaggagggagggagaagaatgttctttatggggggtgttggcaggattagagggatgtcagatgctcagagagaactcacaggccccagtggagggcttggatctgagcaccatgagcctctctctctcccatgtgtagtgagaggataggtgggtagcagtgtgggcaggaaaacagcccaggagttgggagacccacatcttcattctgtctctcccaccaccgagcaaggctcggtctcctggtttgagaaacaggaatgatcccagctctacctatcctgaagtttgttgagtggttctaatgagcaaatgacctatactattctgaaggacaagaaatgctaaattttacagaaatcaagccagggcatggttgtaatttggggctatcagagagaagtctttgctcagacaagactggtccctctgaacacacttcgcccacccctccaaggcttctggcctgcatcccactgcactgtctgagcactcatcaagacctgctcaccacccaccaatcctgtcagactctttctctccagcctggcctcgccttctctgtgagaaggaaaatgagaacattccggaaggaagcactcttctttctctggctgctggagtaccttccaggctgtggaggcagggagctgacttcacagtgactgaggagacataccttagcccacccccactggattttgagcacatgcctaaactttgtacccatgagagcacatagtaggtggttaatgaatgtttgctgagcaggaagaacagtatatcccgttctcctagctctcaaaacaatggtgggtgatttcatagtttctttcagcaacttgttctattgccaacctttctataagccttcttctgagatccagcccagtctccttgggcagtgtgtatctgtttcctctttgtccccagcagagaatagaaactgactgtcattctctctgcctctcctgaaagactaatactaagcactcttatctcaccccttcccatctttcctattcatcagatttcctggagcccagcctgctacctggagccagggcctcgcctctactgccccctccgctcgctctgcctgtgcagggtccatcctgaggagagtctgagcaactgaggatgttgtgaaagcatctgacagcacagggaggcagggcttccccagcccagcagaggcaccaaacccacgcaatttgtaaatctttgataatgagcatttaaagggcacgtcctaatgaagggagccaggaatgactggccatggaatgcaggcagaagattttaattaaaatgcttgtctttttagttttcctcttcccttgtctcttccaaacaccacctccccccaacccctgccaatgatgcacatgtcttgcttctggaccaggcctgtgcaaaaaatgtgcgtctcatatttcccttgatttagttgctctctgggggactgggtgctcttcttcagctgggcgcgctgtgtgggtttgacagggactgtgcacatgtgggtagaggcggaccaggactgtgctgcctgcagccaagcagatgtcctcaccccaggaagcacagtggggctctaagagagctcatgaatgagtggcagctgccagccttgtgagcttcctgtagtgaagctctggggggagctctggggggccagctgggagacttctgggccaaaggggtgttttatggggcctctcacgatacttttctctccaaatggctaaatggagtgtggcggcagagcagctgtgagggactttgcactgctctctctaggggtggagggaccgttggctggatgccttccacgtgctcctccagatccatgtccaccctgccctgtgccctgggaatctgagctgtgtggattccagcagcagacttccttgctataggcttcagattgggtctgcccaatgaggaggccttggcaggacatgggcggaaataggaaaatgaggttggactatattttctggcgctttctttgtgagatcatctcagggctggttgtgtcttttgattgaagtccacagtgcctggtaaaggtggcttctctaaaagatgctctccttcctggttctatgagccactctgtcccttcactgctgccactctttctaaccccaagatactatactcttccttgtattactcctggagcaaaaccttgtaaacagtccctttattaaactctccagattccccaatttctgtgtattgtctgttttctgccaggatcctgatagattcacctgttcttttccagactggttccttcgcaccagacacatggtcagaggggattattcatgttattcctgggatcctagctctgatgtggaatgcaatgtagtctggtgggtgataaacgtccctacttccacatagacggactgggtttggaaaagtgcttgtgaatttgtttcccaggaactgatgatagtctttggacttctccaaaggtctgtgtcgaatggaatataagccccctctctgtgtgggatgaggtgggagtggggatttattcctccccaacatgttttcatctgggctatgatgccattctcattttatagacaaggccactgtggttgagtgacttacccagaatctaagaggcacgttctcttcaactaatatttagcaaagaattaaagcaggttttctaccaattgatggaaatctttcctccttttgttccttgccccttttgctatttgttcactatgaagacctggcttcaaggatcttgtggggaagtgagtagggctttggtcttggactgggaaaaactccactcagatacactctctgtcagtcaagctctcaggcttttccttatccagcaatgacttacctcttacctctgcctggagctggcctctgagtagggtttctgatcttggcttagcagactgattgcctcctgcttgtgcctcagggccctaagcttttagaagcatgcctcactcccagcctaagagcttgtctttgactcctgattggccctttttcctgatgtgtgggttggtgttctcgaccccacagggcgctgaactccagttagaactgccacccatggcaactccacagggtgagcccgccctttggacctgacactatgtgcctgatcactctttcacagacgtctcccttccttcccactccacccgagtcaaggctcctgaccaactaggagacagaggccctttctccttgacacgtcctgcctaaagtgtcagcttccatccctgcctggtgttccccacaccaaaatatgaaaccaatctttcttctcatacacagtgacacagtagctacttcgtgttccctcttcattcagttgtctgtgcaatcagtctgtatgtatgtattcattcattcattcattcattcattcattcattcattctgctatgtattcagcaacctctaggtgccacagcttgcaaatatcatctgaattcattctcacagatctctagcagatctctagtgttcactgttactgccattttacacatgaggaaaccgggtcaaagagtaactaagcggcttgatgagggccacacagctggcaaatgtcggagccagagtttgaagcagaacgtatggcattcgcactggaattctcaaaccccagcacaaggcacctattcacagacagtttgaagttgttcatatgcagaatcggaagattctgagcagattccatccctcctccccataagccacacttccattagctctgctcaggacaggtgggcccctgtgtgttggaaattgagatggagagaggtgaggagagaacaccctgagggagaagtgtgtgggggtggtgcaggcaagaccaattcaccctgaggtgatttgcatctttagcaggagtacatgtcatgctgtcacagccttttcctgtattgacataataacaatcctttacttttgttagcactttgtagctttcaaagcagtttcaaatccattagctcattttattcctacaacaatctcacaaaaggcagaaattattatccttattttgcagatgaacaagctctgtgaggctatataacttctccagagtcaggaagcctggatgcaggcctagatacctgactcctggtcttatggattatgtaccttgcctcacttttctcattgttactttctgattttgagccatttagggggaaaggatggcttcctagactctcagaaacccctcactcttgggttccaggccacctagactacataaagcagtggttctcaaattttatttgacaccgggatcacttggaaggccatcacatagattactgggccccactaccagagctactgattcaggaggtctgggaggggcccaagaatctgaatttccaataagttcccaggtcaggttgatgctgctggtgtggtctcacactttgaggaccacagatataaggcaatgcctatgagtctttagctgaatttctctaatcagggctcttcttctgggctgcagaaacctcagatacagaaagaattgcccttgtgggtctctccctggggtgagaaatttgtgtatgtcttgcttcactgactgtggtgtgacccagagaatgggaagaaaacctcaggctttttggtttatacacacacacgaaaggaaaatgtccacacatgagattattaattcattgttcaattaagttatgatctctaaaattatcacaatatttggctcggaggaaggcagcactgaatagcttgttacacgtaatgtgtgaataatgtaactttattacttttcccactcgtaagtaattgtgactgacacattggcaataacacagattgccttcttaccttcccctctctctactctcagcacggagcgtttactttcttgtctctattattttcttgctcatcctccttccctgccacaagcctcctccactgcatattagccactgctgtaacaagtatactaatgtctcctcatcaatttttatctcccaatgcccaggcacttggagtctaaacttaaaaaaaaaaaaaaaaaagaccaggcgcggtagctcatgcctgtaatcccagcactttggcaggccgaggtgggcagatcacttgaggtcaggattttgagaccagcctggccaatatggtgaaaccccttctttactaaaaatacaaaaattagcctggtgtggtggtgcacgcctgtagtcccagctattcgggaggctgaggcaggagaatcacttgaacctgggaggcagaggttgctctatcaccactgcacttcagcctgggcaatagagtgagaccctgtctaaaaaaaataaataaacttaaaaaatcattctctattaaaatccagtctaagcactgccatgatttgggtatggtatgtttggccatgccgagtcccaagtctcgtgttaaaatctgatttcccaacacacaccggggcctgttgtggggtgggggtgaggggagggaatgtagaggatgggtcaataagtgcagcaaaccaccatggcacacgtatccctatggaacaaacctgcaagtctgcacacctatctcatttttagaagaaataaagagaaacaaacaaacaaaaaaattgattcctagtgttagaggtgggggctggtgggaggtgtttgggttgtgggggtggatctgtcatgaatggcttggtgtcattctcatgctcctgggagtgagtgagttctcattcttcgttcccacaagaattggttgttgaaaagagcctggcacctccccctcgccttgcttcctctcttgctctgtgatctgcacatcccagctccatttccccttctgccatgagcggaagattcctgaagccctcaccaaaagaaaatgctggcacaatgcttcttgcacaccctacataaccatgagccaattagatctcttttctttacaaattacccagcctccagtattcctttacagcaatgaaaagggtctaagaaaaacactgtcttgtcttccttttccatcatccatcagtgtatgtttttgtaccagcaagtatgtttatttaggcagaaccacaggtactggcaacgtatctacagtgtagacatgaaaagaacaggaagagcataagtaacagagattttgttcacatggtttagtcatgttcccactgcaatgtccctcttcatacagtatttcttacctccttccacctcttcagaaagtacagcgtagtccacatgaatgagacctgagtgcactggggcatccttccctcctgctctgggggtcaggtgtggtaatctggcttagcttcctccaaagctccagttggaagggaacacgttctctttttctggggtgatccagtgtcgaaggccaatttacatgcagactgggtgtgttgtctgtattgctctgttcaccggtaccgaaggctctgagtaaggtggaatcagaccctactctactttccctgaacagtgagagcagcaagagctaacagctgagcatctactttgtgccggaccctatgacatgcactttccatgcattcatgcagtcttcacaataattgaatgtggaaggtgccattgttccctgtattgtaccgctggccagtgagagccaggagcctgtgctcatcacaataccatagttttcagccccccaggctaacatctaccctctctcgtggtgcctgggacccttctggacctgatcaaggtgtagcagctaatggactcggaacaagtctctgtagatttgagtggaggcgccacttgggctggagaggcttgcggggagctttgcaggggaaatgaagcttgactcttgggtcctcagggtttaaggtttgccttttttctcaaaaaagacttaaagggaaccaggtcccttgtacctgctgtgtgcacctggcaaagagtgcatcgggtggaatgcagtcctctctcaccaagctcttgcactccattgccccctagcctagaatacttgctccctgctcagtaaagaatcaaattcctgcaaatatccatcctcggtcctaggctacaggtctgcgccctctcggaggcccttgctggtgctctttccactaagcctcactgcctctcctgtcttcaaggggactgattgcactagggaagtgtggagggagggtatatgcacccagggaagaaagcagcacagcacttctcacagctctggtctacagttgctccactcagcaagtggggacagttccagcttctgggctcttcttgcccctaaacttctcctcgatcaggagtaatatagtctgagaatgagcacaaagaacactttttcttttaaggattgaccttttgctcaatgagcaggattgaaccttgaacccaacaaaagggtctgcagtgaggcagggctggacagctccacctctaggcaggcacagcaagtgtgggcattgcttactgcagagaggcttcccttctaaatccactcatggggggtgccaggtgcttccctccaaggcagaaggtaacccctcccagtccagagcaaatcacggtctccatgtttttcctccctggtcccacataggtgagtgatatatacagaggttagacctcagggttatgttatggattggagggagcagagaagcttcctcattaaaagggctgggctggttggctggctccaaggccctcagcacctctgggcttctgagccatgggagagttggacagaaggctgaacagtggctgatggcctggaggaggagatagggagggaggagaaggctggatgctgggttcccattgtacacccccagcaacgagcccccctgccagcccagagtaaccagagatcttgggccacaagtcagacacacctagactaagatgtggctttgaccccagctggatatctgctcacgtcatcaaagctcttgaggcctcagcttccttatctgtaaaatgtggctgggaatacctgttctactgatctgaagaattgttgtggtaatctgaagaggcgattggtataaaaataccaggtaaaaggcagagtgtgtcccatgaatgagacaccctgtccttctccctcaagacatcctctttgtttctcattcccaatatgaaaataacaaaccattctagggaacaacttggttatttttgggtcatgggcagggccagcaggcctacaggtagcgggagggatcagtggaggaagcgacgtgattcctgtaagacttgaatgcccctgagtcaaagtctgctctgaagaccagcccccttagagtgacagagatggggctacctcacaactctgccacttactatttttaggaccttggggaagtcatatagaattttgaattttagttccttcatttgtaaaaatgggaagggtaatagcactatccttagcattataaaataatggatacttatggcatacccagggcatggcatgtgctaagcattcaataaatgtggactattattgttatttcctttttgagctagttgtgtttgcttgctacggaggaaatacccatttcaaagaattgggaggataaaattaagagactggtaacccagcatctgccgtttaacagatgccctgtaagtgagtgccttcctctttctcccttctggcacttgttctgttgagagtctgtgatgcccaaaccttggaattaaccctgatagaaaaaaggcataaagccactggatatgtggcagctctgccttcgtgttgggctcacattacagacatttgagtgtctgcccctcatcctgccccccagatctcactgctctctgagtcttaccttagtctcctgtcttttcttctgccctcctggacccagcttactgcctgctctgctgccagcaccctttcttgtgtcttggtatctgcctgagacctttgttttgctggttacggttgtggcctgatgggctaagctaggccctttgtaccacctcagaacagcaggggatgcagcaataatgccaactaggagtccggatgatctggacttgaatttgtatcccggtttaaccacttactctatagccttaggcaaggcacttaatgccattgcatgccattgtcacatcaatacaatgaaagtaacacctatatcatggcattactggaagataaaaagagatgactgagggataaaaaggcgatgtgaaagtccctaggagggtaggcacttagtaatactaggctacctcccttcctcctcacttctctagtctcaatgcctgcttaggggaggggtagagatcagggtggtgagttgtctcctctgcaggatgactcagcccctccctactcccctactctgttactgcctttgcctcatcatactctggaaaacctagactaaagtaagttttttagctggacctatttttggaggtggagaatggaacttcctcactggtatgctgagttttgatttccatatgggctgatttcagagtaactgggaaaattcagtaattagcagtagcagcattagtgaatcatgttgtaatcatcctcttctcgcttcttccctcttctgcatgttccaaatgctattaccgacactatctttccctccactggcccttggcctcatgttcccactgcagacgttgtgcttcctgcttagcactatgggtcagcctctgggtactttcctccctcccagcctccagcctcctgctcaagcctctgcctatttgtccagaaccctggtgggcacatttagctagtttctcctcttgcaaattcaacctacaggtttatttcaattcaaagaaaaaaatgactcatctaaatcctgataaaaacatggctagtgctgtctgggctgatgaaatctacttggagaatggagaacctaagagaaccttctctgtctaagtctggatatctctgcggatggtcacttaaaaaaagataaaaatgcagaggagggttttccttagcaaaaactaataatcagtggctccatccatttatccatctatccatctaggaaacatttacacaatgtctacaatgtgccaagcctagcactgggctttaaggacatacacatgatagctgagaagactagcaagtaaaccgatgaccattgtacagtggaaaacatgccaagagcacagtgggagcatgagtcagtgagcagcaggggcagctcctctgagagggaaatgcttaaatattgaggaatggagagaatttagctttgcagagtttgctttcattggtatgcgtgtggaactaaggctcaacaaatggaaacctgtaaaatctatacttactcaaatttttgtagagcattgtaatgtgctgggaatgggaagctcagaagaggaataataatgggctttgctttggggtttagcactgacttctcagaatttgagaatttggaacatttaagtaatcccatttcctcttgacagaattttcctaaaacatgccagagagataggaatagaaacaccttgcttgttcttaaagaatctaaatctccacaatgttccctgttcattccatcatctcctgttgttggaaaaacgtacttgtctgtcctctggctgcaactaaagtcagtcctctccttagggcacccaggaactcttgatgtttcaccagtcctcttgctgagctaaacccaagagttgttctgtgttctatactgagtctggcctagtgtcacagaatctgcattagacatagaaatcattactgcataaatgtggagcaatattaacaaaaagctgaagcattcagatgaagaggcagctgttttgccttaggcgggctggggtgggtagccccatagtccgtggataattctccctccgtatctttccctcacttatcctatatgttcacgtcactgcagttatttggtgggcagttgtagtcttagatgagctttagtgaatgggagcccagcttgagggcttgaaattcatttagtgtaggaaccttggtgagaaggttgctgctgtggaggaatcgctatgtgaaaggactttagtcttcaaaagccggctaatgacccaggcatcaccccgtctccccatggccccagtgacagcaggcacaatgtctggatattgagtaattacctatttccttttctagatgatgtaagctctgttttgcttaccactgcatccccgggggctggacagtacactttaatgatttttttttaattgaatgaattaagattcacaagtaatttgaaaggcatctctatttatctcgctggtgtttctcagtcctgggctgcattgccaaagtttccagtttcttcatgacttggccagccccccaatcatcccaaagcccagttaagagaaacacttcggtgctaatagatctggaaacttaagctctggagggccacctgtcagatgagatttgccttcaaaggccactggctctgaccttttgataacattttaaaaaaagaaaccttacatattgactgaatcaggcctgtctccaatgaagatctaggcagctatttgtatttctgtttggatttttgggtccttttctttttgtacctctgggtaagcaaaaggaaaaacgttcctttgctttaccaaacctcatttaaaagttgtttgtatatattttttaatggaacccaatcccttaagcctttaaaagtaacctctactgagctcaataaaccatttccaatgtggcagcttctaatccaggagagttaagaaggcagatgctaaccaaccaccaattgcatcccaggacagttgctgaaagtctcagggctctgcaagctggagatgagatcggctaatcctgactctattctttcgtctgctctgctagctggccctacttgtacaattaatattctccctggtgttgattttgttcaaatatattgggcccatcaatcacccactttccaactcatctgtctggatcagtcatttacaaagttatttttgagccactaggattcttgtgaaatagacacaagaaggagctaaactcatttcaggtttgacctctgtggctgggatctgagaaggcttagtttgattacgcttcatggccatccaatccaatctggcttgtagaatagaaaggccacttgcttaattgggaacactttaatatagatatccattaacttatgctaaattacagtaaagcatctatggaggaacttgatgtgacatctgcatgaatactaaataacttcattacgatcagtactgtgacaatgaatatgaaatgaacgtgcccagagaagacaattaatctcccaccttcccaagccagtactgttttattttaccctgcattgtactaaaaaaataaggcatagaagctctatgattttctgtctatctcactcacccttcagctggtgagtggtccccgagagcttctgtcatttgtagagtggaaactgacccaccctgaggaatagccatgggcagtgggtatgtggggctcctggggacccactttggtttgggaaaggaggttgtcaagactaactgaacacaacacacacacagacgcgcgtgtgcgcgcgcacacacacgcacacgcgcacacacagaattaaaaggcatcctcatccggaactagcaaacagactgtcagttcagattagcaacatcaaaagcattccaatctgttccctgcatacattacatgcatagatctgagagaagaatttggcctctgaattaagtcagctttttccttctgggctgcttgtacctgaaatgtgtggcgaagagggtccagcagtcagattaatacacctcatagcatttagtctgaaccttacagcatggtcttaaagagacaccctctcatattacttgctgctgtttcacatgggttctttctgaatctggaatgaaccatgggacccttgggttgaagactatgcctaactctgtatgaggggtcgctcagaatggaggcatgcatgaaagaatattcctgggttctccattctagtcatttccctcctacgtcactgacttattgctggcatctcctccccttgaccttcatattggagtccttggatctcttctcaatcttatggctttaaacaccgactctactctgatgtctctcaattttgtatccacagcctagaccaccccctaaactctggactcatctatccaattgcctagttctcccctccacttgcaatgtgtaacaggcatctcaaatttcacatgctccgaaaagaactcctggtcttctcccacaggcctgcccctctcacggtcttcttcatctttgaagaagatgataaacttgtcagtggcaattttatccttccagttactcagaccaggaaacttgaagtgagtgatcctagactcttctcttcctttcacacccacatccaatctgtcaatgtagcctgttgtctcaaaatatattataaaccaaccacctctcaccacttcctctgctactttcttggcccgagcctcatcacttgttgctcagatggttgttacagtcatggttctgggtttagcagggtctctactccaggccttgtctctgaagagcctcttggtggtcacaaagctacttgccactctcatcagatcagggtgcagggtgtcatgagttttacagattctggctacaaatacctgaggtaaaaggatacctttgacattagcaacaacaggaagggagaaaattgctattaccacctagactgtgagcaaataacattctggccagtgggatatgtctcaccaatccatttacaggtcgcagacatttacaacaccagcctcctggcttcttatggggatagtggctgcatcatgtcccactgcacccttgcagctgactccatacccctattacataacacaagtctttctccttctctctttgtacccagaggctccagcatatttgcatagcatttattatgctatgtaaatacaccattatatatgaatttatagcatatgtgagaactcagagtaaatccaattccatctaaaaccacgtaatactcactgaggttcccaccacagtccccttgcttacatgtgcacatcctcaacttccactctttctcaggtcaggaacgtgtcaattctgcaacttcaagtggcagttagggaaggatcctctctccattatatgaaaagtaggtgtctagtggggaggagcttccttctgaaatgctcagaaatgtaccgatgtccttagatgctgcagatggagcccagatcccagtgagcgactgctgggctgttcacagagagccagaggcccctttggaaagggtggatctccataacccatgggaggggagggacctccaacaatcttgttagtgcatcaagtaatagatttttgacagatgctttcctgccttctagtccaaacttcaaaatccttcctgcactggtctcattggggttggtggttagttctcactttccccatttctgagaccagcaagaggctctgtttgcgccaagtctccctgtaaacactgtggttatgcccacactaggcaatgccttcctgggagataacattgcatttattccaggactcctacagggaacaggaggggaagaaaattgcctctctgtgaaagcacattacaatgtggcctagcccaagctagactcactagaaatgttaactctgccctgcactttccattccccatcccctttcctctgccttttccaagcaaactcttactctaggaaatacatgtttgattttcttgggtgaccaccatctccaagagaacctcttagaagtaggccaaggagcaaagaagaagtcccataaaggtcaagagcatcttacaggaaaggaaagtggttacggcagattgcaattgtaggaggaatgacacaaaaggggtaggctagaaccagagtcacataagaacagccttctggaggcagggggatggatgaaagaatgtctttatgtcccttcaagggttatgattttgtatgtgcaaaattctgaactgtacatccagttgaacaaagtaaacatttatcaagcatctcctctgtgtcaggcttgaagtgagaaattcaaaggtgaaccaagcatggttccagagtacaaggatcctacaaagtaaaagggtaaaaaaaaggtactttggcctcccttcttccctcccatccatccatccatccatccatccatccatctatccatccatccaatgcaaggcatattgtaataaaggagacacaactctaggcagatgtcatgagcactggaatcagattggaaaactgagtctgccacttactaattctgtaatattgggcagaaaatgtaaacaagcatagcttcaattttcctatttctataacaagaatattaatggtatctatttcatagggttaacatgggaattaaagaagataatgcatattaaagttcttggtacatagcagatgctcaataaattaatatttattaaactaatgaattacaaataaagaaaatgttagggaaacacagaggggagctcatcaatagttgaagagattgggctaaaatttacaggaaggatggaatttgagatggtcttgaagaggattttaacacatgcagatggaagctatttcagacagagggaaaaaacatgagtattgaagtggaaaagaggaggtcatggttcagggaaaggtgactagtgggaaataggactgaagatgtaggctgaggcgatatcatggcaaatctttatctctacactgatgatatagacttgatccttgggcaaaagtgcattagtagggattctggagcaaggcataactgtggtttaggaagatcaatgtggcaacacaatgagtaggattgtactgaagatgaattggagatagggagaggagtttggaggcagcagtaatctcagcgagattacgtgaggattttaacaaagctggtgacagtagaaatggaggaaatagaaaagagttattatgaactggtgaccaaaaagatgaagagaatgaggggaggaagagcaaagctgaccctgagcatttagggagaaagaattgaaaagatcatgatgtcaactctagctcgagaacacagagaaaaggcaagagtttttgcaggaaggtaagctatgtgctagatggagagttagggaccttgtaggaaaccacgtgcagatgctcagtctagctggaactatgtgcctacagtccaggccatcgtccagaactagatataaggaagtggcatcagcctcatagggttaatggctgaaagtgtgggaaaggatgtcattgaaaaggggctaaaataactcttgatttaggggactagcatggtagattgaagtagatccagtgtatagtgggctatgagaactgggaactggaaaatcaagtaggcagaaggacgaaaagctgagtgttactaatagtagaggtaaaacatgaggctaatagagttcagggactggagccaccaagggaagtgggaaaataggaaaggatgaaaagattgaagaccaagggaaggccaaaaagtaggtcaagagggagtgagaaaatgagtgaggacagagaagaactttgacaattggagctgaatgttcagtagttttgagtcgtgcatttcaagatgcaaatggggtagatgcaggtcacttgggggaagactgctgggacctgaggaggtcagaggcttgggaggactgaaatcaccaaggatgaagctggtgaagacatgggttgggggtgggggctgaaagcctggtactaaaatcctagaggaagatggagtcatgtccagaaaacctgcagatgaggtgagaagaataaagagatggtacagtggatggaaatattggggcaaattgctgaaattgaagtgagtctgtggaaaacaatatgcaggatgaatttatccgtctcctattaaatgcctcaaagagttaaagtttttaagttggagggtcaaagaacatctatggaacaaataataatctatagatgtacaaagctagcaaatattttaagtgctaaaatgtgtggtgctggtcacaaatagcttgagcctggtgcctttgaccagccctcctgacaaacagcgaacgtgccaagtcctacaaggcaccgttgcagcccaggagagctaaaatctatgccctggaagaggtgaggacttgggatgaaccttgagggaggggttggggttgaagtgggaggagcatttcagtcaatgggagagtggataaatgagcagaggtgaagtgaacacagcatattctgaatatatcgcaagaggggtgcagactgggcgttatgaaggaaaaagctggaggaagatagagtgggaccagaaagtgaagggatgcagactgacatcgtaacaattcaaatgctaatgaaatattctcaacttgagttccctgcggttgtggtcatgggccaattgcagtattcagtttttatgaagacctccagcgtcttcatgtgtggtcctcaaatcctgaatacttctctcccagagcatttaccacacggtgctgctggtatgccagcctttctccttccaccgtgagccatttgagggcagagaccagaccatctccgcagcctctcaggctacagggtaccctgcattatgcagactgagagctctagaaatatttgtggcatgaatgaaagaattcatgagtaatagccgggcataaatcagaatatgcacttgaactgggctacagtgttccaccagaggccttccacatctaaatggaagcatcatggcacgaggtgaaattctaggtttctgaagaagaaaaggtaagaaggactctcaaagcctttgttaattaaaaacacacacagctcttcagggaacatttccctgcctcccattctccctcgttgtactgaatggcagataaggtggtgtcttcgcctatgctttggaccacatttaattaaatgcctacattactgcttcctcacacaccttattttatttcctttccttccttccatgctaaagagggccagggctaatactaatgcatatgctgttaaacctttttaattaacttcaacttctcccagagatttatgtttaaacagtaaattttttgttgatactcaaatacataggcggcactcggaatgatgtacgagtactcttgtcctcaaaatgattcttcatgagttaccaccagagacgttttcatgagcctcttttattaaaataataatactcagcaaggcaataatgctttacagccggcagctaattaacccaccccaccccccaaacaggtcagcattagcatctgcaggttcgcgatatgatcgcccagtgggtcccccttgtaccttcgagtcagcactgaatcggtctgggtttgtgctctagcatctgtgaataatgattttcatttaaaacacatctttgttcttagactgtagctcaatctattattattgttatttattttgttcttgttagtgccttcctgcactgggtatcagtatttctgatctgcagttgacctcttgaaacaaaatttaaccatgccttggaaaatccaattgatttaaaactcttgtctaattgcaaaatccatttatttttctgcaactctaaatttgtgccccaagtatttttttttttttttttttgagacagagtctcgttctgttgctcaggctggagtgcagtggcatgacctcggctcactgcaaacttcaactcctgggttcaggtgattctcctgcttcagcctcctgagtagctgggattacaggcatgcaccaccacacccagctaacttttgtatttttagtagagacggggtttcaccatgttggccagactggtctcgaactcctgaccttgagtgattcacccgccttgggctcccaaagtgctgggattacaggagtgagccactgcgcccggccaccccaagtatttttaatcatgatctatgctgtcaattgtaattgcaatgtagcaattctttgccaacaaaaccaatctacctacccaagctcctgttcttttcttcatgttgagacaacgtttttccccacaagccaatgtggtcatatcacatgttgcaccaccgatgagccaattatttcaattttggcatcagatttaaaagagactttaatgatcctcaatggtataaactgaatttttattcctacagcaatttagtaatgatgatgacacttaagcatttagaaagtattactcatcttccaaccactgacaaacaggaggctcggcacttttcattttaggcacttttctaggcaagtctgatggggacctcagcatggacagcatttcacaatatttagggagcccaggctcacccctgctactctgccaggagctatagaaagaaaaatctccaagccccagtgcttgtctgctggggtttctagctggaaatcagaataagctcccaagccttgcatgcccgttttaattaacttgtctattcacgcatccaacaaatatttaatgagtttctgctaggtaaggaaacccagccccaggagggagactgagatatatgaggtatacccctttccctctaatcaaattcaaccccacccctctcaccagggtccaagttatttgaatacttcatttatgcatacgtttactcctttcattcagcaaacgtttatcaggcaccttttagtgtaaggtactctgctgggagcccaaaagtttacagcgaagatcaaatctgtcagcaaatccctttggttcttccttcaaagtaaatttggaatctggtcttcttgcccctccaaggctaccccctggtccaagtcacttggaccctgtgcctggatggcggccagagcctcctaattggtctcgcagcttccatccttgtcttctgctgtctagtttcaacagggcagtctgagtagtgcttttaaaaacctaagtcagagggagccgttcctttgttcagaacggtgcagagcattccatctcactgagaatgaaagccaacaccctctccatgactcatggtgctctccggggtctggcctcgttgttacactttgacttaatcttcactcttccttttgcttgcttatacagtttggatttgtgtccccacccaaatgtcatgtcatattgtaatccccagtgttggaggaggggcctggtaggaggtgattggatcacaggggtggatttcccccttgctgttcttgtgatggtgagttctcacgagatttggttgtttgaaagtgtgtatcacctcctccttcacttcttcctcctgctctggccatctaatatgggcctacttcccctttgccttccaccatgattgtaagttttctgaggcctccccagctgtgcctgcctacagaaccgtgagtcaattaaacttctttcctttttaccccgtctcacgtacttctttatagtaatgagagaatggatgagtgcacttgtgctggcctctttgctgttcctgaaactcaccaggcatgctcctgcctcagggtctttgcacttatgcagttccctctgcctgggatgtcctgtcctcggtccctcccctgcttcaagacattgctcggtggccaccttcttggggactgaccatcttatttaaaatgtgcaccccacgcctataggagtactttatatccctctccctgttttacctggctgtagagtgcctatctccatctgacatgattcatctttatttgttcatttcatgtctcctccactagaatgtcagccccatgaagtcttagctatttgttttattgactgatgtatcaatgcctagtgcacagatatttaaaatttgttgaacatatatatgtatgtaatgagtgcatgtaataaatagtgctgtgataatcttcaagaagcacatgatcaaataggaactatatctaaaataaataatgagctatgttttaagaaagctagaaataaatatggtagcccaaagggtagaaaattcattttgcctggttgaatgagtggctaaaatcacagtcctacaatttcaggtgtgtcatgttggaaaatgtattagtcagttttcacactgctgataaagacatactcgagaatgggaagaaaaacaggtttaattggacttacagttccacatgggtggggaggcctcagaatcatggagggaggtgaaaggcacttcttaaatggagatggcaagagaaaaatgaggaaaatgcaaaagtgaaaacgcctgatataaccatcagatcttgtgagacatattcactacccctagaacagtaagggggaaaccaccctcatgattaaaattatctcctattgggtccctcccacaacacgtgggaattattggagtataattcaagatgggatttgggtgggaacagagccaaaccatatcattctgctcctggcccctccaaatctaaggttctcatatttcaaaacctatcaggccttcccctcagtcccccaaattcttaactcatttcaccattaacccaaaagtccacagtccaaactctcatctgagacaaggcaaatcccttctacctatgagcctgtaaaatcaaaagcaagctagttactccctagataaaatgagggtacaggtattgggtaaatacagccattccaaatgggagaaattgaccaaaacaaaggggttacaaggcccatgcaagtctgaaatccagtggggcaaattgtaaagctgcaaaatgatctcctttgactccaggtctcatatccaggtcatgctgatgcaagaggtgggttcccatggtcttgggtagctctatccttgtggctttgcagggtacagcctccctcccagctgctttcacaggctgacattgagtgtctgcggctcttccaggtgaacggtgcaagctgttggtggatctaccattctgggatctggagggcgatggccctcctctcacagctccactaggcagtgccctagtagggactctgtatgagggctctgaccccacatttcccttctgcactgctttagcagaagttctccatgaggttcccacccctgcagcaaacttctgcctgggcatccaggagtttccatacattttctgaaatctaggtggaggttcccaaaccccaattcttgacttctgtgcactctcaggctcaacaccacatggaagctgccaaggcttggggcttgcaccccatgaagccatggcctgagctctacattggcccctttcagccatggctgtagcggctgggatgcagggcaccaagtccctaggctgcacacagcgtggggaccctgggcccgtcccatgaaaccattttctcctaggcctatgggcctgtgataggaagggctgccacgaaaacctctgacatgccctagagaattttctccatcatcgtggggattaacattcgactcctcattacttatgcaaatttctgcagccagcttgtatttttcctcagaaaatgggcttttcttttctattacattgtcaggctgcatattttctgaacttttatgcttggcttcccttataaaactgaatgcctttaatggcacccaagtcacatctagaatgctttgctccttagaaatttcttccactagataccctagatcatctatgtcaagttcaaagttccacaaatctctagggcaggggcaaaatgctgccagtctgtttgctaaaacataacaagaatctcctttgctccatttccaaacaagttccttatctccatctgagacaacctcagcctggaccttattgtccatatcactatcaggcttctggtcaaagccattcaacaagtctctaggaagttccaaactttcccacattttcgtgtcttcttctgggccctctaacctctccctgttgccaagttccaaagtcacttccacatctttgggtatctttttagcaactctactggtaccaatttactgtattagtctgttttcatgctgctgataaagacatacccaagactgggaagaaaaagaggtttaactggacttacagttccacatggctgggaagatctcagaatcatggcaggaagtaaaaggcacttcttacatggcagtggtaagagaagaatgaggaagatgcaaaagtgaaaatccctgataaaaccatcagatctcatgagacacattcacttccatgagaacagtatgggggaaaccacccccatgattcaaattatctcccaccgggtccctcccacaacacataggaattatgggagtacaattcaagatgatatgtgggtggggacacagcaaaaccatatcagaaaagaactgcaatccacgtctaaatgagaaaatggttccttgctataggatttctcagctagactaagaaagtcttttgggaattggtgggatggtgcacagtttgcgtgtttcactgagtcttgataattattccaactgggaatccctctccatcttccccaaatctcacaaattccagtgataaactccactccatgtctcaaacagggactatttttgagaaccatgcatgctctttccagatatcagtggacagcatccaggggggcagagtcagtgtaatttctcatggctgattttgacaggagatgtcaggttagtcttagttatcctggagcctaactggatcttgggaataaatctcttattttggtagcactttcaaataagtggcagcagttcatgcataattacttctgaattatctaggggatttatcaggtttgattatagatgcataatgaatttaccaaatttgtgggtattatggagatattaattccatatgaaacctcacaattcattcatgtgccatttgttttcattccttttttataataagctaattagtttaaattatttgtacttgtacaaggtcttgaaacacatattaggaatgattataccagagaacccaataaatgagaagttttggagacagcattaattgtgatgaagggttcataaagcagtggatgttcaattttcccatttggggtggtaataacaggtctaatcatgacacctccataaagtcatgggaagtccctaatgaaagtttctgaattcagatatttaaatgatggtagggtaagtcattatgccaatgggagaatgaggcaaaaagcggagttcatccttgtgctaaccaaagaaaagatgaaatggtgagggctcatcaattctgggccaggaggaagataggcactagtaggtctgatctgtctggaggattcctttaaaaaaacccaaggttctggaggtcactggcaggctggaatttcagcccctcagagtgaagggatgggcttctttggttgagttccggtgtctgttaaccccccaccccttgttctttgtgtgaaaccagcacccactggccaaaaagcccgggttggggtctctgtgggttgatggatataaaccatcttctttacttagggcacaaagaagaaccaagacaggagaggaagcctgggccaagcctgcctagggagtctatcgtggtaggaacaagagctaccatgccttgagcccattctaaatggtaggcaagtgctagatatttggctcacacatttcatcctcataacagccctatggtgtagagaatatcattatctccacttcacaggtcagggggctgtggacaagaggtcaggccatttgccaaagtcctccactcaatctataggtagcggggctgggttcctaaggatgtctgattctgaagcctggtccttgatctctgtgctccatgaccttctgtaatccccacagtctcccaaacatcaatgctgtcattacaaccccatcacctacccttacccttaccacaccaaagagttactcttttttgaaatctgaatctcagattttcactttccaggcaattcaccaggacagaggcctttcaactttcctccctgagatcttcctccgtgaaccaacaacaaaaggaccagccacctcactggtcctctgttgccagtagaaaaagccctacaaggattaatgcaagaagaagttctgctttgggtgagacatcagtttaatttatatttgattaaaaaagtcattcattcatgcattcagcagccagtatttgttaaatgtctcctacactcttaattgggttttgtcgggttgtgggggtgggggaggggaaaaagagagcaggtataataaagcttatgccagacaccttgtttgtaattgtcttgtgaggaatatatgtacacaactgaaaagttaagtaaacaagagaatgatggaataactaggcaagtgagagaggcagacagtgcactatctacagaatccaacggaggaggcggtactggggcccgtggtggcagaggatgacggctttgcagaggcagaggaacgactgacttgctcagtgaaggatgggcagacttggggtggcagaagaggcaccagctggacccgcccaggaagccaagcccctgtgctgcctcagtttgtaagtaggcatttgaccttgtggggaatcactctctagcgcctcaccgtctttgctgtaagatggagataatgatacctcatggggttgtcatgaaattcaaatcaggaaatggatatgaaatggttctgaaagatgtaaagagcaatataaacaccagatacggaatgagaaaaaagcggcaccggaagtggcattttgcaaactccaatcccccaggaccacatgtgaaggagctcttttcaaggtcacacggacactctgacccgactctctcctggcagcattcaatgtgacacgccagggcaatgagaaacgggaggggctgcgtgagacatggcaaggctgaggccaagccccaaagttcacggacattccataaaaagtgcacggtggaacctgagaaggtggagaagggcagggatgcccctggcactttttttgtctctggtgctatcaaacagaaaatgtcacctttgttcctctatagccatttttagttgcaccaaaggggggagttgaaaaatagaccttgtagctgcctccatgcgattcaggggaaggtgataccacttctgcctagagggtgacccccacgcccagcacatatctcaccctcagtcacagcgaggccacagccctcgattctagaatctgatgtccttgaatctccctatcacgggctcccagtttcaagggcctctggacacatgaatttctactttgagaatcagtttggctgtgtttcggtatctgcattcagcttcacaaggctggtgagcgagggctcgtggttgggacacctgacaggtggcggggaagacctccactggggacactgattttattgctagaagttgctaaaggatgagcaacttagcagctaggacttttaccacttcagtgatagaatgtaaagtcaaccccgagaagatggatctaggatacctaaactgaaagtttttttttttttttttttcacagcatattgcaatgcaacagtgaaaggaattttaaatgggcagcttctccttttctcctacctccaggcatctgcctctgaaatgttgaaggtggagggagataggattggcctttctgggaagacctctaagaaaggggtttccattgagaagaaactacgggtaacagttaaagaggaagagcatgtgtaatgtaggaagcgcttttgcttcagatagatgtccttccctcaccccagagcacagtaaccctaatgctatgtcctgcatctgtctggaggggttgtctagcctggcccacatcctgagccctctccacatgggcaaccacacagccgacatcgtgagaggtctgagcccctcagactcttgaaggtcaatggatattgtgtatcttttttctacactgcttcaatgcttttcaaccattatttttttttatttttttatttttttacaaccttgagtgttttaacgatttgcttctttaaaggctttgcttccctctgaatattatgactagcctattgggtcagaggccaggagtctgcagaggaccattcattcaccccagaggccgctccttgcttttatcctgtcctcaacatgatagctcaaactgccagattttacataggaggaaggaagacaccgaaagatgttcctagctggcacaggctgtgctgaacacaggtctcaccccactgtgggcaggtggtggtggagcacatctgtctctctccgtgttggtggctgtgatttggcagctctgccgaagatttgtgagatggagaagaaagtgcagggttggggtacggggaaaggggtaagaaaggagattagtcacttgagtcaggataatttttcctgatgtcaaagcctcacccaggagagctctcgctgttgcctgcttttatctggaaaacaatgtgagcagtatctctcaaaattaggtcagggcttgcagaggcagggacttgccaaggtgctaactgcctgaatcctcggtgggtttgcacagctctctgctctgacaaatgcctcctttgtctccctgaaaagcctgcctcttttctccttcacccctccactccccccacaaacaactgaatttggaaggttaaaaatcacttcacttgtcaactcgaaagctctccctcccacctcaagttgtttctcttcctgcccagggaaggcagctactgtgtgtccccctggggactggaaccactttgcaaagagcgcagatctgcagttttcacaacgcagttgtcatctcgggagcagtgtgtgcccgtccaccctgggagaggcttatgaaggctgtgtctcaagcatttcagggggctgcagatttagggggacagtcctggtggcttggtcttaggcttgtcttggctcaggtttctgtgtggcaacagcatgataaaaattctgtccactctaccaaaatgggagaagcaatagcaagacagcagggcagcaacagtcagttcttgtctggctttccaggacaacgtgactttctcttattttttgttcctgacactgtttgcactgactaagatatcacgatgatgaaacactgttgaatctaaaaggtgggtggggctgaaggaggggtgggaggaggccttagaagctaattagaatcctctagaagtgtgtggaaatgggaacctgagccaggagagtcctgtggattcactagattctgggactataccttatctatgctgtgcaaaggaataagaaactagtgctgtctcgggaaccagcaacacagatgttcccaggagcaatgtttgcaggtgagtgaggtcagggagggctacagagttaggactccgaagtcagaaagatgcctgttggttctgccgttcatatctgtgagatatcaggctggtttcttaaccataacctccatgattcagtttcttcatttgcaaaataatttaaataagataatatgttgaaaactcttagcacccaataagccttcaaaattataattgttttgtatgttttggcaagaaaatagaataatattattattggagtctctggaaaacctaggtttccaaacctttcaccttaagtagatttttataaaatgagacttcacgtggaatctcaacatacaaaattggcataagtgggggataaggcagcaggtgacagtggttgcgtgctcctgggcaccgcctgcccagcccctgcactgattgtcttacccacaggggcagtttaaatcttcatgcttttaccaccttatactgagtaagaagatgaatttgcacagatttctccctgcataatttctccgtatctttagcacagtttggtgatgacttttaagctttgacatcatgtactcataacctatctcttatgaaaataaatgaaactggctaggcgtggtggctcatgcctgtggtcccagcactttgggaggccaaggtgtgtgcatcgcttggggctgggagtcccagaccagcctggctgtcgtggtgggaccccgtctctactaggaatacaggggttggctgggcatggtggtgtgtgcttgtggtcctggctgcttgggaggctgaggcatgagagtggcttgaacccaggaggctagggttgtggtgagctgagatcatgccactgcactccatccagcctgggcaatggagtgagactgtgtctcaaaaaaaaagaaacaaaaaaaaacagaaaaaataaatgaaaccatgattttctctcacactgtattgtgtttaattttcatttgtttattctataaacatgacaggcttttgaactttgtattacctatatattttataatagatcatgcataatctctcaggagaataaaatgagaattccaaataaataattaaataaataaataaataaataaataaataaatcttcatggaatctcaaggctctgaggggcctagttagacaactgctggtttaaaatattagagaaatagtgggccagttccaaaaaagtagagccctgatgacatccagccagttaacatgttttagtaaccaagcaaaccaacccagaaagacatggatcaggagaaacctccatatgtggcagggcacaggtctgagaggtgagtgctggaggaaccaaggccagagtgggacaagctgtttagcaaagaagggcagtgtcattcctcttctcacccagtgtggggctgggacgtgtgggaactcagggcctgtagatgggttgggggtgaggtggagtagggagatggagacaatgacacagagacagtccgtccccagcccaaagaggactgcgctagcttgggagggaatgagactcagttggcatttctgcacatggtctgggtggacctgcgcaactctgattgtgtccatgtagaaacctgtgctgtgttcagtcactgtaatgcttttgtagttctatggctttttccccttttgcttccccttagttttcagagaaattccaatcaggctttactgctatctaccggaagagacaagaaggtaatttgaccagatcaagaccacccagcccagcagagcgcaattcatgaccagtccacagagctctcctcccggatcccatcagtttcacagagaagatggcattgccaaagcctggggctgctcacccaatccctttgtgtctgtcacagctctcccatttctggaggagtcgagttagcccctccttctcctttgaatctcttctctttaagactcgcagcttcaatacccaaatgctgccatgtctgtagtggtaatgcttggaataacaagtagttattgtcatacaagaagaataaggaagcttttgatgatctcgaataatgtggatatctacatcatttttgcatgtcagtgggtatacccagctttgagggaatggttatttttatacctttcaagacttggtatgcttaattatctagggaaactcataaccccaacttcctaagccactcctaaagaaaaagcacagatgcagtgactaaaaactttctggcctccttatacttcatctcagggctggaggtgactcagatgtaccttgctattttcatgatccattggtgtctcagtaatgaatgttcaccactgcagtgccctcatttagcctaataacctcagtaaggtaatgtttgatttgtgctaagtatctgattaaacaacataaagtatttaacctattgatcttttatactttgccagccctacattgctggatatactttaattactgactcggagagctttcctgaatgggatctgcatctcgttaagactttttctttgtctttaaggtgccatatcaacagcttctccttcttgttgcctctaggcttttcttccacttcctgctcctccgccagaccctgcttgattctgcaagactgacgtttggttaatctactgaaagtagagtcctttatgtaaccatgaatcttactgcttattttagaaagtcaatgaccacataaacaatcggacttgttactttgtccaccctgatctttggagcatgggaagttgtccaaagtgacaaccccattttaggcagttggtcacagctgttggatggacctaacccttctatctcacaaggagacgaggccagtgggcatccatcaagagaaattataggaaaccatttagactggccaattggttagctaattgctctagtctaaaccacttcttagaaaactacagaaaatgatacattttccctcttgcctgcaaggatatagtcatgaacgttaataataattagctgctttacatgctgtcttttcttcaagaatctcagacatggtgagtttatttattttttctcttattttaaaactagatctacaaaggctgagatagcttctccatgggtcctcccaaaatgagagtgacacctcataggattaagagaattcaatgagaaaattcatattgaacacttatcataatgccactgagtaagcactcaaaaaataggagttatactattagttattattagttatatcatctaagaagcctgcgacttgtgggttgcccatgaatttctgaatagagtcaggctgggaggaaggcacactggtccaagtgtctagttactttgtccagaccacctgataaagactgtctcaccctgtgtgccaacatcctttggtctctgctggcccatcacacataggtcttggacaaaaaagagtggtttgtggaggattaaaggtcatgaaaaggcgaacattcaccttcactcaagatgctgcccgaagtcagatcagaagcagagtcagaatggctctctaaacagcttctcaaaggatgccttccacgggctgatgtgcttgataacaatgcaaatgcaaggaacatgccccagacaactgaactggaatttctatgagcacagcccaggaatttgcaattaaatcaagctcgtgggtgattcttatgttcaataaagtttgagaagcatactactaagtgttgcctttaaaggcaactcgaaaacttgcagaaaacatctaaagaaggctggaggtggcctggtgcttattgtataagagcatctggcaagctccaccctctaggtggcattctggtcttgaaaagcatgataaaaatttggggttgctactaagcagggacaattgcgcagcttgtggagtggcttggagacctccaatagccctgctaggatctggggcagacagtgggcaccagccgatgccagggtatgtgaagggcaaaggaggccctttgggggaagagaactgtgaggccacaggactactgaaatagagctccatgcccttctccattgcctctgtaaataccctggggatcacttttactctattttctggcttctctgtcacttgtggtgcagttgggatgcttactttcacttccaaatgatgatacctcagagaatgcaaactgtaatgcacataagacacagacaatccatggaaaacatgatactgctgagacgtaggcacatgttcacactgacgtgcattgcatcattgcatttgttccaaagccggtaaaaatgattttcagataatctgctattttggatcgtctgcactgctgcttgcttccattagcatggctaattgagaactgactgtgtgtcttggaccatttccaggaagggaacccattgcctgtataatacaggctccctgagagagccaagtaaatggctggaaatgtcaggttgaatgcccacattggaggagcaaacttttgaggacgacctgaccattctcaggccagagaagcaatcttgttcagcatgtcacattgattgccaagtcagtaaaccataaaactgtcccacagctagaacatgcactgactctgagaaagatgaggcttggttagtaaaggatgaagccattccaagaccaataaaagatgcaatatggttttccctgggctgtatattaacaccatcctggcagctataggggatagaggcttggcaaacaactgtgttttgctttgacttttgcagagtgaggatgagatagaggccaatggggagatcatctgaggccagatgaaaggcttggaaagagtaagtctttacagaaacctagtctctaaagaaaccactgatgtttatgtgtcttggccagtgtcttctgtcatataacatcttggtgaaataccccaaatagatcttaaaaccaaaacatactaagaaaaaaggaaaatagaaagcacaatgttgtaactgccttctgggtaaccatgttttggatggtgtcatttttcttatgacataagctcccagatggcacagacactgtgtctcagaaaaaatagcaactagcagagggtcatgcctcatgtgagtttctgtaagtattgtttggttgtgtgttgtttatcacaaagagaacagatactattgtcagacaatctcaccagctgcattttgcaagaagaatgagagaagtcccctacaacttttacaattctgtgttctgtcccaaataacgacgagagatgaatcacctgggctgaaggataattgaaggaggaggcacattactcaagaaggtcagaaagcctatgtctaggattaatctgtgctcatggaatcgtttctatgtgttgctaatagctagagggtctgctgatttcatctgtgcccagtcaactccctgggcccacctctaatcaaaagcagaggacataaactgtgaagatttccaggatggatttctgaggacagctgtctatagcttcagatatggcactagacacagtggtgctcatcattggctgcatgttagaatcacctgagggagctagaaaactatggatacccaggctccatccccagagattctgatttaattggtcagggatgggtcctctgtatgaataattttaaaaatcacctaggagattttacttgcaagcagggttgagacagcccgagctaaagcctctttagtggtatgagggaaaacaggaggctctggctcagttcacaaagttgaagatcaaacccagccttcgaaacagcattcttcttctttacaggatgacaggaaataaaagactgtgggagttggggtttgggtaaagaggaaagaagggaagggagaaaaaaggagagagccaaaacgcccattgagaggaagggaataagattgattttcccctagtagtttttattcaaccagggtctgaaatgtgctcagtctacctcatgaaaagtgtgtcacccagggcacactggtgtttctatcgctagtcacagaggcttcgggcaactgctgaatggcagcattagggacccataaaaggaaaaatgcattgctatgactaagagcccattaccataacaattgtaaatgactttggggagtctgcccattgaccatcaaagaaaccagaaaacggggccaggccccttggagagcactagaggcttatgaaagccatgcactggtaatgttagtgtcttagtcccttcgtgctgctgtcacagagtacctgagagtgggtaatttataaaaaacagaaatttatttcttacagttctagaggccgggaagtgcaagatctagaggctggcatctggtctggtgagggccttcttgctgcatccttatatgcagaaggtggaaggcaagctagaacaagttagccaaacactgcataaagcctcttgcataagggcattaatcccattaatgaggaaggaagtctcatagcctgatcacctcttggaggccccacctctcaatactgtcacgttggcaacacctgaattttggaggcgattaggtttcaacatgaattttggaggagtccaaaacattcaaatcctagcagttggagatagcaaagcacattgtatgatgtgacaagaaagtcacatggaggcagaaaaagaagaagagacccagtgggtcaccccaacttcaaatgggttctcaacattaactttctagagtgtaggattttactttttccaaagtcctttctttttttttttttttttttttgctccatctctctgattcttactcatgtatttctactcagaactggagccaggaatccatactccctgttcactgtcccttctggcagaaatactatggaagagcagatgtcagtgatactgcccgatcttggcaagggaagaaccagcaagaagagtgcagggcatctccacacgtgggactgatgagcatggggagtgtggagtgtgagaggcaggagagggatgtgggggaggttttgatatcatgtctggctttttttttttttttttttttgagatggagtctcgctctgtcacccaggctggagtgcagtggctcgatcttctttcaccgcaaactctgcctcccggggtcaagtgattctcctgcctcagcctcctgagtagctgggactacaggtgcatgccaccacacccggctaattttttgtatttttagtagagacggggtttcaccatgttagccaggatggtctcgatgtcctgacctcgtgatccgcctgcctcggcctcccaacgtgctgggattacaatgtctggctttaacaagacaaagcttttgatagtttatctcctgcaattcctggttttctctaaggtggtgctggtttctactacacagggagagggatccacttgtcataattaaaacatctcatggaagcgtatgcttctgtgctttcctggaaaatgtactaatagctggggatggcaggttcccagggaagtggcacatgacatgtcaggggagtccagcaatggggaggcacaactcctaggcccttagatttgtagcctctgaacccattgcatcctggagccagttacagatttcatctgagggacaaaaggagagtgagagacttggaggctccctttggagctctctggcaattcatgattgttgagcaagaaagatggggaatgaggaattagttttcactgaattgccacagggcctgctctgactataagcataggagagccaccccagtcctgtaaagccctagagttgggctagcaggggaaagcacaaggtctggagattggaaggaattttcctgagagtgtgtgtgtctgtgcttttgagcctgtgcccctggcacaagggaaattaaccagactctgcatgttgtgggaattctgcatggcaacctaatagaggcttagcttttcattaaaatttccattaatactggagctgtttagagcaagttgaatgggaatatccataatgcacctcctatcctctattaccattctgaggatcagagtgaggtttcaggcttttgctggggccattagcattttttttttttttaccatcattatgatcatcaacccagcaccaattatgtagagcaggcaaagtacaaagaggctcacacagaacctatccttgtcctatgtgacaggcagggcaagagtaagagagcaggcacgcagaggcagagagtgaagtctagtgagaccacacggacatggactttccagtgttgagaagcacctccttcctcccacctgcctactctaaatgaaacagctctgtcatactgggctagagcaatctcaggtgcagggaaggcatagatcttctgttggaactggggatactgaaagggatgaagaagttcggcctcacctcttgaggatcatttctacagcagagctgcccagaggatcaccattgttaccagctccgatgtgcccttcctgcatgccaaagccagttctctcttggagatggccactgttgctctctgggctgtgggacatctaggaagctgatgtccttgtttcagggtcctgggaggctgtttcaatgacatctcatagagacactttcctttctaaccctggctgcagcctcatggcactacttcctcatctatgaacctcttgtgcccttagacaggggggcattccctgcctcaaccacaggtagctggagctcattctacagtgtccagagtgaaacctgtcccctccaggcagaatgaactgtgctcttactctgcagccttcgacacattattcataacatgatgattattttggagtgcgttcttttgcttctcacaatgagcagacactctactttatccagcttgtatcctctatgctaagtgcacagcagattacatggtagttccttataaattttttaaaaattgttgtagatttccttccacctgcctgaggtgaggctcaacactgttactgatgaaacagtccatgtgtggaaaaacagagcccattaaaaagaaaacccaaacacagctaatagtctgggaatggtgtctgcaggatgatgcagttgacacattctgtttgtgccacacgtgtgttttgtcactgagactgccagctctgaggggaaaaattctactataagaatatttaaaataagattgagtacagtggctctttgccaggtgtgtgtttcaggaggcattttaatgagaacatgctgtcatggtctgaatgtttgtgtttctccaaaattcatgtgttgaaatcctcacccccgaggtgatgctattaggaggtggggcctttgggaggtgattagggcatgagggtggagccctcatgaatgaaattagtgaccttgtgaaagaggccccagagagctgccctcttccaccatgtgaggacagagaaagaaggtgccatccatgaaccaggaggcgggtctggaccagacatcagatctgccagcaccttgatcttggacttctccacctccagaatggtgagaaatacatttctgttgttcagtctaagatcgtttgttactgcagcccaaatggactgaggcacatgcttcagccccagtggtgaagagcacagactttggaaacatgctatgtggacctgaggtctgcctgcaacacttagctgtgtgacctcaggaaggtttcttaatctctatgtgcattcatttttcatttgtaaaactggaatcataatagacccatcaccttgtgccattgtgaggatgacatgaggtaaaaatatatacaaacttagagtagtttatacttatactgtgtcagtctaaagcgttgttgctattaatgaatcagaaagcctggaactatgatctggacctttttattttgaaggcgctcctcggagattctgatttgcatccatggttcagaaccacttgcctactgcattgtctgtatcatagaagttgaggaaccattaagcattaataaataagtgcagcaggatcttggttccgcaggaagagtgtggattcttggaatgcaattgtcatgtggcaagttatttcaggttttcttgttatcctcctccctgtatctataatggacagccttgggttttacctcctgtccaggcacccgttcctctttctgcagggataagagtgagcatggaagtacttaagcaccagggaaaggggagaaagaaaaagtgggggtaatccaccaactgtctaaccatttcctgaaaaatagagggccaactaccattagagctcttagaggattgctgagccttctaagggtttaccaagaagggacaaatctaatgataagaaagttacagccaagtttattgaacaataacccatttccttcatgtagaaacaatgaagaaacattttttctcacttacatggcacaaggaaaacaatatcaatgatttgtgctgcctgcttgtcgagtctgtttaccaacttggcttatttttttactgcatgatatgaacacttagggttaaacagagctctctttttctctctggtgaggtttttgcttttcccatttttatttgtattgactaggaggtctttcaccagaagaataaaagaccatgcttttgaggagccagtcactgagtttctctgttgatcaatcaccattgctggtacaggtatattcattttgggtctgggatggatacaggtttgatgaaaggtccctggggaatgagagggcttagccaacagtctcagggtcagcatttcctagtcctacaagattcagatccctgatgtggagccaaggaaaggcttgagtgactaggggtctttttgaacaaggcactttaatttgccaagaactctacatcattttgtacaatttatttcagggagagatatcactttaagctaaaaaacaaaggaaaaaagctccagactactccatgatggaggacaaagcatctcagtaaataactttgaaagtcaagagttacaggaaataaaaaaagaagacaatcagagaatgtgccactaatgaattcaatcgcagcaaaagtccatttccattcccttgaactctacacaatttccagttgcaaatatctttcagaagtactgtacacacacagttggatattgagttgcttgacaaacatttctgatcaaaactgcttgcctagaaatggctgctggagcaacaataatgtggatttagaatgagccgggctgtttgcacataggtgtagtctatgagtttaatggagttttgcagaaggcaattgcctagaaaatagtgggtttttaaggatgaacttttgactcccaatgcgaggtgaagggaagatcgggggagaatagggagagaagggctgtcttttctgttttctctggggcaccatggctataataacttctactttgctgtgatggactcagcaatcaatttattctacgatcttttcccagacacactctcaactcatgtcggcttagttgaatggtcaccctacctggattctgagacccttcttggggcctcaattgggatatttacagcttccatttttgagaagtgtgtgtgtagaggcactaatttaagaacaaaaaaggccagtgacatctagggaaatgtcttcactttgggcaggagtgggatgaccctctgaaagctgcacaaaaggccacagatctggccgatctgaggagactggtgttttctgatcttgggacaaagcagttaaaatcctggagctcttgcatcttggagaaaaatcctgtagcttctttctctggggcaaggggcaaggctgtttggtcacactgtttagtgattcacagctgggaatcttctgtgtctgaacaatttcagcccctcataaggggttgatagctgagcccctgtgtcttagtcagtttcggctataacaaaacaccataaactgggtggtttataaacaacagaaatttatttcttacagatctagaggctgaaagatcaagatcaaggtgatggcagatttggtgactggtgagggctggcttcttcataggcagtgccttctctctgtgtccttacatcgtggaagggacaagaggcctttcttggacatctttcataaaggcactaatcccattcatgaactccgttttcatgacctaatcacctcccaaaggcctcacctcctaataccgtagccttggaggtgagaattttagcttatgaatttgggggaatataaccattcagaataaaacaccctggctatagaagagaggtggcttttcctctccccagacagcttccctttccccacagtccaaccggctgtctaagcttagggagctgcccctggggaagaggagccctgtcaactgcacccggaatgatggcctttcttcctgttcttcctcgttagtttcttcccacttctctaggatgacagagaggccccccttctcggttttctcagatagcatgccatttgctgtctcaaatctataaagagctgttgggaagtttctgtttttctttctttctttctttctttctttctttctttctttctttctttctttctttctttcttttttctctttctttctttcaaaaaagttcaattctcctaggtggctcacctgggcttttaataatgtttggctccattttaaacccctggctctgagtgtgctgctaagaatctattcctataggcgtttggtcattgcagggttaagaaaatttgagccgttcctttcctgcctatgttggggtgctgggtactgacagtaagagtgtccaggatgagggaatgcatgtttccagtgactcctgaagttttattcacctgttagggctttccatcccaattttcatccctttttgacaattcttggtaaaagctttgcaagtatggagctaatcaaaggatttctggctcccaacttgtctgctctttgttttgtttttgctttggttttttgcttctctggggtatgggtcttcatcttgtttgttatggcaagaattccctttagtgactagtgttgggagttgttagacccattgaacagatgaaaataaaaggggtctctagatctgggatcctggcactgagtgaagttttccttcagcgtatttcaaacacgtgcaagatcttcctccttccctgagacacttacctctcctttagttctcaggtgttggatcatgtcctctagaaaacttttccctatttaatcccatgtatttttaacccactaacataatccccaatgtttccatgtctttagttaatgcttgtaatatctatgtatttaagggcttaatcatgggcggttagatttttaacttctggttcggactaatacatcttttccagtgcatgggtacagatctcagtagcacacatggaacatttgctaactccgtggttgactcattcaagccctcccacgagtcagattacccagtcagccagtaaatgttggaggactcctgcacttcctcgtgggcttttctctcttctccatttacatttttctctcaaggttttgcatgaaactccaaggctttaaataccattgagatacagatgattttttaaattataaatccagtcttgacctatcccttgggctaaagatttgtagagtcaactgtcttcctaaatctttttttggaggtctaataattaccgaaaactgtaacatgtacaaaacagacttgtagcccccaccctgcacatctgtctctctcccagtcttcagcatgtcagtgcattgcagcaccatccaccccgttgctcaagctcatgcctcagtctcccctgactcttcccattccttctcccagcacattccacacaccagcatgtcctgttggctcttgtttcaagatacatccagaatctgttcacttctctgcactgccactgttccagtccaagcctccatcaactcttgcctgagcttctgtattagtcttcccaactggtctccctgcttctctccttgccacctaaaatctatgccccacatagcaggcataatgattttaaaaaatcagcatttgaccaaatcgaatggctgttcataataaaaactatcaaataactaggaattgaagagaatttcactaacttaatataaagagtataagaaaaacctagagttaacatcatacttaatggtaagagactgaatgcttttgtcctaagattggaacaaggtgagaatatctgttctcaccacccctattgaccactgtactggaagtcctagcttagtgcaataagataagtaaaagaaataaaaagtgtggagacttggaaggaagaaataaaactgtctttattctcgggtaacataattatctacataaaaaacccaaagaatctgtaagaaaacacctagtaagtcaatatagcaagattgtaggatacaaggtgaataaacagaagttaattttttcaatagaaagttggaatcgtggtaagctgcctaccttgccccacccttgggggctacattttagcttttactgaatggaatgaagaaagataaatacaaatttgtgtctttaacgaagaaaaaattaactgctttcctccataccaaaaataatctcaggaagtgattttgtagatacaacaaacttaatgtaaattttgtatagaatggcgaaggacctagaacagtcaccacaatactaaataagaaataagttggaggactcatactacctgatttcaagacttactataatataaagccacagtaatcaagacagtataatactggtgaaggaatacacaaatagatcagtggaacaggatagagagcccagaaatagacccacacaaataaagggacagtgttttcaacaaatggtggaggaacaattggccatctatattagaaacagagactagacacagatcttacatccttcataaaaaattgcttaaaatgaattatacacctagatataaaacatgaaacaataaaacttccagaagaaaacactggagaaaatctatggccttagattggtgatgagtttttctccttttttttttttttttgagtcgaggtcttgctgcactgcccacaccactcttgaactcctgagctcaaaaaatccccctgcctcagcctcctgagtagctgagattacgggcatgagccaccatgcctggttggtgatgagtttttagatattacaccaaatgcatgatccataaaacaaaaaattgaaaattttggctttattaaaattaaaaacttttgctctgctgaagacattcttaacatgtgaaaaagacaagtcattgaccaggagaaaatatttgtaaatcacatatcagataaaacacttgcatctaaaatataccaagaatcctgaaaactcaacagtaagaaagcaaatggtccaacttaaaaaatgggcaagagatctgaacagacacttcaccaaagaagatacacagatggcaaagaaacatatcaaaagatgatctatagcatctgtcattagggaaatgcaaattaaaattacaacatacctctacacacctcttagcatggctaaaatccagaaaagctgacaatactggcaaggatatggagcaacaggagctctcattcattgctgctgggaatgcaaagtggtacagccactttggaaaatagttttgagagtttcttaccatgctaaacatagttttaccacatgatcaagtaactgcagtcctagatatttacccagctgatttgaaaacttacgtgcacacaaaaacctccacgagaaggtttatagtacctttacttgcaatcatcaaaactggaagcaacaaagatgttctccagtaggtgaatgggttaataaacttgggttttttaaatacacaattaagctataattaatagcatgccccatgcataatcacagagtaaaacaagaaaggcccagcccattaggtcaaacatgctgagtgttgtggaacagcaaaaatctatttctaaagacttgaacagtagctggaaacataaaagttcagattattggctcagttggacttgattatatgagactagtgtgtatataaagaccctaaagttgggagggtatgtttaagagatacatgaaaccagcaggacagggtggtgctgacatcactttactacaaataaagttgttataaatccatatagtgggatactattcggcaataaaaagaaatgagctatcaggcgacaacatggatgtatcttagatacatattgctaagtgaaagaagccagtctgaaaaaacatattgaatgattccatttatatgacacttgaaaaggcaaaactatagaaaaagagcagtagttgccaggggcgtgggcagaggagagggttgaatagatgaagcacaggggatgtttttaaggccgtgaaaatattctgtacaatactgtaatggtggtagggtataataaaaatatacatattggatctttgtccttggttcccagcatggagctgggaggatacaaagaataataccaacagctctgagagtacatagggaatttgctatctagtcaggtacgtgttacagtgtctcttttcttctatgtccagtgagttcctcccttacttgttaaggacctaaactaacaatctagttaattaaccaaccaattccctcactcgtatttgcattagtgtttcaattgctttgcgttaaccttaagtttcaaaatttcttaagccggttttcagtaatctgcccttcatcaaattatagaaagtagcataacaaataggcttgagtttcctcatctcctggccctcctccgtctctggggaaaatattaaagacagaaatggtcccccagtgtagagctggagccaggaagcaggaatacagttgagggctaggataaccaaatgaaaagcagagctgggtgttgggcaaattggttgtattccgcgaatgcagacagctacacctgcaaagacgcaggaatgcagatgatcagataaaccaagttcaaagaaatgaggccacacttggctcgaaagagcggagaggttggtgggtcagtgagataattgtgctgcttgttcagaatctgaaccagtcccgtctgttatctggtcaggacaggtggcttgcaggcagagtttgggctcaggcaggtggcaccaagaggaaaatttatggatagacctttaactctggtcactttggagcccagcagctctggaaattggatccagatggatagtattttgatagcttctcctaaccaaggaatttatgctgattttcaggacccaaggggaaggaggaagctcctaaaggcaaggaattcataattgcttcttaccatgtttccaaaattcatctgtgttttcactcaccaccacagtcagggctggcacagggactggggaatgaaaaataaatgagggctcagggcctcactcatcacacgtgtgccttccatgggatgtcctggagcaggacagggaggagtgtggggaatagtctcctaattcaggaaaaagtctaggttgggtctgtaagatcttcctccactgagaaatgtattaatccttgccctgctcatagaagcaatgaaagaagctctaaacaccgggatggatgttcctccctccacatttgggtttttgcgtgagttaaactactggaagggtggagggttctccctctgtacggagctcagtacaggccaggagggcccatctatgtgaacacttctctgaaaatgaagctacttctggtcatagctctgctgttaactgtgtaatatgggtaaccccttaactgcctctgggccatggtgtcttcaccggacatttgcatgagagccagaggatggccaggaccctttcaagctctcatcttcaatgctcctagaatctccgttggaaaccatttggctctgctggaatgttacagaaagaaggcaagggcaattcttcttttctcatgaatgttttgggaattctgttgcttggaagagacttcaaagactgtatcttctgcttctctgtgagattcatctccaatttatgtcacaaggagatgggattttgaaggcatactaggtgatctccatccaggttttcatagcttttgcaagcacttactgagcacctgctatgtgccagaccttgttctcataagtcctgatttcatactaagacatccagacaaagaggtagcataaacaaagggcttgagccagtaaagatgataagcaggatgaagaatactgttgctcagtccccagtcagatagagcatccaacaacagcctgcccagctactctcagaatcctgacactgtggcccagtgcccatctcctttcctaattccaagcaagaaatcatccccaatactgacattcaccaacagcccttgcactgcttggggacctacaaaaggagattcttttcatttctcttccaaatttcatggcaagggcatttggaggagttagtggagaaggatggcaggggctttgagttgtcatcttttcttaggagctaagaattttaaattgtacttaattgctggtcacagtcaatggattctaagaatctgatgtgcttaccctgcacactcccaccagtccctcagcctgggccagccataaaaacacattactggtgtctgccatttggatggctggaggagatggcgtagtgagttttatttttacctgaatagtggggagccagctgatgtggtgcacctcgtgttaaccaataagcacctgatgggatttgcctcacgtcaagaggaagaaggggctcttggctctactgggccacatcccagttcagtgtttgtggaaggcattcaccttggagcttgttgcctgccaggccccactcttagggcctcttcgatgctggggagaatgatgtcagcaccacccattcctgctggtttcatttatctcttaaacataccatcctggcattggagcctttacatgctagtctcatataatcaagcccaacagaggcaatgatctgaccttctatgtttccagctactatttatgtctttagaaatggttttctacattccatagcactcagcatgtttgacctaatgggctgggtctttcttgctttcctctgtgattatgcaccaggcatgtaattaattatggctcaattctatattttaaaagcccacaactttggactgagattacaatgaacaacatttagcattggcttacctctgctttcacgtggagctgagagatggagttaggtagtagggagtgaagtttgttatgataggattgaaacctgcaggcagcagtattagataatttttctctagctggggatctgggggtggtggagaccaagaggtcaatcaccagcatgtaatgtggggccatcccaatgcctactgtcgttgccactcccaagaacaaagagcctgcttcctggatgactgggagccaaccatggtggaagtagggagtaaaaaggaactaacagggtcagctcatgaaaggttttgtaagccaagcataggaatttgaactttattctgtaggtaaagggaagtcatttgaagcagggaaatgatcacttcagcagctgtatgggtaatggattaatgaggagagactggaagcttggaggccacttaggaggccacagcagtaatccaagcagagaagaggaagctgtttaataggcagaattgaatgaacgtgttgactgaaagatagaaggagagggaggtgttgatgactccatgcttttggtttgagaagctggatggatgatgatgttaacaccaagaataagaaatccagtaggagggagaagtttgagaaaggaagaggatgccaggtccagtttgggacatactgaatttcagatggtttggggacattcaggtgtttcattgtttggccatgtaggtctagagctctgaagagagacttcattagagattacaagcaggggtgtcatcagcatcaaggtgctagtaactatcacgggcaaagatgaaatcagctaggaaagaaagcacagaaccatcaggagggaaacactcagggccaggccgaggcagagaagcttctggagggcagagactgagaagatgctttcatagcctggagtgaagtctgtcccatctgtcctatctcagttcaggctagaattctctcctaccctggggcctctctagtcccccagggccactgggctggctctgcagttggccacactgaggctgttctttgaccagtgtttctcaaatttgcacctgcagatgttgtattgttttgttttgtttgagttggggggagatgctgcgagtcctttaaagaacctcccatagcagtctgtgaatacgtattctgaggggtctttgagttctcaagttcaggaaactcagacgtggtcctggactctccttgcctggacttgaggtaactgccttggcctccctaagccaaagatgcatctgggccccatatgcgacccagggcttcccatggcaacatgtggtgttgtttttactactgcaactttttatttttctttagagctgattttttttttttccttttgagacagagtctccctctgccatctggactggtatacagtggctcaaccacaggtcaccgcagcctcgatctcccaggctcaagcggtcgtcctgcctaaacctcccgagtagctgggactacaggcatgcaccaccacaccacgctaatttttaaaaaattttttgtagagacagggtcttgctgtgttgccagggctgatcttgaactcctgggctcaagtgatcctcccgccttggcctctcaaagattttttttttttaacagctgtattgagatacagttcacatatggcccacttaaagaatacaattcagtgatttttaatatattcgcagatttgcacaaccaccaccacagtccatttagaaccttttaaaatcaccccaaagaaaccctgtacattttagctatccccttagcctcagcctctccctccccatcacctgggttttaggcgactactaatttactttctggctaatggattaatgaggagaggctatagattcccctattctggacatttcgtataagtggaaccatagactgtaactttttaggattgcacgttcccatctgataaccgaatctccattctggagaaaggatgttggcatagtctgggtgctttgctatctattatctcctctaattctcaccacctctttggaaagccagccttatcaaccccattttagttgagagtgctgaggttcggaggtgaaatgacttgtcagaggccccagggacagtcagtggaagcacgctgaacagggaggggcacccagctctgtctggctgcattcgctgagctgtcgctgtgctaggtgctgaagcagggctgggatgggggtgtgaagacagaaaatccaccagcagctcgcacgagtgggtcctcccagaatgagtccaggggagccccctggaccaaagcaggacagagctaattccaggaacaactgcacatttgtccactggttggagtgagcctcccccttttactgcatctccacgaggcagaggaagtggcagtggcctgagccctcagatacctggtgccctgggaatgttcccaaccagatgattatggctgttgtcaccaccaagccctgtcttgtcatcagcctcagtgtcaggccctgggacccagagacacaccccgtccccaggctccagcttcatggagcttcagaatcaggccctgttacacccactgcagggaacttatcatctcattataaaggataaggcatattttttcagtatggttatacgcggtaatgaagcatgcaggaaaccacacaagatagatggcagctttcactagtgaagctgaaaacttggttaccttaatagtctatttattacattcactctctgagcttacagcacctgattaatatctcccatcttctcccttgctatacaattaaaactagtaatatgtgattgcacatgctgactccagcacagatgggtgtgtggagttgaaggccgagataagaagtgaaggggtcaggcgtggtggctcacgcctgtaatctcaccactttgggaggccgaggcgggcagatcacgaggtcaggagattgagaccaccctggctaacatggtgaaaccctgtctctactaaaaatacaaaaaattagccaggcatggtggcaggcgcctgtagtcccagctactcagaaggctgaggcaggagaatggcgtgaacctgggagacggagcttacagtgagccgagattgtgccactgcacaccagcctgggcgatagagcaagactctgtctcaaaaaaaaaaaaaaaaaaaaaaaaaaagaagtggagaaggaatgttcttcctgggtcatgatagaggagtcagatcccttgctggtaagggagtgatcttacagaattaattacactcgaggagaaaaggaccctatgtccactgcccagtctcacccattgccgtggcttctggcaggggagtggtgaagcctgcacagagagaggatatcagtggaggtggccatacggcctttaatcagcaaaaggaaagatggctggactttaactcatttgcttggatgagaatgtttgaggttgaattcgattacaatgatgtagctactcaaaagccgctcccaacttcctgctcccctgcccacctgctcctgaagagctgagcatttggccaagttctgaccaatgagatgtaaggagaactctgctgaggggtttctgggagagatgctttgctttttgacaaaatggcaagtcacattatgagaacttgctggtgctgccctctgccccttcttcctgaatgtggatgtgatgactgagtttgggctgccatcttgtgagcatgaggatgaaaacgtaacatgccatggatggtggagaatcaccagggagagcctaggttcatgattacatcacccagctgacagcccaaccctggggtcatctacttctggaccttttgttaagcaaacaatatatagccttgtggttgaagccacagttagaagggcattatgttccttgcagctgagaaacatacctacataatctaaatggctccatttattgagcagcatatgcgtgtcctttgctaagtgctttgtgttcattttgaagcttcaaaacatgttccctttaagggagctactatgacctctgttttataaaggaggacacgagttttaagtgtataaggtcacacacctattccaggaaagagcagagctaagatttgaatccaagtctttctgactagagagttattactattaatcataatattgtgactttgtagacagttcatctcaacactgaactctgggaatgagtgttacttaaagtctggttggcataatagtactcagtataaatcacgaagtttttccacatgacccactaaaataaggtgaaattcagtcttattggtgattgaaaattgcatattttttacctgcctcaacccactccaaatagccggggttgaaattagtttagctaacctaacttgccccagccaattggatggccaaaaagtgaaatgtgtatgaagggaaaaggtcccagagagagaatttgagttaaaagaccaccagtccgagcctgtgtgcagcccatctcatagcttttgagtacaaagcaggaagcctctccttccgtggcatttgaagactcagagcaaggttaagatggctttgaaacctgggtctggttctcccagaaacacttctgttgcttctcctcattaaagaaaacattccaagtgtgcaattgttctctgagatgaatttctcaaaacacatgtgaactacttgagactattctaattcctggaggtgcctagtcagtgctggccatataacagatgctcagtaaagatcggttgctttcatgaccagtgagggcaacagaaaaaacaaaagatctcttaatgaatatgattcatcctcctagcctcagtgaaaaggcaaaaaataggctgctttcttggaaacgtgccagctaatggtacttagcatgcaagggaccgcgtactgatccatacccattagcccaatgctcatcaactcttctactggagatatatatatatatatatacacatagccagcagccaacagagggacttggccacatgctgattctctctcccctcccagtccatcagaccattattcagcaggaggtagtagggtcttcccctccctcttatgccctttagggcaggagctatctagagagggaaaaaaagtcagaataaacatatgcaaggactggggtttaaacatcccatgaagattaacttatctggagtaattgccttaactaggggatttttaatgcttttcaaagttttttagaggaagaaaaatatgcagaatgagtcttaaagcagccaacagaggagatacttagagcaaaaaaaaaaaaaagatatcaaccataagaagcccatagctaggaaattttaaggcactgattctaggggatttaataagaatgtaatttgtataattaaccattcatcaatgtcaatttcattaaatgaatgccagaaatattaccttcagcagcacgacctaacaggattgaatatattatatgaaaaatgaacacttagtggtttcccccactgctctgtctgtcacagcaagatttgcaaggctgagaaataatttaaagggtagtaaatgaaaccggctaaggcaaatgtgtgcattttggtaactaacctccgtcatgatgtatgagagttcatgtcaaaatgttttcctgcagcaatgactaaagggacttgtagctctctcccaggtggcaaaatgtgagaaataatgccaggaacttcccaaaggtcccccttgtcactcgcctggatacagcttactctttccctagataggctgcctagggtctaagaccagaagccatgtgtttttgtgtccagaatttgtagaccttcccttcatacctccaggttagccttacatccaatcacttgcctacctgtccaggaaaagtgatgattgatgtgcaggagacagaaatcattctgagttttatttatgttattgcctacagtcatcaggggagcacgaagcttgaggtaggtgggctgatgaaatatatgtaaataggacttatttccaaggttgctcatgagggaggcagtttatggagggaggcagtttatggggatttatccatttcagtgcatcataggaaaagtggaggacttgggagcgggggctgtagtaacttgtccatgtgtgtgctcctgggaatgtatatacagacacacacacacacacaccagatcaagcacacactggagatcagtgcttgagatttgcaaattgttgtcactggagttggcctggtgcctcgtgtatagtaggtgatcaataaacatttgtttaattgaatttctcttagtgttaactccactcccattctcttctgtttcagggttctatgaggctgaaaatattggatcagtattcctgaggaatctgcgtttcagaatcccaggtccggaaggacaagaagtactttgcaaacaaatcaaatgtacgtttaggaagatgaaatcatgcaacagaaagatttttcagaatttttcagcaacagattttacacacaattcagaaggaagaaagaacagatgagtttgggaatcaggagaccagatgtcaagactggactacatctttatattcatttccagatttaaagttctatgttgtattttatttgatgcaaagcaataaaatattcctccctcctgtgaccaccgaaaaggtcatatttaggacctgggtgaaggaagagtgggcatcacagagctgctgtggagtgtgtgcacagattctgtgtactaggtctgtgggctctgcaagactcaaaatcaattgctgaaacacttcttaaatgtgttccctcctatgcattctgctatgcatagtcgccctctcttccttctaggttagagtgggtgacactgagcatgtaacttaacctctctgaagcacagtttcctcatctgcaaaatgaggatgataatatcctcctcccagtgttgctgggaggatgaagtgagatgaatctggtgatactgagtaggtgtgcaatcaatatttgttttttcctgccactcctttaccaggctttttttcacctcaaatgagtgatgacctctgagtgcggagcttttttgtcaattttttaaagacagtggtccccagcatttttggcaccagggacaggtttcatggatggcaatttttccatggacctgggtagggggtggtttctggatgaaactgttccatcatagatcttcaggcactagttagattctcataagagacacagcacacagcctagatccatcacatgcgcagttcacaacagggctggtgctcctaggagaatctaacgcctctgctgatctgacaggaggcagagttcgggcggcaatgttcactcacctgccgctcacctcctgctgtgtagtctggttcctaacaggctgaggaccggtaccccggggctggggatccctgttctatgaggatagaaaatctggtaaagtaattcaccctaagatgccattaaattactatgacctcctgggctcaagcaatcctcgcacctcagcctcccaagtagctaggacttcaggcatgcactactatgcctgggtaacttttttgatttttattagagatgaggtctcaccatgttgcctaggctggttttgaccccctgaactccagtgatcttaccgcctcagccttccaaagtgttgcaattacaagcgtgagccacagcaccgggttactttgttactctttaggggtattggaaatattaagaaaatacagcagggagagattgatttttaggatttaagaagaacaagaatagttttgggagttctgggagctacttccaagggcatgaaccaaatctggaaagtagagttggggttgtgaaatattagaacgtgtggatagtctgatggtttgcaagtaagtgggatcgaccgtggggtctctggacagctccccagagggccgtggtccacaaagggaaacactgtcccatccaactctgagaaatgggtctgggcatccactgctttcaccgagggtctctgcatgactttaggaaagtcactagacttctttaaccatttctttcttatctgcaaaatgggaagagtaagggcacccatcttggaggagatttggcacgtgatgctcagcacattgcctgacaatactaagtgttcaaccaatgctcatgattggccagggcattgacggcagaatcgtaaggatcacagagacctcaggaacatggctctgaaggatagaagctgaaaatcagtgtgctgatatcaccccttttgtctatgaggagtgaatgtctccaattaggctgcattcagcaggcctggcagcctcctctctcttgggatgcaaactgcttatgtggtagaaacaggaagccgtcttgaaaccctcgccaggccccagacgcgcgtgggtccacctaccgtccatctaccggggtcactgagtcactcctgcccaggtcccccttcagggactgtcgtgggctgtggcctcagaggtcccttacagggtggtgggacccagggcccagggtttggctccgggtttttgggcagctccgccttcataccgaaggcagcttagcatggcactgtctgatctgctgacagccgcgaccctgccacctgctcagtgggatggcatcttgggggagcaccttgggcagggctgcccagagccctggaactggactctccctgtgcagggctgatgggaaggaggtgtgtgcaatatggtgggaggagccgggctggaggctgcagactctgcctctgtgcccgttctgggaaagcccctgggcttgctggacccatttctgcccttctgaaagcgggagttagactagattggggctttcaacattgctgatattttgaacagcagaatccttatcacaaagccaatggaaacaaagaagtgatacattaaaaacacatcgaagcaaaacctcctggttgaactggcttccctgcccctccaaagtggttccaaggtgcctccacaaagcctcagggctctgagggtgttagggaaaccacaggtgtccacaatgcctgccatgctatgatttcatctggccgatgtgtcacttcagtattctgatgaatttaccctaccaggccagtcagaatcgactcactgatgatcaaaaaagagaggacacttagaattaaattcatttctttgggccagtctcctttgtctgcacttgctgagaaggcatttatgatgccagtgtgacttatagttatcctggtaggtactgaagcttgtaaaggccacctaatcactttgctttggtattcattagtcatttaacacctctaaagaaaggaaaggtgcggcaggttgcgtgtgcgggaggggagaggtagtgttggcttggaccacagcgggagggacctgggaagagggagaagttgatggtctggtcactaatggtcctcagcaggacaggcttctttgtccttgtctcccccctcccttttgtcctcttctctcttcctctctccctcatttctggcttccctctttttctccttcctcttctcctcctctaatatggaaggaacgttagacacacattcctgtagatgctggagtggaaaggcaggttggaggaaatacaaagatgaaggacatagtcaatctcttcaaggaggtcatggccaagtgtgcaaggggacctcgaagaagcccagtgtgacaaggattgagaggtgtgctcaagatgtgctgagagcagaggatagccccagctctgctctggggagtcaggggcagggcggcagatgcttggggtcacatgaacacacaattgagcaacaaaacatagtcacacagggcctgcctcacacccagcactgggtgggttttgtgcaggagaacttcttgcaggagacttggagacagaaattctttgggaaggagatggggtagctgccttaccagagagagcgggatttctcagacactgctaacttcccacctccacacaagctgatgagactggctcagaaaaggggtctgcccccagtgcataataatagcagtgataattaataatctatagttaatgagattaaattaattattattttaattatgacatgttttcctcctctctttcccctgccagggcaggcttggcacttcccaggattacagtcataatggtaacagataaaccttaattaaaacattccaaaataccatggctgagttaaagtgctgtgacacgtcgtttccatctcattttgagatcttgcctatgacggcaaatgtctccccaccgtcggcagcatcttggccattcagagctgttgccctcacagcattcagtgatgtttgccagagtggctccacgccccttgggggcagatggccgacccactggatcggggccactggagactttttccctcatgctgggctcttcacgtggcatcctgtgcctgctcaatgctgaatctgcttcccatgtgcacagcttactcctttgctccacccggctctgcctctgttcccttcacctgcttcttctcaggccaaggtagacctgaggaaaggattgaaaggattgtctactctggctctgtgggcactgttcctgaggtgtgagcaaaccctgcctcagatggcccccgagtccatcagcagctccttccctgtggtccgagttactggcagggtctctgcgttctgcctttgtgttgagcttctcctccacagcccacccacctgcaggggctttctcacgtgtggcgcgggtgtggaggcaggtctccatggattgtacggctttcccaaggcctgctccagactggtggcctttttatggaggttagcattcttttgttagtccactcacatattttcactcattactaaacatttatggaccattctaggaactgtgcttggtgatgagctgcagagacagaagacaccatcctatttttataagccttgtgggtctgtggaagagaatggaagatacacaaaggaagggagtcccaagctgaatgttctgatagggtcagtgctggccactgagcggggagggtggggagggactgtgcgttcctgcgcatgttaccctacactgaattttatttttttattattttattttaattttgagacagagtctcactgtgtggcacaggctggagtgcagtggcgtgatcttggctcactgcaacctcggcctctccagttcaagcagttctcctgcctcagcctcccaagtagctgggattataagtgtctgctcccacccctggctaatttctgtatttttagtagagatggggcttcgcatgttggccaggctggtctcgaactcctgacctcaagtgattcacccaccttggcctcccaaagtgccaggattacaggtgtgagccaccatgcctggatcctacactgaattttgaaacataagaaggagttatccagatgataagaggggaaggaaggtcacattgagaagagtcaaattcagaaggcctgacagagatgacatccctggaactgcagtagaggagtatggctagaaggcaggacaatgaggatgacaggccagaggtgaggttgcaagtgtggttggggccaagaccacaacacgtgttcaaggtatgtctaagaaggctcaagttcatgaatgggtgcatcaaagaaccacaccccagaaataagctaagtaacacctgcaacactgtcatcaaacgtgctgagccctgccttgcgccaggcagtgagctagtccttattttcacacctggctttcttgcctaagcaaattcagagtcaccctaacttgggtcatttgcatcacaaaattgccttcaaattagcacagagagggaaaaatcaacgcatacctcccaacataacatccccaaatttacctagcccagagttttaaaaaatttatatttttaaccttgatacccaagaaagcaggaaatctcacccagctggaagctctcctgtaaagaattcacaaaaatccacaccaaaacctctagatattcccatggagctgctagttctggaaacactatgggggaaattgcagggttttctattagtttgaaggaggtctacttcctaagacattcttctgctaccatctcttgcatgctcagttcattgattgatagagtaaatcattgatatttttccccattgcttcattcaacaaatttacattgcactctcctacatgccaggcattgttttggatgctggggatacaaagataagtgctctgaggcccctattctcagagtgctcagtccagtgagaaactagaaaagtctgcaggtaatgacaggcaaagagagatgcggtgaaatggccatgggagcacagccttgaagagacgcctgtgcaaggcacaggctccactgccagcgagggagaaagccctcctaggcccgaagcagcaaaagaaagcatctagaaaaaggaaataaagggctgtaggtgtatcaaaggtattccagtgccagttaaatttgagagagaaatcattttatttacgaaaatgtcaaggggaagaagatgcataacttctttaggaacgactcctgcctctgctagtatgtcaattccgagaggcctaaaataatttgggcttgaagatggatggaggtggagagcttggccttattgccaacactgtaaattagcagtaccaagagcagcctgtcccacttctggtctctggctacctcttcacccagctctggccacagtcaggtgatctctgatgagtgcattcaatcaccttccttttccatttggaacatgattgtgtgcatgctgtacataagcgatattgattgcaaataagttgttgactggaagacatgcctctgtggacatgtttgggtgggggatagaggggaaataaaattaaaaagagagtaagaaaacacctgtggcccccagttggaaacttctcaaatatttgaagctaacaatgttttggttgcctatttcttttttcttttttttctaggagctaaacgtcaatattgcatttattgctgaacaaactaaaatcataacaaatataataaaaggagagagttagcctcagctttctgcagagaatgattggcacttttgagccctggattggttgggcctttatcttagctgcgtcagctcataattaaacaataaaaggaggaattgttacttgcttggaatatatacagtcagttttctgtaaggtgggggcagtgtgtattttataagccctgttgctgtcccagttttctgtaagaagggaaatgtgggtattttataaactctcttcttgtctctgtcagttctaaaagactgagagatgacatgatagctgtcacaagaaatttctgcttaataacaatgaacactcagagctctttaggccctgaagaggaatgggaagatgatgagggaggaggaaataaaagcaagaaaatggtaggacaggaagattttttttttccgctctcaatcttgtctttgtttggctgaccatagagcagctatgtagaactatgtgtgtgtgtgtaagggggagagaagagagagagagagagagagagagagagagagagagagagtattgtaataacgtattgagcatgagctgcctgatctttgccaggtgataaactggcccactgtgatcttgcaggaaacatcaacagtctgagaattgttgtttcaggaactagaaagaatcctggaaatagttaagaaagacgattttccaatggccaataccttctcccagtggcttgtgagattaagatttggtattggaatttgtcccatctcgacttggaagaatgagacaccttggaagatgaggctgaccaggccatggagctgcccagaccccctgggagcccagagtccccatccttgcatctcatgatctatcatttaacagccctgtccaaagtgcttgctggagatcacagggctaggccacttctgctccttgcaagctccaaagaggaggtctcctatgcacccgaggaggatgagtcttcagagtttccagctgccttcttgtcacctggctctaccttaccttgacactcccaagtgtagacatgcctgattattctatccaaacccagccaggagatgggaagagacatcttgttagccagttgctctggtagcctgcattgcaagggcctggcttttacgcagtttcgcttcaagtcagtgcaactagctacctgtcttcctgtcacttttctttggccacctgggtctcagcagaggccctcccaagactgacaggttagcacggaaggtataatctgctagtcagatttcacatggctgcacagagaatcggtgcccttggcaggtaagtgaataaatatgggaagacatttgctattaactgcaaatggcaagcagcatcttagaaagctagttagtgaaacagggatgggagtgtgagagttgatgcttcttttagaccctatttgtctcccggcctcacactgccttcctcttgctcagactttccctcttgcagtatctcctaagtcactggaggaggcccgagaagaaagccacgacccccatttgtgtgactgagatgttttcccagcgtcagtctctcaacctccccagtttcagctgcactacttcagaatgggacctctcctggctttatctgtagtgcggactatgtgtaagatcactggcagtgagtgtttatgcgccttaattcatgtatgtgctgatagcttataccccatctctgtattctccatcagaaacccacaccccagcagggaaattctttgaagcctaaatacttaaccatttctttggctccagggaatgtttgaaagaaattagttctaagcaggggttttttttttttttcccattagtttcagagcagttttagggcaagaaaaataatcccccttccctcagtggatggataatgatgggaagtcacctcccttcccctgggattaacctagaagggctctggttgggaaaatgttacctggttctttggggaaggatgacggttttgtgccttatgttttggggttttctgggtgtccctaggtaaccatctgtgagagcatcttgggcttggagtttttgtcactgtgaacaccttctgtggactcaggtgaattctccagttggcaaaagagggaatgcaggcttcgctgactaatccctgaaccagctaaggacaaggccttagaaagtttcgtctacaataaagaagcttttatctgatgtcgaggaatctttaccagtagctgctgtcgtgaatacaagtgcacctttatggcccacagtaagcactgggggattttctgtgaaatccttgtcatttcttttacccattttcctaggaagtgagttgtgctcttgtatatgctcttcacactgtgcgaagtcagttacgtgtgtggcaaagaacttgccttggtttctaacttgttttacactttctttgcagtgtcttgatgaacagaagttcttatttggattaaagaaacacatatggtcaataaacatatgatgggatgttcaacctcattaatgatcagggaaatgcatatcaagggcacaagagataccaatctcacccactcggctgttaagagtatggaagtatgacaatatcgggtgttggagggagtgtggatctgcagaaggttttgtgcagtgctgatgggaaggagaaattgtacagccactttgtcatgatctcgtaaagttgatcattcaaatgctccatcatccatcaatcccactcttaggaagtcagacaagggcaactctctctcacgtataccagcagacatgtatgagaacggtcatttcagcactatttatataaagcaaaacttgggggcaatacaaatgttctctgacaggagactggatcaatatattgtggtgtgcctatttaatggaataataaacctcagtcaaaatgaatgaacaatagtcccatgcaacaatatgaattagttttagcagcagaattcaagtgcaaaaagtctcagaagaatgcatattgcatgataccctttgtagacggttaaaataaatccaaactgaaaattcttctttttttaaaaaaaatatatgtagcagtagtaaaactttgtttgaaaaaagggaaagcaagtcaatgatgaacataagattcgagaaagtgcttagttactttgggtagaggaagagaaaggatgcattgaagattgatgttgctactctagttttcttgtttgtttggtaatttaaagaatgtttattatagtactgaagagaaatacataaatacagcaataaaaaatcaaataaccagatttaaaaaaaatgggaaaaggacttgaatagacatttctccaaagatgatttacaaatggccaagaagcatatggaaagatgttaaacatcactaatcatcagagatttgcaaatcgaaatgatagtgaggtatcacctcacacccattacgatagccactatagagaaaagccagaatatagcaaatgtcggtaagagcgtggagaaattgggacccttgtgcactgttggtggtgttgtaaaatggtgcaactgctatggataacacaatgaaggttccttaaaaaattaaaaataggaccaccatctgatgcagcagttccacttctgagtagacatccagaaacattaaaagcagggtgtcgattcgcacacccacgttcacagccacactattcacaataaatagctaagaggtggaaataggctgggcacggtggttcaggcctgtaatcctagcactttcggaagccaaggcaggaagatcacttgaggtcaggagttcgagaccagtctggccaacatggagaaaccctgcgtctattaaaaatacaaaaattagctgggtgtggtggcacacacctgtagtctcagctcctcaggaggctgaggcaggaggatcacttgaacccatgaggcggaggttgcagtgagctaagactgcaccaatgcactccagcctgggtgacagaccaagactctgtctcaaaaaaaaaaaaaaaaaaaaaaaaaaaaggaggtggaaacaacccaagtattcatcaatgatgaatggataaacaaaatatagcatatacatacaatggaatattcttcagctttaaaaaggaaggaaaaccttccatatgctacaacatagatgaaccttgaagacattacgctaagtgaaacaagccagtcacaaaaggacaaatattgtatgacttcacatctatgagggtctaacatggtcagattcatagaaaaaacagaaagtaggatgttgattactagggacaggtgacccctccttggatctacccgctttgcaatgtgactctgcagctcttcccaccaacaggtggagactgctttcccatcccttggatctgagctggcctggtgacttgctttggcccatagcctgtggtggaagcgaggctgtgctggtgctgagccaagacctcaagaagcttgcatgctcctgctcacgcccttggaaaacagacatgtgaggccatcctagaccagccaccctctaggtgaccctccaggtgactgcagatagatgagtgagtgcagttaaattcagctgtgctgggccaggcactgtggctcacgcctgtaatcccagtactttgggaggcgaaggcaggcagactgcctgagatcaggagtttgagaccagcctgggcaacacagcgaaaccctgtctccagtaaaatacaaaaaaaattagccgggcgtggtggcgcgcacctgtaatcccagctactcaggaggctgaggcaggagaattgtttgaacctgggaggtagatgttgcagtgagctgagattgcgccattgtactccagcctgggtgacagagtgagactctgtctcaaacacaaacaaacaaacaaacaaaaaaacaacaaaaaaactggctatcaggagatgaagaatgcatctgaaagtcaacaaggagagaaagagactctgccggcatgccgtaaaagcgtgcaagtcatggcaggggaacacataagtgtgttacatctgtatgcacatgcatgtgagtgcctgtgaccacacacacacacacacacacacacccatagtcagaggaagcctcaaatcaggctgagtttccgaagggaaaatctcatttgtccaccagtgatagcgtatgtagccttctacattaatgtaaattgaggcaggattaccttctagtgataaagtcgcatctggtagcagagaaaaagtgagtggaaacggacacatttccaatcaggctctggcctgggctgcagccccactccgctgaacacctagatacacctttttaaaacccaggatccttcgggctcagcctcctagtccttgccccttccccagatcccacccctgtctgcccaccttgtcttctcgggccctcaaaacttaagccagaagtctgggcaggccagtagaggaaggagctggggcccaggcagccacaggttgaagaggcggagggaagcggcacagctcacagtcacactaggacaacttggaagttgaattggcaagttgcagcaggagatgggagcatgggctccatccctaagggagccacattcgttttttttcctttcaaagtcgtcaggcagtaaaagaaaattgcagggatggggaaataatgaaaaaggctctttgtttttcccccagtccgaactcctagctcatcaaaccttggaaatgctcactgcaaatggttgttcttgttttattgcttatttatgggaatctatttaaagtgaattgcacttttccattgtatcctagtgagcgtgcaccggagttgtgtctcccctggctgtggggctgtctggactggggattctgtctgattgtgtcagcatcacgctccgtgacatttaaaagtggggaaggaaaatactgcagaggaagcagggcgagcgtggagaatgattgctcaggcctccatcagctccaggcgggtgtggggaatgctgttctagggcaggtttgggggtgctgactaggccttcacacaaagaggaatctgctcttgtggatgaatgaatggcggtgacaaatcaaactttaatctggctctgctgtaagcattgtgaccttagggcaggtactgacttctatgagccaccttttttaaaaaaaattctctacagagaggtgaatactgggctgttgttaataatgatgatggaattcattatatatatgagagtgcttactcagtatcaggtagatgctcactaaatgtaaaactcccttataagggtggctggaatggggactggaagagacaggtaagtccccaacctatcttcattttcttaacctatgccttttgactcaaaaagaatgaaggctccctcactcctttgctttgattgggagatgagatgcgagtctcaatgcctagaatgctctatagcaggggtcagcaaactggctgaatcgggctgctgttctggtagctaaagcattatgggaacccatccctcacccccttctgtctgcgagccatctatgacagctttcctgctacagcggcagagcaggatagctatgaaagagaccgtggggcccacaaagccgaaagtatttactttttggccctttacagaaaaagtttgccaatccctgctctaattcattggtattttggggttctcttatctgtgtgatcagaaggtctgagcctcagagaaaggaagcagcaacttgtccaagatcacaaagttagtgtttgagttagaactgcaatcaggtttcccaattcctggcccagtgcttttccattgtttaactgtaccatttcacagagatcccaaagccattgggattagctttaccaaaaaaaaaaaaaaaaaaaaaaaaagagtctctaagtcacgtggcatctgagctccatgtgattggtaaagttggcattagtccctgccacatttcccaagtccccaccttctctgctcaccacaccgctgtctctccaggctcagcaaatacttctagagacaccggtgtgtccttgtcctgaaacctttgtgagtcagctgcattgactcctgctccaggatgacgagggccaattccttgatgaagggccatctgcctgtgtctggctgcctgtctgtgagctttcgtgtcttgggggctctgctgcattgcaagaaggagctgggacagagctctgagagaggggaaggaggcagggagagggagtttgattcctgaagaatcttccttttcccatgaagacaagcaagctgatggccagcgtagagccacagcctggaaaactttatttttaaatttatttttggtggggaaagagttgggttagctctaatttacggcaacctccccagttccctgacactgctgcctcctcatatgctttgctaagaaaacctggatgagtcgggcgaggtggcttatgcctgtaatcccagcactttgggaggctgaggcgggtggattacctgaggtcaggagttcaagaccagcctgaccaacatggtgaaaccccatctctactaaaaatacaaaaaaaattagcctgacatggtgacacgtgcctgtagtcccagctacttgggaggctgaggtatgagaattgcttgaacctgagtggcagaggttgcagtgagccaacatcccgccactccactccagcctgggccactgagcgagactctatctcaattaaaaaaaaaaaaaaaagcctggatggcctagtgcttccttattgcttaattaacccttctccctttctttgacccttctcctccttggttgccttgtgtggttgatggtgacatcatccatccaatttcttatcctgtaacttccaagttacccttaactcctgcctttgcccaatccccagccttctatgagataccacatgcagcctgcaaactcccacagctgtacgcaggcatgtggcctcttgcctcgacatctggccccaccgtccaacccacctttcagcctccaggcaggtcctcacctctgccatcctccacgtgatccccaaacgttgctgatcaacacaccacagctggaatccacagaggcgccacagtaccgaaagggtggctcaaaccacatcgcatggctcataaggcccttggcgagttgacatcaggctccctctctcccaaagccacaccgtcttcctgcaggcaccgccagtggacacaccgaacacccctcttgtccaaacacactgcagctccctacatacaaagggcaggagctagactgtggaatgaggttgactagcgcttacatccagacactactgtaccacttgctttccgggcagattatcttccctttctgagtctcagtttcttcatctgtattaatggagatgacctaagagctgccctgaggattaagtggtataatgcacttaaacatgacaaaaaaaatgcactaaataagtgtcatctccttcctttccagcctctgcctgcacaaacccactgttctttcgctcagggtgctctgccctgcgactcagcctccttcgggctgcggcttagcatgttcccctcagcctccttgcaaatgaaggcttagtcacttcctccgctggtcccccagacctgtgttcacctggctcacagccctccttaattacaattgtaattgtttatgtgcttgtttatgcgggagatgacaggactacaagaaggcgggacttcctctattgccctaggccctggggtgaactgcagccagcactggccttgccggctcactgcacagggtgggcacttagtccctgacttggacaagccactcaacccctaggaacctgttttcttatctagaacatgagggtaatagttcccagttgccaaagcttttcccacagaccctgactcagaggagatattcaatgaatgctggttctactctacctttccagggctaagtcctacgactgtgacacaactgatgctcagtggctctttgtttaatgaatgaatacatgaatagtgattagagatgaggccccaggacctatagctttagatccaaaagaggtcagaagatttagaccaaccctaataacctgaactcatgtaaaagtggctctttcctcccagtccaaaccacaaatcctaaatgctcattcagcctcacttgccggggactcagcttctcccggggcctccgggtgggtcccatgattgctctgatcacctccctattattggatattaatcaagtcctactcagaccacaaacaagcagccctgctcttgacagtcatctgaggatctttgttggtgatgaggagagtgggaggaagggagagtgaaggaagaagagagggaaagtgatgagaagagagagccagggaggctcagagactgagcaagtgccaagaagggaagatgacaacgctggtgaagtctgaacaaatgcaaagtcaagcacaataataatttgggcaaaatggcaaatggcacagctgaggaggaaatagcattgtgaatgtaaaaactcctaaatggagcgcagatgggagggaaaagtgtaatcttctggaaaagcctctaattgtctgcccacactaataatttcagcaaacgctccctctctccctcctgcgtataattacaccattccatctgtctatcagcaggttttttactgtgccttactgctaccacgttctcatgctcacggagagatgaggggtttttgaagatttaagaatccttctgacacatatcctgaagaaaaaacactcaggcagacaaatccctctcccaggcctgctaagactctattttaaaaagttgtataatctctccaaacgctattatgaagtccaaaggaggcagggccacatggaccctccaccttgggtgttctcatctgccggcttgtcttagtaggtcagctctggagagacgacaggtcaggggctgcagggagaaaggggctggcagagacaccggcccgtgcatcccgcaggtggcaagtcataagagcatctgctcagggctatccctttagagtgtcttaggtgtcaaggccagggttctgctgcgtgaggaggaagaggaatgcaaatgaaagagaagaagccagccgggagtggtgggggagtgtctgtggccatgtattagctcagctcagctggcctgaggagcgctgcccagcgcccaaatccagggctctgagtgactccaactgccattggcttctctccctgctctggcagtgagttccagagaagacaggtggcctcgtgcacagagcccagtaggaaaggctccaggtttcccacccaagtcactgcccttcgtgcaggaggtacagagcttcccatttgcttgctccacgggcaggagctgcgatcttaaggggctgggagctgcctgcaggttcttcatcaggaagttttcttttcatgtgaaaaatcacatcccagctcttctccctttcctttccaataagtgggtcctaagtagttactggaaggggtgccaggagagaggcaggacaggtcaaaaaggggaatgaaggccaatgcccccaagaggatcttgaaggctagaggtgtggtggtggcagtgggtgccacgaggtgtgacctattcaccagatgtggattgggccaaggaaatgtcacacagaggcgattttgacagagccagagcccctccatccagcttgtcctcacatagcctgatatcataaccgcatcttccccagaattgctgagtggatggggagaagagttgactcacatcacaattcattcgacaaatattgatagtgttcccacaaggtgcagtaaaggctgaatacaacacgtttccaattctctatggcagcaacatctaatagaaatataatgcgagctgcagctgcaattttaaattttctagtagccacactcagcgagtaaaaagaaatgtgaaatttcttcgaatagtatgttttattttagtaatatttcaaatattattaattcaatagattataattataaaattatttgttagctattttacctttttttaggtaatgtcttcaaagtctggtatatatttatatttccagcatacttcagtttgagctggccatgcttcaaatgctcactgccacatgtggctagtgatgagtgtatcagatggtatagagccagagcttattaaggagaaaaaattgtatgtataattataattctagtatgtgcattattattattatagtttaggcccgcgaagtaattcgctaaacactttcacatacattatctctgatcttagcaattttgtgagatgattagttattgatattttttatcagataaataaaaataaggccggacatggaggctcatgtgtgtaatcccaacactttgggaggctgaggtgggaggatcagttgagttctggggttcgagaccagcccgagcaacaaagtgagaccccatctttacaaaaaataaaaaaattcattgagcgtggtggctcatgcctgtggtcccagctacatgggaggttgaggcaggaggatggcttgattccaggaggttgaggctgcagtgaattatgcttgtgccactgcagctcagcctaggagacagagtaagactttgtcacaaaaaaaaaaaaaagagagagagagatattcagagaaccgaagtgacttgtgacttcagagcagtaacttgacatccttatttcctactttctgaaacaagtatatgtacacacacatttttctgtgtgactcagtatggcacattggaagaggcagcgtaccaccttattttcctcttcattacagctgctttcttcttaagaacactctgaagaacaggaccggaaaacgatgtgaggtccccacactgtgttccacatacaattattagattggtgcaaaagcaattgaggtttttgcaattacttttaatggcaaaactgcaattacttttgcactaacctaatatctccctttactaatctctgctgctgtccccagatcagctgaggccccacctttggccgatcctctgcctcctagcctttctggcggaccccattcttagaaggctggggagtgggcctcaggaagcagccggggctctgaggagcccaggcattgtcttttctgtgagactcatcccgctattcagcaggtgaaacctctccgcctgtcattctctccccaccccataatgtgcaacaggcctgactttgtgatgggcaaatatctctctgagatcttctttacaggcattcaccccccacaccctcctcagcagtcttgggctaatgagctcagttcctttaaacccagctcctgcctcagcccttctcagaaacttatatccggccatgtagacaaagctagaattaaggcttccagatttatttcatttaacaagaacccacaaagccagcccagtagcccattcatcccaaaatagcttctgaaagcctgaacatacgtcagtgtctctttgcagaaaccacactgcattgtcatgaaagggccatttgaacaaggtagctacaatgaaattatctcaatgcatttcaatcactttgcaacatcaaggttcatttctcagtaacagtctctttgacaataaatgaattgcgtgattggtgtgtgtttgcgtgtgtgcatgtgtgtgacaccccttcatgatgaattcctgggtatgccaatgttacaagtgattggtctttgcatccatctcttagcataaatccccagcatcaacgtgacatgttgagcagcaccgagccccctggattctctcagtcttggtgagagagggagtggggactgtgttcacgctgttacaaaaggacatctaagagggacagcagggaggaagctgggcagaaatgctccgaatcaatagctctttcttcttggtggcttggagcttgcaatctctcagcctgtgtcgagtcatcatgaaactgaagaatccttggaaagtcactgggttgggcacttttaaaagtagagtcttttctgttctgcttagaaactctcatggcatgctacagagaaaagaggagcagaggcccacagagctcccttcaccagagaagggagcgaggaggtcagagggtggaggaggtgggctgggatctcccagggcagcacctgggcggagttctggagccactcccagcctggggagaagccctgcccctactgtttgctaaaagtttggacaaatccttctctgccctgtacctcaggttttccatctgtaaagtgggaagacaaccatcccacagaggtgccatgaaagatttttagggagtacctaaaaggttctttaggtgctagtcaagtcccggggtctcgatgtgtcattaacttgctgtgtggtcttgagcaagttacttaagatttgttaggtctccttcctttctttataacagggtaataacctacctccctatttaacttatgagtaaagcagaatggctgtgagagtgggcctggagccaaagatacctgactgtaaatctgagctctgctccatcatcttgggtagtctgctaaggtttctgtctcctgtccaaaccttcatctgtaaacgggagcaaatcatctctaatttgtagacctgttgtgagaatttaatgataatgcatgtaaaatgcctagcaggggcctgtcacatagaatgtaccctattgatggtagctgcaggtatattacaaggttgtactgaaaaacaaatgaaagaaagcaatctttccttgaaaaatgcacagagctccacaaatctatgacatcatgatgattatgatgattgttgcaaatgtcacatcttcatgtggagtcgaggtgggcattagccacactgttcccattactcaaaccccagatgctccaatgacagagcctctgctgagaggctgacgtcagggagaggtggaggagggcagatctcccaacccttggcttccaccagcttcctctcaccgtggagccctaaggcctcagcagacacgctgacttcttttcagaacaaagcacagcaaaacaaaacacacagcggctgctgaatggaaaacacttgcactctagaaaggctggcaaattccctgcctcgtcccaccctgcacggacagggccctctctgcccagccacctcctggtgcaccccgctgtatctctgaccacactttaaatgtgcaccctaggaggtggatgctctgcagagagtgtgtgtgtctgatctgaggcctgtggtcccctgaagaaagaccaacaggactgggtgccatcctgtgcccaagttgttcccaggaggagaaagcctgtaggaggggagcaagctcccattctgcctccattccttgcaaggtcagccagctacatgctttcttctggctgggcccctgagggcaattgttgctttttcctcttgaggagtctttttattttcagagtggcagggaggatggtttatggtgagtatggacctaaatgagaagggtgagtagtagatggcgtattctctgggctgtgaatcctggtcaggtgggggtggctgggctggggcaggagacactgtaaagagccagtaggcctggattccttccagccgtgctgcttcctgccatttactccatctgacctacttcacaggctgggctgccatgagcggctgctgcaggctgtgcactgcacaaggccaaggcttaccatttgcatggtctgcggaggaatggtgctcctgagagctgttctctgcagcagctttgctcatggggcactggtgagcagcaaacagaatcatcgtcttcatcaccatcagcaggagcagtgactttaccaatgattgatcagctgttatgtgccaggctctgtgctaagtgctttacattttatcctcccctccaccctatatcaggtaagtactgttatatctcatccccattttataagtgagaacactgaggccaaaggaattaagtgatcggtcagaggtcagtcagatcgggagtgatggggctgtaatccaaatgctgggctggctgactcctaagttcacactttgtcttcattcatgatacaaaagagatgtctgttttcctgaggcccacgggcaggggaggcaggactcctaagcctgggccctctgactgcctgggccagtgtttccgtgccagaaaccctgtctcagagggcaggaaagagaatggggagcccttgcagaatgtggttggatccttctctcttggctctgtcatccttgccttgggatgtcctcccaacacaggccattaatctcactcaagggccagtgctggcagcggttatgctggggacatctacataccttgcattcctcccctttcacagaaaggaagaagaaatggaatttctgtcagattgcttgaactcactctctggaatcactgcgcccatcttttcagagatgttgctaccagaatcattccccccttctcttatttatatacactcacacaattagatataactatattcacacatagacacatattacaacttgaacttagcacctgctcttgatatgtatgcccagaaggctgtcacacaatcttgcacacacccacacatttgcacatgcccatccagctgagcaacatgtatttacacagcacacacatttgcatcatatctgttcatgtgcatgcatgtgcacagctgttccccttaactgcagaatgaagtgagcacagcagcacagaacaacagctggtaggaagcatgtttgtcggggtgtggggagtgcaggagagaggaggtggggtggggccgggaagaagtgagtactagcagaacagaggcttgcaaaagactgcagcaaccagccccagctggctgtaggggctcacagtcttgtcacttagaaggtctgtctgagagaccttggtggagtgcagcttcagcatttggggccacagctctgcaggctttttctctaaaaggctgccctatttgtgttgtgtgtccctgtacacgtgcgtatttggctcaggctgactttccatacacagacagggctctatttttggatgtcttggttctcatgagttgtggctaagtgaggaagtctgagtctctcctgatgcccacgcttccaggatggctcctggctgtctgcgttagcaggtcacttttgggctagctacctataccagtccaaaggcttgatacaggaaccacatcagaattggtgacaaaacaagctggggggctcctaaaggaagatactgggattctcaataggccatcacccaagggaagcagtattctcctcctgcgaccatgccatgggatgaaagcctctgccctgtatgtctggccaccttgctaaaaactgtcagccagctctaggcagctccagagctgtatgacaggagtgggaggactcttgggtcagaactgtatttgtgggtggtaaatttatatcttacccactgaatatagctttttatggctcaagacataggtttggttttcttaaaaaaaggttttcttaattcaaaaaatgtacacatttatagtaagaatacaaacagtacaaagatgtcagtccttttctactcgtgccaaaattataaacagtttatttgcatcattctgcaaattttatatatgtctttgtgatatggtttggaggtttgtcctcttcaaatctcatgttgaaatgtgatccccagtattgaaggtggggcctggtgggaggtgattgggtcatgaggtcggattcctcaggaatggtttggcactaacctcttggtgataagtgagttgttgatcagtttgttcacatgagatctggttgtttaaaagtctgagacctctccttccctctctcttgcaccttctctccccatgtgatgtacctgctcctgcttcaccttctgccatgattggaagcttcctgaggcctcaccagaagctgagaagatactggaaccgtgcttcctgtacagcctgcagaactgtgagccaattaaacctcttttctttataaattatcccacctcagatatttctttatagtaatgtaagaatggtctaacactacgtatgtgcaagtgtatatgtatatgtaatgtatacctatgtgtatgtgcataaatggaaaatgcactgtggtaaattacagatggctacaaacacttagccactcctcccagaaagaggtggaggctacctctcctattttagaactgccatggcactgtgacttgccttgaccactaaaatgttgagaaagtgatgctgcgtaacttctgggaaaaactttaagagatttgctgtttctgcttgcagtcacttagaatgctccttttcagaatctggcccctgtgctgtgagaagcctaccccacatggaaatatacacagaggaaaatggaggcagtggccaaaaacataagtcaagctcctagtcaacagccagtgctgattatcagccatgtgagtgaaccactagggccttctagcccagtcaagccttcagatgactgcagcccccgatgtcactatacggagcaggtgaaccactcaactgaacattgccaagccacagaaccatgaaagttagtacatggtgggttttatttccagtggctatattttgggatagtttgtcacatagaaatagagaactgaaacatgaagatatatttgattcatttaaataaatatttagtaattttctgattggctataccattttctttttaattaataccacacttaataggtaaatgtacagctatgtgtataatggaaagtgtactggggacatgcaaatatcgtttaagtacaattaggtttttatctagttatttgcaaaaatgcagcaatagacatcctgtgtgtggatatttgttcacatgtataaatatatgtctctaggttaaatttctaggaacaaaatgcttaataaatgacatgtaaatttaaaattttaatagacattgacaaattctcttccaaaggtaccatgccaccagtggtatgaatgtgcctgattccccacttccttgtacacaggacatggagatatgctcaaacctttcatcttcggttgtgtaataaatttttaaaaatcatttattttgcttttcttcaataacaattgaagttgttcatcttttgatatgtttatcagctatatttttctttttctgtaaacatcttttgcccatttttctactggttcataagagcttttttctgtattgaattttaataattctttttcctttttgaactgtaagaactcttagatgacaaatgaaagaaattagctctttatcagtcatttgtgctatacatttttttccacagattgttttttgactttttttttttttttaagagatggggtctcactgtacatacatcacacattttaagagatggaatgcaatggtgtgatcatagttcactgtaatctcaacctcctaggctcaagcaatcttcttggctcagcctctcaagcagctgggactacaggtgcatgccaccacattggctaatttttaaattttttgttgagatggggaccttgcccaggctggtcttgaactgctggcctcaggtgatcctcccgcctcagcctctcaaagtgtttggattgcagacataagacaccttgtccatggcttttttttttttttttttggcttttgactgtacatacatcacacatatatacatctgacacattttatttttgtctgattttatggtttcgtctttcatctaggcggaatttgtcttgctacaaggggtgaggaagggatcctgtctaattttttctccacaaatgtctagctagttccccatagctttcattgatcattgatttatcccccactgcttcaaaacactgcttggtcatatactaactgcccaggtatatatttgggcctatgtctatactctatgtcagtccattgttctctctgttcatatgccaatactgaaggctgcttcttagcctttccagtctgcatttcctctgagtctgctgttcgctgttggagccaggggctaaagtactcagcctgtactgtcagtcccggatagaatgcttccatttaaattctcatctaactcattctattccccctgtggattcttctcagcacttctttagaaagtctcctttccctgggtcatttctcccagactagaaaaattccttcccataatagctcttaagtgcttcctcttggtccttgtgatgagcttttttttttttggctttcctaggaatccttccactctgggccaaaacttcacccttcttgcctcccttgagaaagcagttatctttttgtgggccatccccatgcattcattctcctgcctgttcgctcgcttgcagtattacatggggtagcggggtcaagtcggtggagggtgaaacaggcgattggcaatactcccctccgcatccctgaagcaggtgatgatctccataggtcccagggtatccgtgccccgtttgatcagaaagaaacacacccaatcttcctcttccactgacttttcccgtgtgaaaggactccctggtcaggcggtattcatgccgcctggaaactcatctgcctgtgccgctgctttttcctggcagtttacaatgttatattgctaccaaagcgggcaaaatgaggatgtgaagtcgagcatctgagaaggctcagaaagtctgaataagcaatactggaataacaatgtactcctcaccaaggcatttagccagaaaagtgctcctgcttaggaattctatttgtttttctcttggaaaatggggaagtacatctgtaattcagctgtgaataccctattttctttgcaggggaagactggaaatagagtcctttatctcagatatcaaaccctggcccaggatacacaagaccaggagtcatcaccatcagtaacagtaacaacagcttcattaacaagttgctgttccgacgtgggctccggggtggggaaggaaggagggcgttcggctcaacgtccaggagaggcaccggcgaactcgagagccaagagcggcactcccacctgggcactccttgctgatggaccgggacctcctctcccatttctccggggcctccagggccctcccgcacattcagcatgatctctgaggagttcactagctttcctccctccgctctccagctcccgttcctaccaaatgcaccaatcatcactaagccaggtcaaaggccatgggatcagctgtgatctctcccttcctttttcattctcctctcctcatatccaaactgtcattaaactcagtgtttcttccttcaggctgtttcttgaattggtttcttctctatcccactattactgtcctgatccgtgctaatccaacagtttctgcccccaccccaggacagcttgtgttatcacggccaggtggatctttctagaacaccaagctcagcgtatcccttctgatcaacagagaaggagaggagagcctacactgtgctgggtcactgtgttacgctatgtgcttgtttcatttaataccgtcaacgaccatataaagtgtgtttgattatccttaagcaaaaaggtcaagaaattattagatcaatttcaagtcctcttcctggcattcagaactcgccccaaaatatggctgccttgactagttggctttatcatctcctctatcccaagatgacctttggggttccaatcagtcctatctcttccccgggagtaggggtggaggggcagcacccccgggcagaagatgcagccaaacaggaaagacagagttcacacctaactggctaaagtacaggcaaacacctgctaatgagtggtggtggcagtggtagggagtaggttgaactgtgtccccaacattcatatgccccaatacttcagaatgtgtctatatttggagatagggtctttaaaaaggtgattaagttaaaatgaggtcattagggtgcgtcctaatcctgcatgactggtgtccttataaaaagagaaaatttggacacagaggtacagagggaagaccatgtgaagatgagggaaggcagacatctataagccaaggggaggcctcgggagaaaccaaccctgtagacacctccatctcagacctcctgcctgcagaattgtgagaaaataagtttctgttgtttaagccacaagatcgtggtattttgttacagcagcccagggaaactaatacaggaggccgggcaggcattgtccaagggagctggagaggctgagcactggggcacgagggtaggtaatgatgtgagctaccttactgagcatcttctatacagcaagcaccaggctacgctgtgaacattctgcattcattatcactaatccttacacatgccctgccaggaagttactgtcacagccattttagagatataagatccaaagttcagggtggaaagaaatgtccctaggagacacacataatgagtatcaagtctggcattggaatcccaatctcctcctcactaagcccatgcttattctactattctgtcctgtgtccatcagtagatgggctggcatcagtggaccccagatctgtccacaggcagcagggccctgaccaacaggtggcttctcggagcagtgccttgtcttaggggggcatgttcactgaactcatgaggtcagaacacaggacttcacaaagctgaggagagaagggagatagctagctcagtgtggcaccccattcttcccattgagccctctcctcttcctgttgaagttcagcgtggttctggaagtacctgagtgggaagtagctttagcttcccacgactgttcaatagcattcaagtaacccttcatggcatgccgagattcctaatgagatgagaatacattctttaaagctccagttaacgtgtatgcagatgggagcttggaggactattttgctaaatgatgcaccctgtgaataaccatcacccccatatctactagggcaggcaccccttctctgtcctcagctggggacccctctcatcccacttggactcagagtccctggtgccccgaaggaaagcaaatcagcctcacttataattaagtgtctcaaataaagttttgttttaggctaaataagaaaagtgataccaagtcaaacagatcacaactgattattaagaacagatctactacagtttgacaactgccacaaacacaaatcttatttgggagttgctaaaactcagtaaatatcattttaataattaattaaactttaattaatgtcttgacagtagtctcaacctgataggcctcttcacaatgtgcaggctgtgatgaggatggtggctgctgggacggccaagggcagctaggtttcaggtgtcccctccttggggcaaggagaactaagttcactttcccccaagaaaaatctgtggtctacacaaatcaacctaaccactgaatcatcaaacactctgagaattcaggttaccaacagtgactgcaggagaatctaaagtgcttttgcatccttagagaaaaatctctgctccatctttttatggatccagtgggtggcagaaggaatggagttactgcaacatgacaatctccatcctgcctgatgcgcgagcacataaccgcctaagtttaaagagaattctggatataatttattatataagcctgtaatcccagcactttgggaggccaaggcaagtggatcacctgaggccaggagtttgagaccagcctggccaatatggtgaaccccccacctctactaaaaatacagaaattagctggggggtggtggctcatgcctataatcccagctacttgggaggctgaggcatgagaatcacttgaacccaggaggcagaggttgcatggaactgagatcgcgccactgcactccagcctgggcgacagagcaagactccgtctcaaaaaaacccaaaaaacaacaacaaaaaataatttattacatgagtagctcccaaatagcataattagtatcatgttagctgtaaaattaaacaaaaaagacttctgtccagttccctagaaattctaatttagtaggaatgagctaaaaggtctgatttagtaaggtgagaatttagtaggctcaggaatctatatttttaaccagttcccactgtgcgaggatgctgtgccagcaaagggcttcttcaagccacagagcctcccctcccagctgccctctctccactgagcctgaagcatgggcggcggtgggagccgcttcattataaaaagcagaacatccctaaaaacaggatattctagggacaccaaagagccgacactccattggaaacgcctcctctggggtccaggaaggccactccacagtggcgctgaactactgtttctcagcaaggtggtccgggccttctgccgtcagccagccacgccccactcccagtggtcctcttccgacatgaaagatgccaggaacaggaaaagcaaaacagcgcgcagcgactttcctactctagtagcattttctttctgtgtctctggtgagtcagagtttgtttgaatgtgaattatctgcaatcacgaaagtgacagtacagctggctgccgggcccgaaggaaatgtgtgctccagataagggcgagtgtgtgtgtgtgtgtgtgtgcgcgcgtgcatgcattttggggggctggggctgtcctcacttatcaaagcaattcccaaggcggcctctctgagtgaggcagggtctggcagggccgagcccctcagagccctctgccccgttggtgctgtgccggcgaaaggccacgcctcttcaatctggggcacccctgccgcctgctccacctcgcccgtccttgggttctggtcaatgttgggttgcccccttttcctagggatgtgggaggagaagagaaaatggaggtctatattgccacctcattctccgggtgcgggaaactttccctcagaggcaggacgcaggcaggtgaggatcacccgccacggcttttgtccactcatggtgtgagtctcaagaggagggaaagtgggtagggtctttaagtttggtactgtggccctctgaggttggcgacaacctgaaagctaccagcagagaaaagtaggtggagacagtgcttttggccacgacccgtttttgtcatcctcgttcctcctacaaaatgaaaaatggtccagaggccattcagatccccgcaccagtcactgaaaagaaaccagtttaggtgtccaaggctttttggtcatttactagacatttattgagtgccttcgaagctctggcgtggtgctaggtattaggtgctaggtgttaggtgttgagtgttgggtgctaggtgctaggcactgggtgctgggtgctaggttcctcatctcagggagctcaatctctcataggagtggcagataggtaaatagctataacaaagtgtgagaaacctgaaactgaggaagcacagggggctgtggaagcccacattgctgattcctaaccaagagcggaggagttggggctgtgaggatgaatggtctgagaaggccatttagggtacggactgatgctgggatgtgcagaaagggagaaaggaggctccatgcagaggtcacagcccatgcaaaggcctggaagccagagagagcctcatgcatttaggaagtagcggacaataggcagggtagcatcactgaagcaaagcaggtgggccaaggtggggaggggatgagggcagggctaggggcagggccccagatgtgaagcgccttttatgccattcttagaagtttggacgtcctcatggaggtaaaggggagccccaggatgcctcaaggtatgtaggaagatggggcaggaggccattgcagagacccaggtaagaaacgatgaaggcctgggacagggctgcgctgcctgaggtgatgaggagggaaagactccaggcttattaggaagtagacgcaacaggctctggtaactgacaggagtgtacattctgcagagggcgacagacattcaacaacaaatgacacaatcaactatgcaattaccatggtgataagtgtgctgagggagagtggagggtgtggggttccgtagggggatctgacctggccagaagtgggcgagacctccttgaagaggtgatgttcaacctgaggctgacgggcgaggaggaaatatccaggtgaggtgttgagtggggagcacggaacagcatctgaaaatgggttgcagggggagcacagtgcttggaggacctaaaagaccagtctggctagatagggcaggtcagctaaggactgcagaccaaatttgattccctgactgtttttgtaaaggaggttttgttggaacacagccacgccctctgcattcgtattgggtagagcagcttttgcatcacatagggccagggctggggaggggaaagggaggtgcccagggtgcaatactgaagaagaccctcactcccaggctggtgcacaagccacagcccggacagtcagtgcctccctcaattttgtacctagagcaccttacctgccttacacagttctggcctctctgccacaatacaatgacataatcaatggaggagttgcaacagagaccttctggttgcaaagcttaacgtatttactctctggctctttgtagaagcatgtagacccctggcttagagcagcataaagaggggagcgtgtggcccaggccgagccctgatactgttgcagctctggccacagccccttagcattcaactagacatgcagaagaaacctgtgctaatgcctgcgattctctgtgggacagcgggtgtgatggagtcacggagatgtgatggggggcatttgggaacatgctcattctgtcttgggcaaatggcatgtgctggagagtttccgccctgggaggcagccctctacacatgataggtatggggctggtggggataaatgccccaatttcctcacttctccttggggagaatgccacgtcccagagttgcacggtgggctgactgccagttgcacacagtggtatctacatgatgatgaatcctttactggcgtctttccttcctttcctactcacttcctccctcccctaccagggtttcctgggatcgccccctgaaacaaactacttgcatttgaatccttgtctctgggtctgctttgagggaagatgtgggatatccctgagctgcctgaggtgggggcttatgtaccaaatcccaccatagagaaggaggcccctgctgggtgatcagcggagttttacttacatgaactttcctcctgcttccccatcccaggcacccgaggcgtcaagccacagggtgaagactcaggcttcatctttttctcagattctaaactcacaccccacctttctgtgtggctgcatggctggggactccatcctcctaatgatcaggttcttgtgcaagcctgtgacactttcaccttgtgacaatgcccagacaactaatagagtctctgttttgccaccggataattgtttatttcctctttcaagggaactgtgtagaggaagaaatcagttgagaaaaacagtcttgagctactcaggctatccccatctattttgtgggggaagaaaactattcagcattttcaggttccttcctttcagatcttcccaaagatctcagtgcacaaccagggctggtctgggacagttgctgtgcttctgctctgccctggccagcctctgagggggtctccaaattaaaatgcaagttttaagtcagtgctctcctttcctggggattgttgacagctcaagaccacatgggctcatcactgtgatcttaaggaaagaaatgatcagggcaaatggctccaaatgaagatgaaaaagcttttacagtgacagggaagaaatattgcaggctgcttgagaaaatgcagtttgggaatataggagaacgtggaccattttgcaaatcaaaaacaagaggaaaagggactacagcacgtgaaacatactaaagagaagagcaaaaatgagattagaaataaaagaagggcaggcaaaaggaggaaagagaatgcgggggaggcaaacatcagagagactgcacaagagcaagagggaagacagagaatgttcaaacaccatccacgatgaacacggttgcagagaggccagtgttccaccgtcaagagcgcagaaaagcccttggtgctcctctgaagaatgcaagagcaatctgcagtgttattgactagtggaaaaatggctcctctctgacttagcacaggatgcaatttatcttcagagagtaccctccatacacccaatgttagttcttaggcatgaggttgggcaggagaagggcggaggaagaggtgtgggaaaagaggcagacagggaggtgagggggaatgtgggaggtgatgagaaagaaggaaaaagaagaaaggagatggagagagtgatagggagacaggaggggagaaggaggaacagataggagggagctatgaaagaaagagtaaggttagaataaagatttgggaaggagagggaggcggaggaagaaagaggaagggagggagctggagagcaagattttgaaactcttaaactaagaagagcaaagcagctaatatgtatggagcacctgctaggtgtcacgcattgagctaggtgtcatttcattattatttgatctcatgctaacaccaccttggtgttatctccctcatttttataggtgagggatgggtgctctgagtttcaataactttgcccagaaccacagcgttgaggctgtagggaggttaggattggagctcaggggacaaagcctgtttcagatgacacaggtcagccacatcccagggaaacaggaagggactgacttttatggatctctagctcccatctaagtgatactgatggagcacagaagattcctggggacactcactgtggcctgtgaaaacctgggcctccaaacaccagggggagctatcaccctggaagaaacagccaaatgcatctgaaaactggccatatcagtcaaagaaggtatttactagcctgagtgtgagtgtgagtgtgtgtgtgttggggggggggggaagtgtgggggagagtaacagctgattctttctagctgattttcattttatactggacctcatctagatgggatccacccattatttgcagtgggtgcctgttttgtttcctttcccctgcttgttggctgctgactcatttgccctggttacctgggaaggcgggaatgagcctagggcaggcatagagctcagcgcatccaagatgatttggtgcgtttttgacagatgaatgaccaatgggaggatgaacacgtgcttgaactggaagggttctggaagaagcatttgattcttcctcacccaggtcagatcaccatctcaaacatcactttaaaacaaagaacgccacaaagggagatttctttgccttccttagaccttcacgctggtccttaccttcaaggctgtcctcgctggactttagctgttgaacccactggcatcctttcggaagcctgaggttgggagttaggagagaagctaattattctatggtgtcttggatatgctaacaataacagctcccgtccaaggctgtcatgttatttaatgaaatagtggaagcgtgattatagtttataaactcaagtactttgacagtggtcactgctctgaaggtgccactgttgtacaagtggctatgtgaaccagcagtgatagaatgtcccagctgttggctatgccttaccctattaccctagatctattgactcagatgctttgaaagttctcgcggggaactgttccttgtagactctgctcaggcaggttggcgtggccaggcttgggaatggctgtcaccacacaccttgtcctccatcctcactcatctctgtcctcctgctggccagtcacccccacctagtggttctcgtctgttttaatgagttcagagtcattgccaaactaagtagtcagcttccatcagtgctattcttcatgttgagccacaacataaaacactttattgcaattacaaatagcaaaattattttctgccgagcctcagcatctgaacttaatggcatgctgtaatgccaccctgcgctgatgtgtggcatatctaatatccatctttcttagaaataacagtgttcagaaattagaagggactttagcagtgaaataattaatgtggataaccatcataaacggcacaaatggaacaaatacagatggtagtgagccgtgattgctaatatgctaacctgttttgacagaactctacattttttcattgggaggttcatggatagaagttaaaatatcccttgcctcatgacaagagctttgtctttctgggtaagagattcaatgatctcctacctgggcaaggtagcatcaccggaatttgcgctgagaggagggcttgcatcccagctctgggctctctcacacccttccatctcctgcagccacatttctgccctctgcctcaggctcaggcaggcgggcccacccagaactgcagccagacacccacctcttctgtgctatggctctgagggaggggcaggggctccctggctgggctcactcagtgggaagcagctctttgaagatcctagctgcatgcaggtgcaagttgcggaacccaactccaagaggctgcacggaaatgaaaaattgccatagaaagatgactcaccaaatcacagacactaagctattgagacaaatataaggacgagggtgtttgggggcactggaaacacttggctgtgcctgcttttggccctgctggcctttaagcagcattagcagcagaagggccatccaagtttctctggatgagtcagaggtcctcagagaaatgctggagggcaaactggggaaggaaggtagaaaggatctagctttaacttattaaggataagtgctgtgctttacacatattttatttactctcaataataatcatttgccgtgggcatggtaagttaatatttaagatggggaacctaagaattagacaataagtgatttgccaagttcaccaggggcagggaagctatgggcagagcggctagggattagggtcacaccaccccggccaggagccccattgatacgatacagggggcctcactgagtctttctgccccaggaagccaagccctcctctctgatgctgaatcccagcccccttctcccactcaagggcgttgatagaaacctttgtctcctttccctccagagtcatcattccccctttatttaatcatcttcttacaaatatgctgtaatatctctaacttttttaaaatggagaagcctttctcatgtttgttttcctcctgctatacctcctttgctgtgttctcttttacagaactcagaagagctgtctctcactgtctccttcatctagacaaacgcatttcccttcattccgacactcggtaacccacttattctggttttgtctcaaatctaaaaatacgccactgaaacggcttcttcctaaattaccaatgactccatgttgacaaatccaatggtcaactccttgttgacacaaatggccagctcttctgtttgaacgccttcttctcttagcctctgggagagcagtctcttacgggtctactcttactcacagctactccttctccatctcctttgctagttcctccccatctctattattcccaaatgttggaggacctcagggcttctccgagctgtctacattcactgcctaggtgatcttacttagtcccatggctttcattccacccgcatgctgaagtctacttccttgctgggcatttccatttgaacatctcttaggtttctaaaatgtaactcatccacagccaactcctgccttcaccacacagcccctcccgctagatcctgtcaaaatcatccctatctcagccaatggcaacttatccttccttttgcgacttctaaggccacaaccttagaagtcatccctgatgcctttctctaatactttatctttcaatcttttatccagaaaatgaccacttcttacaacctctgctgcccccaccctggtccaagacagcatcaccttgcatctgttgaggctcctgagagacgccctgcttcttccctgcttcagcctcttcttaacccagtggccacagccatccttacgcaatgtagcaatgtcagttggatctgatcgctcctctgtccaaacttctgatggcttagggtcagggtgtggtccctctgcctctgatttcagctcctactcatccccctttgactcatctgcttcagctgaactaacctcctttctcaagccaacctgcaggctccctcttcagcttcttggtccttactatttttcctgcctcttgactttgtcttatgtttcttcattgaacttattgcctgacacagcatatatttatttgtaaattgtctgagctcccacttgaatgtaaactctttgagggcaggggcttaatgtgtttgtccactactgtatctccagtgctcaaaatagtaggtgccaaataaatatttgctgaggggatgaatttagacctggtgagactctgcagtccttgcctgtcccaccagccctcacggcagtgtttgcatgcaggagatgccatgtttgcatggtggggctgtatctgcctggctccctagtgatatgaagttctaaattccaatgaaatctcaaatccctcaaagaaagattttaccactctggttaaaaatcagacctagaggaaatatgctagattgcagggtgtatctaaggaaataaaagcattaggtgggtgaaaaattgcaaaaaacaaaattactttcaacttagatctgaggagtttaaattagttcactcccatgcccagtgtaggtgaagacattcaccacccaaacacagacactcttgagagcgaatgagagttataattatcatagttatgttagggctgcaggcacaagccaagactgtcctaggcaaaccagttatgatcaccctcatgagagagaaaggaattggcttgtggctgggccagggcacatgcaaatgacgctgtagggctggcattgaagaggaagcctgggagaaggtgggagaagatagcgaggggacctggaggagaggagtgtccaggaaagggcagagagcaggaagatctggagtcatacattaaagggcaggggcagggaacaatctgggagaaaggtctatttcatgtgcttgagagaggggagagagagaaactgggattcctagggaagaagctaattgggcaccagccgagctggcaagggagggagccctgaaatgagaacaattttggctgagagccaaagtgttttctgagacagactgaatgagaaacaacatggtgatttggaaagaactttgagactagattgacttagtctcaaattctggtgctcattcgctttgactgtggggatgacactgcttgtgcttagcctcagtttccacaagacagcaccttccttaaagaatcatgaggccgggcatggtggctcatgcctgtagtcccagcactttgggaggccgaggtggatggatcatctgaggtcgggagttcgagaccagcttgaccaacatggagaaaccccgtctctattaaaaatacaaaattagctgggtatagtggtgcatgcctataatcctagctactcgggaggctgaggcaggagaatcgcttgaacacaggaggcagaggttgtggtgagctgagatgcgcctttgcactccagcctgggcaacaagagtaaaactccgtctcaaaaaaaaaaaaaaaaatagaatcatgaggaataaataagataacacatgcaagacatctaacacagtgcatggcacagagtaggtgcctctctggcaatagcaaagaagcctgctcaagaggacagagattgaaggccaaggcttcattttggatttgcagagagaagtcaggggatgagcttgagcccccataactgcgctctcccctagggtctggcaaggaggccttgatactgaaggaaggatgataacagggtgcgttggagggacagctgcagcttcacacctgtgaagagccatctgggtcaccagcacggtccctgacataggacagctccatgtggctgatactgggatggtgcctcacagtcaaaaagcctcacagtccaaaagcctttttgtgttccagaaccatttgtgagtgctctggtcagaagcgaagggttcccatggaagtccttccctgtgaacaatgtcaggaccccttagcatggcagtcaaggctcccaatgatatgtcataatttccacttccagccttgtcttctgtctgtaactctactgtatatacctcatgatcctgccaaactgttcctcaagcacctgctgtcacttctctcctccatcccaatctatctgcctgaaaacatcctgtttccagtcatcagcccttggctgacacttgaacatggcagagtcattccacccccaggggtctggactagctgttccctcttcccaaaaggcccttctcctggccatctgcatggttcactccctcacttcctacaggaagtctcattcaccttttggggatttttttccctactgaaatttgaagctctttctccaacatttcttgtatgtatttatttattcctgatttatgttttctgtttagctcttctgactatctaacttacaccatatcaggggttggcaaacgatggcccttggggccaaattcagtccactccctgtttttgtaaataaagttttattagaacacagacatgcttactcatttatgtattgtctatgactactttcatgccacaatggcaaaactgagtagttgcaaaaaagaccacaagatctgtaaagactggaatgtttactgactagtgattagccttttccaggaaaaatgtgctgagctgtgctctaactcatgcatgtcatgtactttatgtcttccccactagaatgtaagctccgtgtggacaaggatttttgtctgtcttctgaattactgcattccccgttatctgggaaaacaactactcagtacatatctgttggatgaatgaatgaatgttgaaaattctattcattggcaaggcctagctcaaatatcacttttcaggaagcactcctttgcatcatggtgatttccgcacgaaatctcatttctcttactagatggtaagcttcaagcgtcacctctatcatgaaactatcctttgtctcccacggtggaattggcctttcttcatctattcctcttacagtcttctgtggctgcacatagtgtacggtaggtattgcggtatttgacacatgttggactctccacttgactgagattaagtgggtagggactgtggtttgttcgtctccgtcccaggcatctatctcagagcctgcagccctgacacattgcaggtacttagcatacagagctggatttcccccactgaaacctccacagccctcctagcagagacagacacacttttagtaggggctaagctatgtttgtggagtagaatgaaaggcaaagggaacagtgctgagccagagaacacagcattagtgggagctgtggagaggaggctagaaataggcaaagaagggaggggacaggctctgtttcatttcactctaccataaagaggtaacaatttaaaaaaatcaactctcctcagcctccagacacacatgctctgtggcatcattaagcagctggtgccaacatttacctcacacctcccttagtaggcaagaaagcatttcctaaacccttctcctctatgcttttaaaataaaggccttagtggatctcaacttcagcaaacagaacattttctacttttctatactgtaagatttttgaaagcagtgactgtgtcattcttttatattcctagtacctagaccatgatgacataataatagatgcagaattaattttcattgagttacataaatgatacaatatgaaaagagaagggaagaaggaaagatggaaggaaaagacttgcacagatgctctttgtgactcagaactttggaaaaagtccaacgagcaacaaaatactcaaaatactttaaatgaaggtaaaaaccatcattgttttctctctgcctagggtttttaggaattttcttctattcaagatcataattgcagaaaactagaccaatgatctgattgctttcataagctccatgatgattaaaagaagtgtaggcagctccaaggccacacatgaaaagagaaatgctgaggctgttccatttgagcctttttgtcttgcttggctctttgtcaaaaccaagtctccttctggagatagagatgcagatcaccacctaccccaactgttcccacttgacttaagagacaatgtggggaagaacatcacccccatttcaaccttcagaggcaggttgcttctgccacggcaaggagaagatcactttctgtgtaagatttctgattcctgtctcctgcaggttggttcattttctttcaaacacctgtgctgtaatatgctaacctgatcctaagacaggccccaactagtacacacgcagatccatgcacacccacacacatgcacatgcagacttattgtcatagcttgtatctcttatggacaagatgcagagtgagtgagccagcagatggacaccctggaggttcggagccatgtcactccctatcagccctctccaaacatccaggcaggatctgggagggactgcccttgagatgggtgggctccatgaatttccagctgaagcaacacgtttctgtccccaagggatgaagaagtttcttcagctgctctgtagatatgtcatgtcgagattgaattcaggtatagttttagctgccttccttcttgaaacttccctctccccgtttgaattccaatgaggcatcttttgaatgctgagattgggaagcaagactgagacctgcttatgggccaagggttcttagtattagataagagtcaggattattagacctgcctatgggccaagggttcttactaatagattttgaataaccataaaaacaactttcctgcattcctctttatcatagatcaacttgtcagttagtcattcacttaatgagtatttattgtaccttgactttgtgtcaggtagtgtgctaggtgcaggagtagatattcttatttctgttcttcagatgaagagacagaggttcagagaggtgaggggtttcagtggaaagtggccgagtcaggaatcaaaagcctgtcttctggtgcctgcttaatggggttttaaccaatgtgggtattaggtgagaggtggccaggagaaggcaggacattaggggttatttcttaagcctgtgggtaaccactgaggcagcaggccagaaagtcacgtgacccagtgtgatgtatgggagaggacagcgtggtgcctcgtatgccatgaagaattaatctcaaggagatgctagtgagctccagagacttagcatcagtgccaagagatcaaagatatgatatctctggcagagtgcgctatcaggagcgatcaaagcaaaaaaaagggttcatttcagtgccctgtgcattagttgcctgacttgctgactctgggcacaaaggaagcagtcatggtttggaaatggtgctaacacccgcatgggcatttctttcttgacatctccatacatctcattgttgcctgtccataaacaaaaacattatcatgcccatgggtttgcccccgctcatccccaagctggctgtccccgttttcttctgagtgtgtttgtgtgctcagtggctttcctgccttccttggatgatggtggtagaggccgtccttgtctggaggaggcctgtcagggtgcactgctgcaggctggaccctgagcccgctctgccctcgctgcaaggctgctgctggggtggatgtgcggggctggtggagctctgtggcctgggtccagtctgcacaaaggcagggccagggactacagagagcatggggggaggcatcaggattggccaccaactcactgagggactttgtcaagttgcttcccctcgctgagtctcagtttccttatctgtaaatcaggcagttggtctgtgtcagtaactttcacccccagtttctctggtgatgtaagttttccaatcaaattataataacccaaatagaggagatgccccataaatacttcttgaatgaatcaaagcaaatctataaagataagcatggaaacatgtggactgcagtggacagggccctggagaacgcccttctgagtgccctccctccattctaaccccctgtgtcccgaagtgggtctctaaggcccttctgtggaaccctaaggctccactgaacccagcttgacaaccacaaatatggactttcttgtttcttaaagctctgacattcagtgattctaggggaactattaagtctcaaatcccttacaaattaatgaaagatctctgacatattttctagaatttttcctcagaaatttccctggacttctctggggctatcctgttggctttatgaaaaagtctgaactacacaagatgcctcctttttttctttttagatggagtctccctctgttgcccaggctggagggcggtggcatgaccttggctcactgcaacctcctcctcctgggttcaagcgattctcctgcctcagcttcctgagtagctgagattacaggcatgcaccgccacgcctggctaaattttgtatttttagtagagttggggtttcgccatgttggccaggctggtttcaaactcctgacctcaagtgatctgcccacctcggcctcccaaagtgctaggataacaggtgtgagccatgtgagccactgcgcccagccacaagatgcctctttatgagaggatccagtctacctttccagctgttttttcccactcctatcatttcccttctcctagcaaaactctgtattggcctacacatgccaatgtgttgagcatgccatgcgttcttgtgccctgcatctttgcttttgccattccttgtgctattgtttttccactttcttcctgcaaaactcctattcatcctctaagacctggctgtgatgtcctggctcttgaacggttctacctctcactcactcacacagggaggtcagctgcttctttctctgagccgccttaccctctgggacacgcctccagcacagatttccgcgtagcctaccttcactcatctagatacatcatcttccctggcagatggagtgcttctgaaaggcagagacttagctttgaattcccagtgcctagcatggagcctggtccataaaaaccactccatccatgttcatgaaatgactgagaaacagcaagggctcctgtgcacttgggtgtggctccagaagaggcagcttctgtggctattccccttggaggccggctggccactctccctgcacagagcaggctggcttcgccatcacaggctgcttctcagaagctcagctacctctccttcctcacctcccagacccctcggaaagtgttccccaccagaaatgtctttttggtggcctcaacctgagaaggaaggctacagagcttacagatttaaacttaaatgcataaacaattcacagtggtcccctggcttaggctgaatctcaacttggaggacttggtgtccatggtaagtctggaggcctgaaggtgggaggcgctcagctgtctgcagcagctgtaccctgcaccctgcccagcaggcatttccctgctacatggctctcctcccagctccctcgggggggtctggccctcccaccctgggtgagctgcatttttgtggtcctccttcttctaatctctctgcctgcctcacaaagtggagaattcgattttcttcccaaagaaaatcagatttgacttagctccatccattttcacaattgctacggaaacgctgtctctgtgaggacaaaagaactaaacgaaggactttcagtgggggaatgagcacgtggacacaactgtgcctcagtgagaatcccttgcagacctgggagagacatctgcaggcagtgggatgcggatcagaagccctgggtccccagagtccaatgatgaggagacccggagggaaggaattggcttgaagtagggctgtctcgggggtgagcatttctcccgcagccccacacccagcagctctgagagaagccagagcctcctgatgcacctggcatgacactgggacaaaggcaatccattatgtgactggtatatcagagtcacagaggggctgggtgcagcagggtaaagaggctgcaaggtcacagatggacaaggtgtggctgtcacagctgtggtggctggccccatgaaataattgggacaccaggaggggcagggtcagaggacctctaaatagctctgtagtcttgggtgagtcacttgaagcccccaagcctcagctttcccatctgcagaccagggagaaatatcacctacctggtggggtgtcctggggctcagtgttctcccgtggcatgctgcacatgcctctactgtgcatgagagtgtgtgtcccacctcccaccgtgttaaagcatgttgaccatgggtgtgctttcccacaggagtgtaggcttccagagcaggaaggggtgcgtcttactcactgctttattcccagggccaagcaccctgcctggcccctgcggagctcagggtgtctgatcacctgagtgagatgatgttggttagagtgcttgccacctgctgcacacaggaattagcttccaggctgaagtggggccagtgtagggcccacaggaacctggaccaccttgactctttgtatagggaggggaaaggaggcaggagaagccctgagtacttgtcagtggagtgaagcctgttaagctttaagcgggaggattcagttcagtaagtaacttcgtcccctgggagggcccccaggtcccttctgtgttggctccatggcctctcttctctcctgcattaattcaagtgaggaaggcctgagcttgcctccctgaattccctgcaccccacagacgctgccccattctcaaggtgccatgtgtaatcaggaagcagacgctagctccaaagctttcggggcagagggaggagggcaatggctgggcagtgggctgtcctgttgctgaggagaccttgaggaggaggcttttggggcaggcatgcctgttgcaggcttggagtgggccctggggaggggcagtaccctctaggccagaaaacacaactgggccatcttccctcatctctagcagaatggctgcctccttagtccagactgagtcctgtggaatgtgtggttggagcaaaaagatgaagagtgagtctaagaggtcatgaagaaggacagacccagtagactgtggctcagcctttcttgggaagcagacttctaagaaacaagcacgctggcttaacaacaaatctaattcttttagggaaaagaggtagtgcatggataaaatgtggaaagatatagaagaagaaacaggaagtggagcctggtgaggaacaaaaggtgtcacaaggctcattttagggacatattgcaggagagacaggaaattgaaattggcgccattcttctagattgcccagagtcctccagagtcacagggggagtcaaagggtcaataggtgcttctcctttgcagcctcagggagtgattacctgcaatatgccagggtactgtccctgtaaacaatgaggctggaaggcaagaaaggagcagctccctggcattttgctgctggagcacggaagcagtgctggccaggagctcacaggtgggtgtgaacctggggaccctccgtagatactcatggggccccgggcactccactggacaggtgaaaagctcacagctcagggtcccctgctattttatgagcttgggaggtttctgtgtccagaagcacaatggagggagcccctgatcataatcactaagagcacaccatgtttgctgcttttaactgtttccaaatccttctagttcataggctcctctgctcctaaaccagtcctttgaggtatctggcagacagttttctgcccttcccttccttgacatttctgtgacatttggctctgtgacggcttccttcttcaggaaactcttttgttgtcttatttctgggacaccctcctccggagtttccattccctctcagtccccgtcctgactctcattcctgtccccagccacttaaatgttgatgtccctaggttctatccccagccgtcttctcattcagaattcccctcctcaaagtagattcatcactcccagagacatttacatcacgtctccacttagcccttggccctggctctcagccccgcagaacccactgccgactagccccatccacatgggggcccacaggccccttgagtgtgacacgtccaaatgagttactcaccttctcctccctcttctcatcatctctgcaccatcaacatcccctaattgtccaccagaaatcagggaacaatcctggcctccaccctctcctcaccctatacgtctggtcaatcatgccttcctctcaacctgactcctacaggtatcttcaacctgtgcccattctcgcagctctgagcttattccatactacataagtttgcttagactggtggttctccaccatgggtgatttttgtcttccccacctaggggacatttggcaacgtccagggacaatttctgatggtcacaacgaagtggttgctactagcatcaagtgggtagaggccagggatggagctgaacacgatacaatgcaccaggcggcccctgcaaccaagaaccaaaatggcggtagtccccaggtaaagaaaacctggcttacaacatgcaatacttttctttttctttttttttgtttttgagattgagtcttgctctgtcacccaggctggagtgcagtggtgccatctcggctcactgcaacctccgcctcccaggttcacgccattctcctgcctcagcctcccgagtagctgggactacaggcacctgccaccacgcctggctaatttttttatatttttagtagagatggggtttcactgtgttaggcaggatggtctccatctcctgacctcgtgatccacccgtctcggcctcccaaagtgctgggattacaggcgtgagccaccgcgcccagccaacatgcaatacttttctaactggtgtctctgacaatcaggttccccttcaagccactctctttgctgcctcctgcgagaatgcttagcttacaaatgaatctgtctgcatgtctccatttcctaacttctcagcatagtttacaaagctccctatgatctggccctgcccaactctccagacccaccttccatttctcctgttagtccatgccccagcagtactagataatctgccgttctctgagtaaatcatgttcttccatacctctgggccactgcctaggtctcaaatgaccctatcccagggtccatcccgctgtgtccactgtttgcattgggtcagagcttacttagtccttcaagactcagcccgaataccatttcctggacaaagctttctcttggctatgcttctaccacagcttgtacgtattctcatgtctacctttcacatttctctttctgcagtcttcttgaggtcacagatgtgattttatttatctttacagacccaatgcctagcgccatgtctggtgagtgaatgcacacaggaagaaagctttgccaaaatttgcacacctcgttgctggaaggactaggactggcattcaggtctttggactcccaagctatgctcacctcatcagacctgatggctctaagtaggtcagttttaggtcctgagctacttgatccatctggctcccagttagagaacaacaagaaactaatcacatgtggtggctgctgcctccgtaagtgcttccatttattcacaagctgaaagacaaaagcttggccccccagcatatgctggatcaaaagcaaggaacaaaaaggattgtaaaagaaagacgctggaaatagtagctactttgatgcaggcagctctttgaggaagcagctgaggactgtgcccccagcagcaaagagagagagaagtcactgccagagggtgaaggaaatcactgcaggaagggtgggacctcactggcttctctgctggtttccagcgagtgccaggaatgggggaggggtgtctcattaatctcacctccttgctgccctgcctggggtctttacaatctgctccatttggagactaaggattcctacaggaatggcaatctgagccagagatttaggaaggaggtttataagtaatggctagagcgatagagtaattaataggaaactattattaacaatacagtgatttcataatgattccgcagtttataatacaaatgtatacatcatttgatgaattattgtattgagcccgaggatgcaggaatggccagattctgtccttgaaatagccaccccttctcatgaggacccctgagaaaatatagtaagcacacaaagaaaggaaagcaaagcaatgcttcattgttagctggacttgtgatcaaaaccctagcgctctctggtcaactggactagatgacgttttctactaagcaagttaggactaaacagctcataacaacagccaatccaatatacctgcttgtctcgggaaagtgtagtcagctgcagagagacagtgagagagtgactgtttcctttgaattcctgctctctggagttgacttgggcagcctggctctgaaccaggacaccatctctgggttggtggccatctgagaaaacatggagaaaagacactttgaggaaggtaacctcgtaatgctgagaggaagcttatgcccaaggagactccaaggagaatttgggatctaaccccagagcactgcagagtggaaaaggccagggggaaccccttatcttaccagaaaaccaagcaaaggagatagcaagaggctggactgaagttaaagaataatgcttaagtgtcttgtttgggactcaaagggcttgccctcccattgtattcacagatacagcaaaagactttggtgaaatgcaatgtggaaggaggaagattggttcccattgtgaataaggaaaaaatgagtcctggggttctgaaggcagcttgagatattttgagcatttcacctctgaagtaagagtgcaaccctccaattcaaaagtgtaatttctagtccctttgttgaaaagtcagttatgaaactttacagtttcacttttggctttcggctgaacttttcagagcctttaaggcaaggtgggtaagtatttttagagatggtaacgaggcctgggggctatgcacacagctggagctcagcagatgtctcagaggagaaagatgagaacctcagtcatggtcaagacccctctccgaatggcttctcatccctcagacccacaagagaggtgcatcgtaagctcaagacacctgagacaccttaattctcttccccagccctctctctgtcccttgaaaggatgcaatgcgctggggagatgaaaccagtttgcatcttaggaaggatctggattgttttccttctttctctgagctgtcacttgctataaaagcgatcattgatattcagccattatgccattatacttccataatcattaatattcttaaaaggctcttgaaacacatttatacaaggctacatgatcagttcctacatttactttcaatttaaataacagttttagccagggttttgatgtgctgtttactttaattaccatcctgcccctttctgtgtcttgacacagtgtcatttaatattttatgaatttcccttagccctttttttccctgatatgtgtgatttgaacgggttgctgcttttttagaaaaaaatttgtagttttaacttttctgagacttgctgtaaacaagatgtgtcatgcctatggattctcttcccccagtgataatgggaggaaataaataaaacagcagacagctgctttacccagatggcacagggatgccagggggttctggccctgctgcaggcacagagtgacaggccagcaacttcaggtgaggtgggaagcagcccagaagaggtcagcgtctgcctctcaaggtgtgggctgtcagcatgaggatcacctgggagccccactccagaactactgaggcagaagctgcattagaacaagatccctaggtggtttgtttgaacactggagtttgggaagcactgcactaatggaaatcaattagtggatgtaaagaaaataggcatttcacggctgttctctcccaagtcccatgctttcatcagaaaaaaagctctacttttgggatctatggcaggttcttggggtcatttataaataagtgctatactttaaatactgtgttcatgatctgcttcaagatttccccctctgttttttcagtgatccatttgtttacttaagaaatatttggccaggcgcggtggctcatgcatgtaatcccagcactttgcgtggctgaggtgggtggatcacctgaggtcaggagttcgagaccagcctgaccaacatggagaaaccctgtctctacgaaaaatacaaaatcagctgggcatggcagcgcgtgcctgtaatcccagctacttgggaggctgagacaagagaatcacttgaacctgggaagcggaggttgcagtgagccgagatgtcattgcactccagcctgggcaacaagagtgaaactctgtctcaaaagaaaaaaaaaaagaaatttagtattctatgtactaggaattacagaaagtgataaaggagactgtgtgatatggtcagtaacagagtgtgtcaaagtgctaaggaatcacagtggtggagactgatgagcaggtcagagaagttttcgttggaggggtactttctgaacgattcttgaagaatgaatgggagttaggggtggttggggaggacagtgttaattgtggcaggatggggtttgtggttggaacggtgctgtcttctggtccagctgtgcctggctccgaccaagggcagggtcaatgtgcactgcctgcagcaagcatagcagtttggcagggaggctcataacggggcgtttacccatcctcagaaagcaagggctttcctatgggactgttgttggctgctgcctgatggaggaacatgcactggaactcggggctaggaggttacatgcaaactcagttctactaattgctagttggggcctttgatgacaccttttatgtctctgtaaaagttgtaaaatgtgcttctgtgagggctagatgagataaaacccatgacagaaactggcagtcggtagtaacattagctgggtctgaacgtgaatccacgtttgacgagtacgggaaggaataatagcaaagacaaggagaataagcccaggtaagcatctctgggatcctagaacaacagagaccattgcatgaccaactggggagacagagaaagagagcttccaccggccccatttcccacctcctccacctactctttgttgacacttaatatagaaactaggcctgtaactggcgacagatcaatacttccactgaagaataaaacctctcatggggcagcccagaccagggatatgatctcaataatgtgcgtcggggaattggggcttattggagaaggtggctttggaggtaacaggcagctgtcaggccccagaaaatggaaaagaagtggatatcaaaacctgtaactctggtttagggacagatattatttccttgtctctttctgtaggaactgaagtcaattgccctttaggcagaaccaaaccaaagaggagacataaactcattttgagtgaacaaatccagctaaaaattactttctcattgcttcctttctcagatacggcatttatcatgggtaacagatgaatggataatcttaatttaaaggcaaaaataagggggatccttcctgatactgaaggtacaaaataaacatcccagtatttccaggcccccaccttccaggcattggcaattcagcagaggtctgggtttattctccagttattactgcatttatgaatcctcaattagtcctgactttgcttgagagtttttatgaaactgcctagcgtagtgcctagcagagagtacatgttgaatacatttattagtttctttctttccatagctactgctgctggctaccttgcatttctgtggatttggtcacaagagggattgtctagagagaacagatggtctggtttactttcaattgtagtcacagcaataatagcaccatttatggggccatacactatacgctagaagttttacacacatttcctcatttaatactcttgtgaaatgtgcactatcatctccattttgcagataagcaaaccgaggctcagagaagtgaaatcatttgacaagtcatacacagctaaaacgtagatgccagagccaggatttgatgagaggtccccgtgacatttcaacccaagctgtttttggtgttcatatcactttctaaacagagaactggagagctggaaggaccctcagagatcatctgggccggtggttctcacctgggggcgattttgtccccaggggacatttgagaacatctgaagatattttcggttgttacaactaagtgggggagtaggggtacctgctcctggcctccagtgaggagcccagggtgctgctaaccactctgcaatgcacaggccagcccccatgacaaggattatcctacccaaaacgtcattcgtgctgaggttgagaaaccctggtctagaccaatctcctgattttacagataagaaaacccgggtgtgggtaaggttaaaggtcatgctaatgtccatggacaaaggctgctgggaatcaccatacatcccccacagtcctcccccaccctgtgctgcccaggaaaaagagctcaaagggagtgccccagactggctgtcacaagcatggtgtggaaaggtcctacttagttttccagggagccagcaattggttacatcagaaaactttattctcaggggcagtgcccttatttagatttcagggaaaagcaaaaacagctaaagttttctcaaatagtaagtttcccaatttgctccggttgataattttctaatgtagattcagtggaatctgcctgagagggtgctgagtggggatgtgcttgccaaggggaaaatgaatgtgtcccctgattggaggccggcttgtcagacaactgtgactgtcagcacactgggctggggcctggcctcaggaagggagtggggaggagcagggatggggcctggggctcaggaagggggcagggaggagcagggatgcaccttcagggcagagagggtgctggtggatcccagctccaaagcacagagacggcacaaggcacagtgggcagggagagggcggaggagggagtgaactgtcccccctcctctgtcatgcctgcatcactgcccgggcagtctccacagtcctgggggcctggggaaggagtggaggggacagacgatggtctcctgagtcacaccgccccatggattctggggaaggatctgggcaaatctgcagcagctcggagtctcagtttgtttccctgctggtacgacgatggcagtaatacccgtgctggataaagtgagagactctcgagacacacagtacatgcctgcctcttccccagctcggaattctccagtagaggggggcatttttagacacagtgagctagaggaggcttttttcggtttcttaattctaaatgtttaattattataggcacctaatagttgtatatatttatggggtacctgtgatgttttgacacaagtatacaacatgtaatggtcaaatcgggataactggtatccatcaactcaagcatttattatttctttgtgttagaaacattccaattctactcttttagttatttaaaaatatacactaaaatactgttaactacagtcaccctgtggtactactgactattagatcttattcttctatttaactgtatttttgtccttcctcattaaccatcccactttatctctcccttcccactacccttcccagcttctggtaaccatcattctccttagtgagggctgctgtttgcagaatgttggccagggcaggagaatgtaaatacacgagtatacctagaccttccgatatgccagctgccaagcatgtgccaccaacatctaagcccaggaacaaaatccgacgcattttcattcataggggaatgaaattaattaattaattttgaattaatcataggggagtagcctccaacagcccctgttgccccctccacccctgtcttgccttatctggtccttttcctttgagcaggtgagcgctctcttgcttcctcactcagagattcccagtcacgggctgcagctggaagtgggtttcacagaaggtcccaggctggcctcacctgatatgctctgtgtggacttcacttgagtcctcagtgccaaaggcaggactgtatgtgatgcggggtttgcacagagcactaatggagtccgttagtattcagactgagtttcctattttttttccccctaggagtgcaacactgtggttcaatatttgctgggtggtaattaatagcacttaatctgtaaatctggagctggtttctcatctgctgagaaatgaggttaccatagccaccccatgtttggctccttctctccttttcccttcccagaaatgtccttttgtgtttttctcagccctagcagggctcacgacaagaaggctaaaagcacccagagagatttgctgctgcattagcaggcagctacctgaaagaaaagtttatgaagacgagaagaaatgggcttccacccacctcggaggcctgatgtgctgtcacaccagacaatcctcacaggcagaggagtctcttattcttccacacagggtcctaaacaaagcatcttcggtgatcaaactatgatttttttgactgcctactgtgttccaggtggctcagatatatattatctaattctcataacactacaacaatcttgaaaggcgggtatatatgatacaaacggtacaaatgaagaaactggctttcagagagaccaagtaacttgctcaaggccacacagctagaaattagcaggatggaaactccaatccagactgttctggctccaaagccaaacccttccacccgttccgtgctattgttggagatgtgaattccactgatgtgaatttctagccttctgcatatgacttgcccacagagcattaggtgatacttatagtattaattcgactgccttttggcatggttatggggcttctctgcaaattgcttcatcctcctctgcataacacccttgtgtaggaggctgggtagacattactaaattactttcactttacagatggagacactgaggccctgagacatgaagggatctgggtaaagcaaaacagctcttgagtagtatttgctctgtcagtcagtgtgccaggtgcaggtagcgtcatgtgccctacctgggtcttaaggaatgatgagatccaggcagctggtgctgacagtggcctgttcatactcttcctgaaggtatgtcacctggctttgtatgacagcatgttaacaacatctgtaatttgggcaggagtgaggagaaggaaaccacagttaaggtatgtgtggaggtactatgcaggcaaaccagcccacaagggatgctctggtcactggtgcagatgatggaaaacacctaaaggagaaccgtagccaacactgcaaatcaggcagcatgtatcagagtttaaaaacctcagggagttttgggccagcaaataaaatgtgctccattttgccagagctgaggggattgggcaagaaggagcacttagaattttgacactgcactttgatcagtttgacgggtttagtattatagaaatatttcattgtttcagcagagatgaggaaatctaatcatccatacagctgcactctgaatttgtcatgactcactggagggtagggtgtatggagggagggggcagagaaagaaaggaagaaagaaagaaacagctgatttaaaatgcagtttaacctgaggtaatttggcccattagttcaaattgtgtttttttcttccctccttcttttatttaagtcattgctctattttcaagatattattttttagaggtggcatctaattatgttttctctccacattcattttgagcaggtaataaaggctatagtgggggagttctacggtgattaatggaagaaaatgcagatggggctgaattgaagcaacagcatagaatatgattttataaacaggatagaaagaaattaaagtgctgcattgctaaactcagtggagatggtattcattctgtgtttggtgctgcagtagtggtctggaattgtctgcagaaaagtctttctggatataccagaccagcctttggtgtcactaggtcctctgacttgagtgtgacacaaaagccccccactcacagatccctctcctacccaggagacatgttccttatatttgtgatgtattcctatgggcaaagtatcgctctagcccagcatccccttttgtcttgagagggaaggccaataagataataatcccttagcttgactgtggctccaagggggaggtgctagtagaggggctctagtagggtgtcttgatggggcacaggggatggggctagggacagggagcacaaaaatggcctgaaagataaatttgtatttttgcattgctgggctaaaatatatcctttccttgttgggagcagagagggtaatccttgttagatttacattaaaatgaggtcgtgcttcttggaaaaagccactcactgagaaagaagatatccattgttccatgagagtcccccatggtagagtgagtgacaaggttcttggaaatatcatcagatagtgcttactttggggctgagtgagaataggaaagtggcagaacagggaaaaggttccaccacaaggagctcattcctgcagacccggaatggaaaaccatctcctggcattacataacacaggccaactctctcttcttaacaacaggaagaggcaattcaggtcaaagacagactctcctttcctatgcagagggctcttgtcactttgttaatttctttgtttgtgcttcaccttctgttctccatttccacttttcccactcccttggagcacagatccaagttttaatccagatgcccataatgctgctcacccatcacctacctgtgatatggatattaatatgcatataattttaatgatacagtctttatggtctttcaattcccttacttaatacttactatttctgtgtttgttcatagtctgttggctcccgtggggccagcacaatgactcttgcaggtctctgtaattcatacggagccagacactgaactccaccttcagatatcccatgcccatgtgttgagggtgacaaggaatgatttctttcatctaaccagagttcaacaaatgcgtcttgatcttcaaagaaaacacctgagagtccacaacaagggccataggatgaatgggaacttttagtacatcggagagtttaaaaagcacataggggaatataagttgaaaagggatattcggcaacaaatcagactcttgtgcatagaaaggagagatccctaagtggagaggatgtgaaaaattcagaatgtggggctttgctcatggagattgtagttcagtaggtcagggttagaagtccagaatcttctcctcaggcaattctaatgcagctaacatttgggaaccactgaggtcttggatggctcccaaatgaagaaactgaagcctaggaaagttcaatggctcatccaatgccatacggctaggtgagagggggagagtgagactaccattccattgctcttttcattaaccttaactccaccactcagcatttcactagcagagaatgttggtctgggggtaccaggaggttgaatggaggacgcttgtgctaagaagggagaactatttagaacacatgtgaaactctatttacaccaagctttaaattgaacttcccatttcccagtttcagcttccagaatgcaaccttaatcttgttcatttgcataagctttaaaataagcctttagaacaaatgtaaatggatcttcaaagaacaatattatgatgggttcagtgtaaatgactcaaaaacatatggatggcatttcttgaggatttcccagagagtcttgctgtctgtctgtatgcaagggaagtttattatcaaagcaaaactgggggttgggagaagtgtggtattcttaggatagtgtatcctaacctgcttgtggttctaatttattttcatgcctcagtgagctggactgataatatggaatggccaacatgaagcagaagtcaatctcttcgtcaggctgaatgtggctcacagaagcatctcacaccccaggtcataagacacacaacatggatctcagaactggaaagaacaagagattttcccataaagctcccctcaccatgggcatgaggaaaccaaggttcagagagggcaagtgacttgtcaaggtcacatagccagtacatggttgaactgggacatcagcctaggtatgtctaactccgaattttattttctctcaaatatatatcacctagcagctaagaaatcagcagacagtggactttagaaccaggcaggcaaacacagcttcagggtgaggttaggcagctagaacgttattgatcaacaactttgccacatcactggcacattcgttgctgggcaacgtggctcctctctgaagaggcaagaaaaagattctgaagatgatggatctgcattaagcaaaacccaataaccaggcactttcaggtcaaaaacttggtttgctgtggtttggagtttctaggtcagctgcccaggggctgtcccctgctcagcttatctgagatgaggccatcagtgaggacctcctcagagagaagagacaggaaaaccaatttaagattcccttagacagggcagatggagatatgggcttgttttctgcccaatgttagtattgtatcttatcttacagctaggttgaaattagagtagttggcaaacaaacaaacaaacaaacaaaaaaaacagcacaaagagatgacttggggatgggaggtgggtgctgctaaacaggggcaagtcatttactgccatgggcctcagtttccctatttatagaacggtgagcctggactagcttcatgttagtctatctacaggtgctggctggctataataatcacctggaatgtttgttaacctagagactctgaggccccaatttcagctattctgatttaggaggtttgacatgatactcaacaataatttcatccatgctatcagaggtatttactgcatgtctaggagatgttctgggctctgtgttaggtactgggaatataattgtgaatgcatattgaatgcaaagcactatataaggcaaatggggtatttaaatctttaaagaagaattcttgttggacgaatggcagtgtaatattacatatgtgagatttagtcagaattggatttgaatctttacttttctacttactagctgtgtgaccttatttatgcaatttacttaacttctttgatctcatctctaatatggggatatgattacggtgcctacttcataggatggttgattattacatgagataatctggctgagttgctcagcacagttcctggaacatagccaaggctcaccaatggcaaatacacacagattcctggggttttaggagcttgtaggagtgtgtgtggtatgtatatgagtgtgtgtgagacccacagcatgcatgcatgtacagtgtatacgtttctcagaagaaatttagtgatggggagactactatatttctgcttggcttcatcaggatggcctcatggaagaggtgacattagatttgggccttagcaatgggcagaattttgataagcagaaaagaagaggagcagaaaatgttccagaaagttgggactagccaaggggcagagggcccaggaaggtggagctgtgcttgggaaagtggtggacaggccattcatggaaggcttccaatggctgaagggccttgggtgccagtcaagggacaaaatggacattggtttgtcttctgaaacacacaactttttttttttttatgggtggaaagcctttgataagcatttgttgaatcaatgactgagatgttgagcaggggagcagccttttctgggaggttcacccgcaggaggtgtgctgaccagagaggatgaaagggaagctggaggcagggaggtcaggactgccatactgtcccagacatgcagaacaggctgctggactagacggggacaaggaaatggagaggtggcgcaggtgcgaaatgtatcttgatggaagcagcaccaagttctggagactgatcaggaagcaggtatggaagaagcagcagagacctcaattttcaaagtgtgtatctggaacaatacagaacagacagagccactaaatggggctgaggaaaagcactcagagcctttccaggctaagccagggctccctggcgtgtgccccatggtgctggcaatagtgtctcgtggaaactaaggacccgatgaacagtactcgtattactattctttataatgctcatgccaatgtcaatgttttgaatgctgccttccctgctagaatataggcttcatgaggcaggtactgtatttgccctgttgcctgctctgtccctgacacaataaattgtgtctgccacatagtaagtgctaaaaaaaaaaaaaaaggtgggaaaagtagctgagaactggtttactgaggaaagaagttgactcactttcagacacattaggttggaggtgatgcgaactgtcttgctggaagtgtccactgggtagttgcatattctggttagaggtccagtttcaagagggagaccctggtcaccactgggcacctccttccacgccaggtatcacctccctgtggccctttccttgagaggatctcatgggacctccttccaaatccatccctagtctcccggccacacatactggtttctcccccgaaaggctctgaatttgagctgtggtgatatctctgtgatacaggatagcctcttttgcctaaagaaaaccactctgaaattgcaggctttcaaatgaagctttgtagtacatgctatagcaattcaaaacggtggagggaggggaagaagtctgaacaattgcttagctcattaaaaacagcatttggttcacatttcaacatctgaaaaaaaaagacaaaatggaattttacaatgtggtcacctgagctaagaaagattagtgaagcaagatcaagatggaaaacaaacaaacaaacaaacaaacaaacagaaaaacaaaaaaaaaaaacaaaacccaaacaaaaccctcagataactggttgcattactgtgaatacttggtacggctacttccagtggctctttatttcccctgtaaatttgaagatactggcatgaaagccaaaacaggagatggggagataagaaaaaaggtattcaggtagtatcaggtggtctaaccactgagcttcacccccttggtgctgtaggtgagagcttagcctgcagtgtctctctggattcttttgatcattcattgcttgaaatgtgggtttccataacttcacaattcacctccaagatgtagactgcatggattcccaaggaaaaggacatctgaaagttccagaggccaggcttggtgttgggcgtttatcaatgtacaagtccctccctgccttactcctgaaaggggcacactagtggttactatgactagctggagcctgcttggcctctgtaacaactgaagctgctggccaccctgccattcctgaagggtttgtgtctctctttcctccttgtcactgtttgcttttgctttctctcctgccactccatctgctttttgttaggtttctttgtggacttctacccaccctttaaatgttggtggtccctgagggtccatagagattttcttaattttgtctacattccttattctctttcacctatccggcaattttgaaaagaaatttctatgtgccagacaccgtcctgggcatttggggatatgaacatgaatgatgggcccttgcctttaatcagcgtgtggtttattaaaggagaaactatgtaaaacaaatacaacaaagtgtgatatgtattgtgcaaggtgtcatggaagtgcagaggagagtgggggtaattccgcttgggacttcaggatcagctttcagcaggaggtggcaatacattgagactccctaattcatttctgtggccatgaccacccctgtcttctgagctccacacttgagtttcagatgacttgccagacatctctactagcatatgctgcggatacatcagactcacaattttcaaaatgaaacctcaacctccttacattgacattgccagccacccagtcacccaatctggaaacctgagcttgattctggtcccccctctccctccctcacctaaccacaccctgatctctatgatcaggtgtatctctatgaaagttctgacctgcctctttctacatgaccacgaggtctgctcaagttcaggccctcgttatctctaacctggagtattacaagtattgcaacccctttccaactctttggtcccaaaccccattgtgcttagcaagaacctgcggagctcctcacacactcacatcctgcagtccctccccttgagattctggttcaggaggaacagcctcacgtggccctgagaggagtggtttgtggaccacactgaggatagacagtgtctctctgcttttagtgtgctctgttctaattagtgctggctgcttccagggtatattctgaagcatagacatgcttctgccatcttggcttaaaaacctccagtggttctgaacatcttcacaaggcattgaagacctttcctaaaatgactggaatcgcctcagctgtgtagctaacttgttttccttccccatcaaatgagcaagttggcctcatagcatagagcttggctcttggcttagtcccaggccagcaggcctcatacctctactctgccctgacaagttgtaaccctcagtaaataacacaatcagtgtatacttacaaaggctgttgtatgaggattaaataaaatactggggatagagctctttgctcattatctagcgtagcgtaagtcctccatactgaaagctagtaccgtcgtcccatgctcttccccattatgtcctctacactccagttatcccagaccatttaccattctctgattaagtcatgcaacctcatcgccactacctgggactgtctttccttaattagaaaactcctattcatccatcaaaggcctgctcacatgttccctctctgcaaagcagtgctctctgtggtcgtggctgtgctcacagaaaaggcactgtatatccctctttcgtggtattaggaacctggtataactgagagcgcatctcccttgagttccttgagactagaaacggttttatttattttggaatctcaaacctagcaaagtgcctgtcacagagtaagcactcagcgccgtgaatgaaggaatggggtgagggaacgactgtgtgcagagagtcatgtgagaacccctgttcccctccctctgcttggcagagctgtcctttgtagaagtgattctcagtggcccttgccccttagcaacctcaggtcaactggaagactcccctccagacaggcgttgcggtctttccctatcccacagggtctagatgcggccttcccaggtgactttctgctctactctttctcagtctccatctgacccgtgcctagcatcgtggcccctgtaaagggctcttccattaataattgcctccctagtgactgatttatctgctccttgaatctgaggaggttcaccttttaaggtgaaaatggccagtcactgaaaagctgaattgtttttatgttattcccgttccagtgacttcagaggtggcccagggcccatcatttgggggcaagaagctgcctggatgctttctggccttctgggtgtgcagacaatctcactgtttcaccagccacttccttttactcccttgcccaggcttcagcggcagaagacagtgtaagccccaggaaactgtgacagcaataaaagaactaaatgttttctaggtcaccgcctgatcaagtccccacttaaacaataatcttgccattgcatctgcaaaaccccagactcaggccccaaaaggttatttcatcaataattcttgagcttgcctacggcgagaattattcccagcaggcgtttcaggccatctctaaacaggctctgtggaggcgaggcctggctccgttcaagtgcttaggcagggaccattaatattgttgaagggcaagggcggggcaggaagggagggaatcgtgtgctgtggcaggaaagaagaggcctctgcgggaagggggcaggggcaggaaggccaaggctgattcggccttggtctggcaagggaagctgcgtttcgtggtaacaaatgaggattaaaccaggccacgtgtgccatccatcgctgtgataaaagcctctctgcccaccgaaactgtgcatgggatccttttgtaatctgtaggcttcagtctatccagtgcctagctactgtgttgttgaaacgagcttctttgatttactcagtgtatttaccaagcaatttgcaagaccaagtaattccttctcagttcattgcctcgtaggtgggagagccgcttaggtcctcttatgtgacctccatccagccttcctgggccttcttagactcctgttcctatcagcttttcatctcctctccctgcagtctccaggtggcagggggttgcgaccaccttccctggagagtctgggcctctgcccagtcactcctctgagccatgaactttttgctattgtgctttccatctcccgctccaagttgacggctatggcaccttgtcctccctgctttggagtcagtgatgaattccctccgttcatttcgactgttttcgtggaggtatttatagaccgtgattgtgttcccgctgagccggatcctttctcaactatataaatttgactctctcgctttctcccgatacgacttatctgctaatccctagaacatttgttggtatttatgtcttgcttggattttctacaccttttctaaattgctccgacttgcgtggttcaagttaccccattcctcggtgctcaatcaaaagagcctcatctccccatcctcgccggtttgctcctggggacatcatctgctgagaaccagaaagatcgtgcaaggggagaggaggttaacagatggctcataattatattacaagagcatctctaaaggaaataggatcatttttcaagtgacttctttaccaaagtcttctgtttcaattcgttctccccaccccagcaaaaagtccctcttaaaaaaaaaaagtcagccattcatcttccgagaagaaaatacaaaagtccacccagtctttacaggggaaaggagacaaatattaaggggtggaggtgaggaaggtgaaagtgactgctgtgatcattttcataaccggaccctcaacatgttcaggctgcctgctgaagctaggaagtccagaatgagatttatcaactctcaaggccacggaagaccctagagattgttgtctaacctcattttctacgtgtggagaccgaatcagggctgtgtagagaaaccagtgcgcgttttgatgccactcattctgggttttcaggtctgctcatctgtttactagaaatgagtggttctggatgaagtttcctgactttactgaacttcagtttagtttcctcatctgtaaaatgcaggctgtgctacttaaatgggggctttttgtggatattgaaaataatggatggaataaataagtgccttgcacatagtaggcacagaatacacaatcattgctactgagtcacagagcagtgaagccacctgcccaaagccactttgtcaaacctggggccagaacttggggcctttatttctcagttcgggacttctactatggtacttccttctccgtagccaccccattgaacacatttctgttccttgaaggtggcatgaggatgttctcaactatggcactctggttgtaaatatgtttgatgctcctacgtgtgggtgctcgaagcccacagtgaagcttcaagtgaggttagccagagaggaacactcttaccctctttagaaacagaagggactggagaggtttggctgagagacttaagaatgtagtatgaacttatcagtgaatgtagcagctaggcttttcttagggcaactgggctgggccagggtcactagcctgagctgtggctagtggtaaagcttctacagaactgtttagtgggaaagaatcaacctgtgttgccaatcattctgctgtgtgatttacaaatgccatctaatttagtggttccccagcttctggttccctgacaccaggaagtaggtataatgtttattattttataggtaaggaagctgagacctagctatatcacatggattgtccaagctaacaaatggtagtgcaaacgttggaactcaggtcctcagtgactgatgctcatatattctttccattttcatgagtactaataaaacacatgatagttatcactttagggatggctttgatttgcagggcacctctccctaaggtgctaaacacatttatagatttttataaatccaattaagtttattatcttaatatgatcttgtctaatttatccatatggatgtgtacacatgtgatttggacaggaaaatcaatttaaatgatttggaccaaatgtattttatcttatgtcaatgctgtggaatttaccagagaattgatgaaacttcatgtcaacagtatagacacactgtcggaatgcatcctgtagcgccacaggactcaggctggatgaacttccccctcagctcattcaatccactcctctaggtctaaaaggaagcaagctgtcttattctgaaaggtcttcaaggacaaccttcctggatgcaccatctccttgtctcacaattcttcacagccagaaagttcttatgcctaagcagaatgtctattgctttgagcgaaccacttttccttctgttccattcttgctggctaaggagaacagctgggaaggtttcaatatctctgttatgaacttgaaagctgttttaaaaacactgctcaagtttctcttctgctagcccaatacacttgattcttttagcattcgtcacagggagagatgattttctacacatccagccatttgttaagagagttacgatgattttggaatgtgagatcttaggggggcaagagtgaccactggttaaaaggctgcacaagtaatcatcgcaatatctgctacaagtggatcctcactaaatattctttttgaggaaaaaaaaaaagaaaatagtgagaactattgctagatcctggtgtctatctgaatatgggaagggaaaaccatagaggagaaaaagagtcaaatgaaagaggctaaatagggaaaaaagatagtccataccccaaaatttgtatttctctgttagccaaggtagtagaatattatcataaaagtgtggagtttatttcttgtttatttttatatttttagagatggggttttgctatgttgaccaggctgatctcaaactcctggcctcaagcgatcctcccatcttgacctcccaaagtgctgggattacaggcatgagccaccatgccaagcttagaatgtagagtttagagtaagaaagaactggcttcaaattccagctctgccttggtgtgtgacttcaactgagttgcttcatctccttgtgtgtcagctttttctttgcaaaataggaacaatgatgatacctgtccctgagttatgaagacggggtaagctaatgtattgaaaggatttcccaggctcagcgtgggttggttgggggggtttcttgaagcattgtagctcccattattctcttaaaccaatagttgtctatgggtcttgggttttgaaactatcattaggaacttcctcacttttggattttgcagattcctttcctgagagttgaaatgatggctttaaaaaatgtcaggattagttgggcatttatgagttcaagggatcctagatgctaactggatgatgagttaattatgtagctatggaattaacattatcattacagtgctaataataataattgcataatagcattattcttacagcggaataagaccactgagtgttgttcttgaaaactgatgcagaattagagaatacttaactctctcaagtttgggtacaatttctaagaatctatagtttagtgactcattggcactctaatgactactattccccccccacccactgcctcccaagattcacatgtgaaagaatgcaaattcaattcctcctgacaaagaaatctaaattcatggattttcccagctgtacccttgagcgagaactttcccaaagtgaagagcatggaaaaaaacaattggttttgcatgtttccttgggaatttcaggaggaaatggagctggaaaggtggtgttggaggcacggaaatgttgatggagaaaagccctcttctttgtataaaacatgtgccctttgttgaaggaagtggtagcaggctgccatgaacccagttttctgagctcttccagaatctcttgtgataatattgctttgttttagctgagaaaccttggggttttatgtgacccatgggtacaaagatcatgatggagacataagccctccacaaatattctaccttcctcaagtcaccatttagggatatggggtgaatgaactcgaggaccagcactcgtccaataaatcctgctctaggaaagacaggagaaacaaataggctaaaagttccccagggcatgaaatcttggtagatgtttgtttgcccgctccttacaccagaggaggcctcaccactcaaagcaacctggctcagagcagacagagcatctggagctgcctcagaggggctccatggcttcctctccaatccacagccagccaggccttccagaaccagacaggagggtgcttcagttactccaaggagccactttgttccatcctgcactactgggatgtagacggcccccttccttagattacttaggaaaaaacaacaagcaaatatcacaattgaaaaagaggcttttggattgcatggtgattttttaaaataaaatgaaataaaagacaattgtgggggacaagagtcttctctccagctctccagatggaatgtctgtgttgattcattgactcaataacaactcaagtgttctattttcttggacagtggagatctagttcagattatattaagatctagggaagggtgacaaatggagtatcaccctataaagcagaggactgagaacctgagcattggatctgagctcctgcctcccatccccagttctccgtatgatgctgggtaaatctcatcaccacctgtctccttacctagaaaatgggaatcatcacatctgttccctcatgaggctccatgcatcttcattacatgcttagagatgattagatagaagggtccacagatcgtattagtcttaactataatggtcttaataaatatgtatgctgcccaagaagggagtgtatggtgttggaatggtttatgtgtcttccttttcagactgggactgggaaatgaggggaatagcctactttgtcactatttatcattcttagttaacaatgtaagatacatgatggctgctaaacaatttggtggcagaacctcataaatgaagtctgttttccctggaaactgcataaccatttgaattaatttaatttgaaatatcaaattaaattaaactgtagaataatccccaagggagagcatatttcatttgcaatgtcttttgatagagtagtccctgccaaaagttttgctttgcatctggctacagatctaaatttattgcattagctttgagaagacttttaatagaaagtgagattaaaagaaaacttgatggaaaataaagatgttcactgctgaaacagcattcctcagaacgtacctctctaactttacactctctatatgtctgtctctggtcttcaattcagaccgtgtaactaggctggatgcctggttgaagggctttcttttgataatgctaattaacatgcacagaaaatatcagaacaaaatgggcagagtctacttggtttaaggcctacaaactgcatgtctttgctagataccgctgaaggggatcgtctgcgaagaaagaatagagatacgagataaattaaagggatcatttttaaagtcaccagggagttcgtgcgcactcagtggtgtcaggtggctgtgttgtcttctttctgagttgtcttctctcttctccttcttaataatctcccgtctaagtgcaggtcttgattaaggctttgggtctacaggttggaaggatagaagctgatggtgaatccaacagtttcctaaaatataggtcaccacaaatcaccacttaggaaatgactggtctctttctccatggccagacattgatgaaaattgtactgagcagctgcctgaaagttgatgcagtgggaataatttatttcttcttcctggtgagcaaatacacagcaagagaggcggatgtgaagaaaagctgtttgcttgacacaaacagggctggccctttaagaaaggtttgtatgagtttaaattgggcccaaggaacccagataagagtatcttaatcaaataaaaaaagcattaggctttaatctccagcactttagtaacctcctagtttgttttaaatcttgattggaagaattatcctgacaagaaaattagtagtaagtcaataagtctgtggcccaaaggtagggcattaagtaaccagagggaaaaaaatgtattcccatccgaggcccttgcctgccctcctgtagccacaaacatagccctgcagacagttccctcttgatcccttgcaccaggctgggtggagaagttcattataattttagccatgaagtcctgaagtgcaggtaatcgtgtttaaaaagatagggaacatgacaggaaaagaacccagcttcatgaagaaattctaattttcagcagtcatgggtggaaaatcaatactactctgatgcgaaatgagaaccggactggataaagccacctcttcccattgctctctttaaaaaagacacacaccagaaagtaaaaaaacaaaacaacaacaacaaaagaaaaaacagaaaaaaacaataggcctacaataggaaaggtctgcgtgctgacactctcaacttccctgagtgcctgtacacccccgcccccaattcttgttgccagagagccctcccctggcagcaatctaattccagctctccttgtcagaatgtgtcttcctgccagcttcaagcaactctttccatgccccttctttgcactttttccaccccctcaccactaccctgaatgcgtgctcgccatctgccattcaggcagagagagagagagagagagagagagagagagggagagagggagagagaaaaaacagagagagagagagagagagaagactgagctgagcacccagcacctaattttggaaactcactcgtaatttcaatcacatctaggtgttatcttgatataagaacaggtatcattaattgactagcaatggaatgggagctcttttatactttatgatccattgagagtggcagctttagacatattggaagatttctgttttaatcaccgattatgtatttggccaataaagctcatattgttaacattaatatatacatatttataactcgatgaagccagacataattaagtagaaatgttcgaattaacaatgatgataatcattcaaaataagattcccatgatgtcttccagcagacgactccacccccaacactgccgtgagaattgtatgtgctgagatgttgttcttctcacccttcaaaatgggctgtcaaatttaacaaatggtaaatagaataataatgaatgtcttcattgtgttgtattgaatgtcatctgtattctaaaacctctggtgttggaggaattcttgcagagaaaggggcttccaggagggcttcagtacaaggcccatgccagtatggcaggtcccttagaaggcatgtcttctggatgatcaggccaacagttgaccaggaccaggacagatgtattgttggtctaggcccctggaatgccagtggcgctatctcacatccctggaagagagtggagccatctgctcatcttggcttcagtagttacatgcaacaggttccccaaggaggaggcatgcagctctgaagtcagcagggagacaggggagaagtaaagcctttcttttgggtcaagcagacatctgctctccattccacctccactcccaatgtgccagcacagctttctccttcctttgctttgagcagtgtatactctgaattacgtttgcagtatatccctgcgtccctgccaaattcactggtggggaaaattggtggtattgtgggtaagctgacttgggacagaagtccatttctcgaaggcaccacctgcactcaagacactggtttctttgagtgcctggccagacatatccaccaagactcaggggtctgtcttccaacaaatgcggctccaattctcacatttttatatgccatgttacacacatcatttctgaacctctcagaagcccatgcatttctgagcattggcaatcaagcataaagttctggggcaagctgtgaaatctctgaaatgaaaatcaattccatctccatttcatggagactaatgtggcatttacaacataaacaatcacttctgttagggaggaaaattaaaagctgtgctacataaaggcacaatgtttaaagttctggtggaaatgagcacttggctttgagatgattacaaagggaattggaaaaagaaaataaaaaaaaaaagaaaagagaagaaaagaaaaagccagccccaacaattcagaagtgcagaggtttcataatacaaatttgctatggctgacaccactggcctcagctcagacctctgggagaaaaagaaaatctttgggcatttcctaagcaatgtgggaaaggtatttcaagggcccaggaaagtcacatctatttccttttttgatagtgttaggagacacagacaatttcctatgggaaagggcttgagacctacaggataggcagggggcccagcagttttagggtcccctcaaagtataggtcttttgaatccttgatctggtgacatttttcattatatcaaccttcatttctgtgttgttataatagggctcatgagtgtctatgtgcagaataccaagatttacagattgaaataaaaattaaaggcaagaaaaaaaaagagtctactgttcttttaaaagcctggaaattagctcatattcaccactagctaactaaggaaatctagtcaaggatctccacctctgaagactcagtttccccatctgtacattgagatactagaccatgtgatactagccccaaagggagctgtctctaaaattttgtcattctcttattctgtatgggatggcaaccaaccattcaattggtatcatttgcaagggtggtggggaaaagcataagttgttgccaatcgggaggtgctcatttgcataatgactgattccctaattagccagaaagacttccagtgtcgccatgtaggagcacaccagagttcctgctgtgacgttacttagttgagctctccgatttggctattaagactctcaaagtactagccagccactaaatgacttttcgataaagctgcccaggcaattaagagcattagcataaaggaatctttctcaattagctatttttagagtgggctggaaatgctatcttgcagctttttagaaatttttataacagtattatgtttgttgtattaccagtgtcacatgtgtatttttcattctatttttgttctgcatcaagtaatttgtagtagtactattttgaggggtagttatttgccaaccatttgaagagaagtcaaatgaatttctgataaaggcagccctcgttaattccaatctgagcatgggacagcccagggtatggcttgtatacctatgtcagccagtcatctcatcagacatcttgatttgccttgatcaaagaagcaatttgtgagacattccctcccctctccccaccaaagtgctaatcaccttttcaaggtagaagatagatgggaaacaccgcacaaattgcttgccattgccccaaaatgctaatcacttacgaacatctaaattatgactggagaccttgcatgataaggtaaggaaacagtgtcagtgcatacagaactattatttaccagtgtcaaaaataactatcgcatttgcatagctgtggcgctagatgacaatttctccctcaaaactgcttccgtagcagaaaaagctttgaccgatatgaagtgtggcatactgttatttttttaacccttacaaaatggaatgagacctcttggaattagatgttagagcactgatttgggaaacaggagctacccaagaaaaacaatttaaaatgctttctttgattatatttcctttgggtgcattggttgctgtcttgtgtaagccaacggtctccagagtgggtcatgtacaccccagggagtcatttgacccttctgcatacaggaagaaactattttatttcttaatgctataatgtctactttgtgggtatttttgttgtatcgtttgagacgaagtcttgctctgtcacccaggctggagtgcagcggctcatggtgcgatctcggcttgctgcaacctccacctcctaggttcaaatgattctcctgcctcagcctccggagtagctgggattacaggcacccgccaccatgcctggctaatctttgtatttttagttgagatagggtttcaccatattggccaggttggtctcgaactcctgaccttgtgatctgcctgccttagcctcccaaagtgctgggattacaggcataagccactgtacccggccatgggtatgttttttaatgcatgtcatatattagaaccagagcacgtgtatagaatttacagagaaatgcatatattctggaggtatgctcatagtttttactgatggatgttagtgataaaggaaaaatctgtggagatcattagacaacacgtagcatcgtgctggccaggaagatggcctgcttctaaggagaagtttctagagggacaagctcattagctgtagctacaattatattgttagagaaggtatttccatgacataaagaagcctgcttatgagcactagacataagtatatctaacatcttgcacccatttctattcagacaataatgaaatttactttcctacagttataaatatagtctctcaaagtgaagaatcacagattgaattctttttggggtaggaaaatgcatctagaataagagacacgtcagagaggaagggccaagatgaagaagtcgcaggaaataaaactagtttaacaagcctgagtacctaggcttcctatattaacacagacatcccatgccaaccccagcgcaaccccaggactccctacacagacagaaagacctctgagattgcccaggcaactggttttgatctagcacagttttcttcttatccccactggccctgtcctcttgtctctcattcattcaatcacaaatatttattgggtgtttaggatgtgccagacatagttctggcaatcttgagatttttctttccttcctcctgtctgtctgggggtcacccataggtctccacgcaggaatttcgagaggctgcaaactcatgattcctatttattgttcattgctgccctactgagatacctagatcatcaaatatgtttcaaacagagctctagcagtgggagtagagatgagaactcatagagagaggagccttctatgctcagcctaactgctctctcacttcagaatgtttcacctagttggtcttttcagttcgcatttctgggaacatcaacaaataccccattcatttctgagaagctgcttcatggtcaatcttgagcttattgctggagagatccaaagaaacaccgaagaagagtcagtccctgttctcattgagcttgcacaagagttggaggaattaaatacacacctaagactatacagaagcaccatcacagagcaggacatgggtaagtgggagagctctgttcaggatctattcaggatctgcaggagttgagaggctgttgtgatatactggaagcagtctagaccttgaagtcagaccattatgattccagtctcagctccatcatttatcagctatgtggccttgggcaaaccacttctctctctgagtctcagtttgcttatcaacagaatgggaataataatacctattgataggattgttttaaggattctgtgaaacagccgatgtggaaaaacactttataggctggaaagttgcaatgcacattttaggaattaccattaatggagggtaatctctctggtctggagtggttagagaaggctttattctgttatccactgacaccctccaggacagataccgttaaacataaatgaaagagggaagatgaagcccagttgctctatgcattctttactgctggaccatggaggatatatggaatgggtgtggaggtggctcacttcctcctgcctgcttcttctgaagaatctactagggcttggaatacctgtcttgatcattctgagaagaatggaaacactgggaagatatggtgttggcagggactcgggaccctgcaagacccagtgggaaaggaaaggtggtcaggttgtcaggcccctgcactctgcccaggcaaaggtattcacaaacctccctgggggctcaccagaggggactgtgatgagttggcttctcaggagtttcctactcgctggggcctgtgaggcacagcaacttgcctgcttgtccccagcaaagggcagtgtccagagtccattcttcctgcctcatcactgaggaggagcaagacaaccccagtcccagccctgctcctttctctttcaaggcatggttaacagttgacagtgcaatgtaaatgctgggaagtgtcaagattagtaaacaggaagaggatttggaagctaaatgcatgcctaactcaaaggacagattatatggttacactgttattactttgagacatagttactctttcttctaaggaatcttgtagaaatgtgattatggtgtagtttgtgtatatcaccagatcttatgaagtagaccagtgggccccactcagcccctgggggctagagaagagttatgagctgcactagtttgtcttggttttatcttcattcctatgaactctcttgggaagaagtctccctaggaagctgctccccgctttcaatctcattttctgatatctagttgtgaatttcctataattaaatatagtttgggctgggtgaggtggctcaagcctgtaatcccaacactttgggaggccgaggggggcagatcacctgaggtcaggagttgaagactagcctggccaacatggtgaaaccctatctctactaaaaatacaaaagttagctggggatggtggtgtgcaactggctaccaccagttgcatgttgaggcatgagaatcacggaaccctggaggcagaggttgcagtgagctgaggtcacaacattgcactccagcttgggtgacagagtgagactgtcataaataaataaataaataaataaacaaacaaacaaataaataaagtctggtctcctggttgttcaccttggcttactcatctttccttttgcagatgccctggtgagtgctgttctgaggcaagaccaattgactacaaaaccaggtcaggttaggtacccaaggcagatgtgcaacatttattagaactagtgccaactgagacaaaaattcctagctgttctttaaaatgcattcttctactcttctttagctactgttaaatattagtagaaaataagactgctcagaaaaggcacttcattccccagcctcccttgccgctatgtgatcaagtcttgggcaatgggaggtgagcagaagggctgtgtaaaacttccagatgaagcctttcccatctgtttctcacctccccgttgaccagaatctggtcacagcagtgggagctggagcaacccttgtggactcagaaatggaaatcaggctcttctgtgtacctcctgatgctagtgacagagcaataaggtcttttctggtttcaatgttgttaagttgagcctttgtcacatggccctcaatggagacctttgctctggagatcttcagtggaatacctgagagcgtagactcatgtcacagtctctttcgtcaacctgcttggcaggctatctgtggcttaatgccaagtggggtctcgagcaaaactctattgaatttgggaccatcttttgcaatagcgtctgcaactcacgattgaccccaaatttctcctttgtttcatttccctttggttgtggctgacagctgtggggctgcactctcagaggccacccatcctcagggatcctgggattcaactttgagagcataactaggtaggtagagaggggctatgcccaggagtattgccccaacttccaaacacattcctatcctcgtctggcattgagagaagagtgcaggactgggtttgagagcagattctggctctgttgtcagcaagctgtgtgatcttgaacaactcctcttctccctgagcaaaatgagggggctagatgagacgatttctggaacatctcccaatgtcggcgttctgtgatgtgacaattccatgaccagcctcatggctgaggtgccactttcgatacataaaacaagagtccacatctgtgccaagggctgggcagggcagtgctcctcacttcctccatctgctcagcacccaacagtgctctgatgcagggggagaagagcagggagagggcatgaggatgcagtgggtgggaggtgttaaaaaggggactgatggtggggtccttcttttgagaattctagtctctctggggccacatgacacccgaacacacagaatctgtgggaacaagttacccaagaaatgtgcccaggctgagggaccaaggcccagcgagagtaggtggtaggtaggcaatggccagtggggccagcgcgggtttgaaatctatcttccccatacttgctgcatgaccttcaatgagttcccacgcttttgagcctttgttttctcacttgtgaaatggggacaatagaaacacccctctcaaacgtagggaaagcttgtccacaaagcacttgacacacagtaggcactgagtaaattctagcttccctggtgtcccctctcctttcctactttgaaaacagcagtctgtctcattaagtatcctacttagttttcagttgacattcccactctcttaccttctgccccctgaatttttcctctcttttcctgtatcttttttcccccacaactctgcattcccctccccatccacagcatagttctcccatcattccttctttgtagagggcaaggaaaggtgggttatacagatgcccagtgatatttcagaagctctaattaagtggaagattatgcatgccatttgagttttaaaagacattcagatcagaatgaatgaaatgctaacttttcccctgtctaacccactcacccacataccctggggcaaaatgaaacataactcagtttttcctggaaaggcatcagacagcaggtcgctctggtcaatgggcccacggcagcacccactgtcttggcaaatgtccattctgtcaggcgccctgcctcttgccacctctttcttagctagatacagatggaaaaaaaaaatgacagcattgggctgacacctgcatcgaatggaagctacacatttctgtcctagagataggtggcagtgtggattcagggctgtgtggttcaagatcaacttcgcagagaaacaccgtttccagaagcagtgaggatctttcatcatatgcgcctctgatgctcaacaaccttctttgctgcacccgccgctgcctcatgaggttcctggcagctcttactgcgccagtaacaactggatctcaatccccaaaacaattccctgctcattctatgagttacagtttagttaatctttggttagcacatgcacacgtgggcacgtgcaaactctctcagtgtaggctctgaatgctgcttttatgttattgcacacatgagtggaacatactatccagcttcttagggcctgtgctgtaagcctccggggccatataaacgcggctattttcacagtccaacttcagaactcagaggggcagctctcctttggactaggcctttggcaggagtcctctactctcggcctggatcctcttcaatgaaccacctatgtgtcacttatgtcaatatctcagctctggtttttcaagtgcaagggttatttgctatattttggaaacttttgagggtacaaatagtatacaggtcaaaaagtaaaaggtatcagcttagagaatacaaagcaggcaatcatgacattcctagagatggacaggagaccatttactggagatcagagagtaacaaagagtttctggaatcttcaagccatctatggttgcagaatggtaactgagaagcccctgatggtcaccaaataccctggcccaactataccccgtggctctgccagttctttccattgactaaatatcagtttcctcatctgtaaaatacagaccatgacaatgagcaaccttcttaggtggaaataagatgaatcttgtcaaaattgtcttcaagcttatctacacatgagagtcaaaccctcaccccaacaccacaaagctaagcctctgaggtgtgtgtgcggggagaaatctaaaacgaaaccagcaacccactgccatgcctgctcaaccaaccctcccagagcatacggcttttactcttccttattacaggtgttcataatgctttatctcaacgggtctgtgtctcctgcatttagctgtggaataaacaatgttctgataattgctgggtcaccattatttactactacagttatttttatttaagaaagcccctttccttcgggctccagtaagaaggcaatactataattttcttcactgtctccctttaatgaggtcgaaggccaggcaaagggagtcaggcagttttcggggaagcaaccccgcaacaaagctgacctcagccaggagagtccaacataactcactcctcaggcggattaattgttcctggctcctgcagcctagctgaaaagtgaagaaatgatgacaccaggcactctaactaggttcaagctcaccatttctttttctagttaaatccttccccccaactcccaatttgctacctgggcaaggaagcccctcccttccccccataatcaagtgctctacaatttccactgtaactttatgttacagaatccatcatcagctacctgagcttgggcatgctgggagaatgatcttagctgagcaaattcacctccttgctttgccgtttacttccaaattcccataactcactgcttttgccagccctcctgggatggtatctagtatcgtttcatcgctaatgttgtgagtgagctagaacaatcatctcttaggatgcccacactaactggagtctctacctctctcctcctcccctctcttctccttgtcttcctggccctcagttggctgagaacagtaggagcccataacagacagcatgtcatccattcctgacagccttggtgctataatatggtcctgccaaacccattacagtaatgacagtgttgcagaattagaacactcactcctacgcggagaagaaaaaacttggggagagaggggtagagttagaatcttctgctattttgctttttctctcttttctcctccctaggtatggcattgtcccttttctttctcttttattctattaaaaaggtaagtgagcacacaaccgcgtgttgctaactcggcaaacaggtttccagggcaggtggtggtatcttctgggtcttggggaaccatccaaaagagattattgtgcctcatggtggcgccagtagtatcattccattaccatttcctcaaatggggagtgtacacacggaagttcttttctggggctttgataatctcaataggcacttacagaattgacttttctgccttggcctgggggaggcgggtgttgtaaaacttaatgatcatctttctgactggggatcataaagtgctgttgataattgtgatagttaaagtgatttgcttacagtaattagttcctagggctcccttgtggaggtaagagaaagagattgctctgtcttgcataggggcaaagtgaggcacagagggctggggtctattacaaagagctagtcatgtttgaccacaagagcctggtctaggcacatagattagagactctgcattgaggagggggtacttggtggctctttgtgggtaagagggcattcaacatgagaggtacagggctgatttaatgtgacaaagagatatgcctggcccagagggccccagagctccttctgagtgtgaaagcatatcagtgcaaagactgggagacaaaaggaccagtagtttacactaatacacaagaagagagcaagcctgggaatcagcctccaacccagtgcttttcctacctgacatcccgcccaagggtcagaggagctcttggaaaggcggagggtgttttctaccaaatctgacaggagggagctggtagcatgcttgggacaagaggcagaactcatgtcagtggtgatcaagctatagaaacctgagggagacccccaccctgagctcttgcctcagttgtggctgagtcagcttctgggacagacactcccagggactcctaaagctgggaatgtagacaactaattccagggcagcagggaacagcggaaagagccctgagtgttagttttgaaccctggccctgttgcttgttggctgtgtataatgatatacactgtgtataacgacatacactgtatagaccactgtagggaccaaatatgtgaagcaccttgcccagggttcaggtcattgtagtgctgatacatgttagtttccttccttttactcttttaaggaatcccctcagacattaaatcagtcagcggatatctattgagaatgtacgtatgttcagcctgatgctagagacggctgaaaggggaaacttgccataagaacccagcaaaataatggacattgaaacactgcatagaattcgctgcaagaatttgttaatgctatgtggctgacaatttgattggtgagataaggttcaggcataagaaattgtcagaagccagtgcaaggcaagagataatcaaatgctaaattgtctggtaggaatgacaatttctctaatgtccccatcagctaccatagggtgaagtccaaataatcttcatgacatccaaagccctgtgttctgcttctgaaatgtctctccatcctcaaaattttatgattcctcttatcagccatttctggcaactgtcattcattatttcatccatctgtccatccatctgtctatccatctatccatccatccatccatccatccatccatccatccaatccatccatccatccatccatccatccatccatccatccatccatccatccattcaatctgtccatctgtccatccatacatgcatccacccatccatccatccattcatccatccatccatccatccatccaatctgtccatctgtccatccatactgcatccatccatccacttatcccacaaatactgagtgctcattgtatgcaggcactgcatgtcccaggtctggaaatgcctatgaatcagtcaggcaggccaaggatcttatgaacttggtttatgagatccttggtttagtgtgtgttgaagagacagacaataaaaagactagacatacacaagacagattccaacagtcagaagtgcaaggaagaaagaaaaacaggggcatgagctagacagggactggaggtgggttggaggactactttggatggggtagtcaggatggactcttggaggatgtgacctttgggctaagacctgcacaggagagcccatccctcaaaatgagaaagagagttccaagcagctggaagagcaagtgcaaaggtcctaaggtgagaatgacccaggtgccttcaggaatagaaggaaggtcactgtggctaagcttgatggtcctggggaaaggaggtatggcaggatgtctgagcagtcggcggagaccagacatagagctccatggagcacgagagccatggcaagaaggcgatgttgcttcccacatgcgtgggagccggtgaagtgttgtaagcagagaagtaacatgatctgctttgtgtctcaacatctttttacatgatcacgacttgcagtttcccaaatacacatttccgcagcacatttccatgcctctgcataggctgtcccctggggtctcctttccgcatcttgtttacctgtcagactcctcggggcctttgagctctaagtcaggtatctcttcctctgtgaggcttcccctcttcccacaggtcccatctctgccagtcactgctttcccttcctcctacgctttcaacacatctctaatatggcacacggtgtaatacattgccattacctgcttatgtgtcctccctagcgagtagcctgcaacatggtaggggcttaatagatttgataagggccggtagtcagggtaggctctgtggaagcaaatcttgaaggatggatagaattttggtgataaagagaggccagagtctcacaaatcctgcaatatctgtccaagtcaacatgagacattattggatagatattgccatcaagaagaggggcccactccccgtgaaaaccgtgcactcctgtcttctctctaacagttaatgagaacgataggtattgatttgcatatgatattcatgcattttgcatattttcatttaccactgaatgcatggacagagttctcaatcctgtctttcaagccttctttccttcatttagcaacttttaattaaatgatttctgaatatcctgcacaatgctaggccctgtgaaggacaagcaagcagacatttgtccttggtgagctcacatcttatagcttccaggggcaaggtggagggtgcagtggtttccagctggggttctggaatcagacgacgcagatatgggtctgaatattggccctgatgaggtgtagaatcttgtgcaacctgctcaatctctctgagtcttgatttcctcatttataagataaaggtaataacacatacccaggggggttggcttggcggagtgttgggcacatagctagagctctgtggatattagctgttgattatagttgtttttcccagatccctgtatgggcggatgtgcagatcccattaaaatatcctggttgggctctgggtaggtgtgtgaagcctcttttctcccgcaattccaagccttctgagtccagctaaactgcagttcaacttagaacaggtactgagcagtccagtgggaagcctgagttgggggggaatttgggggagcctccctgcttcctgcttgtcaagggcccacctccccttgcttcttcagttacaagcagaatctacccgttcacatcctttctcttgtcttgccttaaacatgcctgagagagatcataaattgattttcaccctgacctatagacacccgcaaaagtcttctggttggtccccaagacttctgccccatccctgcccgtcagtcactgttcctgtcactacagtcgcagcgacactgggggtcagtgagtgggttgagagagctcagacaggatgtatggtgtgattcatttgcaccaggggattctgaatagataataattgtctgcaaatggcaattaacagaatctttttaaaaatgccttgatggttgtaaaacggaaggcgaagcacatcgtgcctcttgttgcaagtaattacggaggcggcctgttatgcacaggttttgagtgacctgatatttccactcagacactctgcacagagacactccctcaactccagtctgtgaccctcagacctcatcctcaaagatggcatttgaagaagactcactttgacttcttcctgaagccctttccttggcttcatacggagccccagagcagggaagggaactgaaaatcagcactcattgaagatggaaggggcagaaagaggaaggagcatttacttatttattttcttttgagacagaatctcactctgtcacccaggctggagtggagtggtgcgatctcggctcactgcaaactccacctcccaggttcaagtgattttcctgcctcagcctcccgagtagctgggattacaggtgcttgccaccaggcctggctaatttttgcatttttagtagagatggagttttgccatgttgaccgggctgggattgaactcctgacctcagggtgatccgcttgccttggcatcccaaagtcctgggattacaggcatgagccacttcctctggccagaacgatcatttattaaagagtgttgtataccaagtcttgtgttagctgcttttacaaccattgtctcagtgcgtccctaaatagcctggcaaggaagggaattttattcccttactgtttttttttttaaacagatgaggaaaccgaggcttagagtggttaaatgacctgcttgagtccagttaacagacatgaggtttgaactttgaaatacctgcttacagagcccatattcctttccactctacaatgctccctgcactgtgccctgcctggaatctccttcatggtatttaaagctgttattaattatccatttatctgataatttctttgcatcttttttggctttgctgtacagattggtgcaaaaataatcacaatttttgccattaaaagtaacagcaaaacctgcaattacttttgcaccaaccgaaatagttttaccagggcagggagacactgtctttcacattcagtgctgtattaccagtgctcctcctgatctctatccatgggcagttaataaatatttgctgaatgaatgactggcttctactggtgataatgaatcattggaagtgaccaatacaagattatctaatgatcaaccaacatctttattaaaaaaacgttttcatgtgaagccacagatttggcactggctaatccaggtaggcatgaatggtatcttgcagacatctaccctgaaatagagacctgaagttcatctctgcaattcctttgttgacaggctgagcatgcagcaatagaagacgacgtcctcttgccttggctagatcctaatgccctcgaatgcagtccagctttcctaaatgcctcctctcctcctgctttctgtctgaggtagaggagaggaggcactgtcgggaaaccatgacctttccacctgtcagagctctaaagcactaagaggtgccagctcattctcagggcagaagaaccagtgtagtctctcactaatgtcttagctctggtctgttctagattcctcaacctgagcaggttcatatggttttgctgaattctccaagtgttagttgggagggaggatgcactacaaatcagaaagaacagtgctaagatttggataggggaattgaggaagaatgtcaatattttttgggtcaatgtttgtaagaccagactcttaaattcaaggcagctaagaccggttcagggacagagaacagcaagtgacaggcatgcaggtggaatgccaggctcagcggcaccacgtggtgcggggatggcttataatttgagggagacgtttgggaggaggatgcttcagccgcttggcttctaacagcttttgacaactctgctattctgatgacctgaaatggcatgtgtgtgacatgtgtgtttcacctccggagtcagtcaatgtggctcacagagtgggaagggcagatgagcagaatcaacgtgggcaggaaagagcaaaggcaagtgacaagttgctaactcatgtttgtcaaaaagcatccctctcctggtactcatgcccaccccctaactgcctcagccttgaaagctctggagaggccacaggccagcagggaagtcactgcagcctctgggggtgccatcgtggtgccttctgcttcctcctgccctgaggagtttcttcctctgattccttggttttgagcctttgcccctaatgccagcaccatacctactgcatctggatcttcataatttggccagaaacctgcttggccaacaatctccccagtgattcttacggacatcaggactgaggtcctggggttctgtcatgtggactaaggtaggggtgagcaagctatggaaacatttagtgacatcagtgatcttgtgaaagccactaaaggtatcatggttctccaaagagttcctaaaggaaaagactgttgttgaccaaagccattagctcctaaaatactgggaatgagggaatcttcaaaatcactgcacattaatccattgattttgtaggtctgtgatgattgattttttgtgtcaactttgctgggacatggtgcccagatgttttgtcaaacattctggatgtttctgtgaaggtgtttcaggatgaggttaacactcttgaatcaggggactgagtgaagtcaatacagtgtgggtcggctttgtcccatcagttcagggccagagtagaacaaaaggctggcctcacccgagcaagaaggaactctccagcagacgacctcttgacttgaattgcaatgtggactccttcctgggtctcaggtctgacagccaaccctgcagattttggacttaccagtctccatcgttgtgtgagccagtcccttaaaataaatctgtctttctctatatatcgcttcctgttggttctgtttctctggagaatcctgactaattcaaagccaaagagtgctagagctgggtctagatcctagatcacagagatgtgggaataatgatctccttacagggagcacactagcttctgccataggaagaacatcaagctgtatgtatgtgtgtgtgtgtgtgtttgtgtgtgtgttttcctgtgagctccttggaggctggggcccacatatattatttatctctattattgcagccccaaatactgaatctggcagatagtgtttagtgagtgatgcatagatgaaaagtaaaaacagaatgtgattccaaattatttgaatacttctgggacttttaaaagtgcaaacagcagaacacaccccagggaggtgaggaggttgtgcacttgtccactcttaactcttttttactattgaatatcttatcaaataggaacaaagccagggacagggtaagagtctccggctggagaaaaaagtgatggggtccctggggtaaagtgagtgaacgccaagggctgaaggaaaggagggaggagaaatacctctttgtggctgccactctgttggatacttgcatgtaggagcttgtatttaatcttcatgtcaacataaataagtagagagtaaagctttttttttttttttttttaaataaatgaattgggataggaagtagagaagagggttaaggaaaagggctctaaaacctaactctaaccctgcaggaaaataggccctaggaagaaacccctcattgccgaagaagggggaaagaactccgagtccactgtggaggccacctctgtaccctctagtaggtgcctagagcttgcacactggttcccccgtggcaggagagtggggcctccttggcctttgactttgttctcagataaacaaacaaagagctatgggtgagatctggtttgactttaatggaattttgctttggtcatccacgctctgggctacctggacccaggacagtgtgcatgccttcacccaggcctggagcagcttgagcgtgcagtatgcaaacggtggggctgagcgtgggtttggcctgcacgctctgcacccaaacgctgcatttacatgagctgtgccttccccagggcagaggagaaaaggggctctcatcaagttctctcaggtccagctgaaaaaaactctcctttggacaactaagcccatgggctgggttggtttctccagggcagggctctcttggagacagagacgctgacccatcttctgaaccaattggatctgcatcctaaatggcaaccaagctgacagcctggatcctgctgagcccagcttcatattccctcaagcttctatttttaaagttgctgctcctgctcctgtctgctctgtaacaagtcttggacattgcctataagctgctccaccccacagcactccaggatgaacccctgctgtacctgagagctcctagatgcagtctgtcttaagaaaataataacagacttccctaatatgcaactggtaaccagttgtctgctaggctttagttttcccgagcagctggggcaaatacccaacaaataccgaactccccaggtcccagaacagtttccccttcttagacttcattgcctttcacctcccagtttatctgtaaaagaatatgccagccatgggaggcaacatgaggagctgtgtgccagatatgctcacttaaggagttgatcgatttaaaaaattcaggtagaggcattggaagctggttcctgacagcaaaaagaaattctccccagtcccactgagttaaacaccaggctgcatatttttcctgccaggatggacacttccaataaagcaaattttgcggaggagatgcaggctggtaactccttgaagggggtgcccatcttgactccctgtgagataaatataagtcccaggacagtgttactctcctttcatccccgtgacgacaggcttggccttatttgtgaccctcctttccagctcccccagttcatctttctaaatgagtctgaacagcccagttcagggcctgcctgactcactcgctgctgggtctttagggcctattagcattcccggtgcatagtaggtgctcaagaaatactccctaagaaaagaatgcctttgatgtaccacatactgggaattatcttatgtatgtgctctttcaatttttattttttagcctgacacagatcttggaggtggaagtgctgttatgtgcattttatagacgagggaattgagctggggtgtggagctggggtttgaattcttatcttctcaatccaagcatgggctcttccacacatcacactggcaatgtccgtgctctttttgcctgaaaaactctgggaaagaggctgccttgagacctctgacccctatggcttgggggaggtacaatggctgaggctgatggacgacagtactttctgcaagctggggctcctggattgggggccacactcctgagacagcagagtgggagcctggggaagctcccccagagggaagtcaggcctggcctggggattgtggggtgaccttcgctgcaggggatccctgagtttctgccagctctgccgggagccctgacctctagaagctggtccaggctggttggcaggtggcttccctcctgtggctgctttcaggggcagccctactctctcttaggctccattcatgctctttgaacagggaggagctggaggacttggaagggaatgtgtgcttccggtggagtttgctgaagtgccatggagggaacactagcctgagagtcaaaacacctgggcttcaggtctgtcttacgcaagtcatgaaacctcactgaaccagtttcccattggtaaatgtgctgatgcctccttctcagggtggctgtgagaatcaaatgaaatgatttgcagcaccatagcagagatatggtgctgcaggacactggctgcagacaggtctctactaggtgtcagagccgtcggtagggttaatgcaggtcccttaagagagattgagtccttctctagcaataagacctagcatgactcaaaagcttgcagaaacactttagttgaacaagtctctgggacaaaccaaggattgtggggtcacagaagtcaactgttaaaaccttgtggtaatccaaagagaacagagggaatgcttatggaacaccaacaccacttcttctttcaccaagtcctctccctgctgctctttcccatgggaagggagcattttcagaggagccctgagagatgggggctcatacccagccagcagtgtcccagctttcctggccctgcctggggtagtccaaatggagtgcaggagaccggtgcccatgggaagcctccaaaagtcttgaaagtttggatttgcaatcacagatgccccatgtggcttcttgagagatgtcaggactgccatttgtgagctgtgttaaacctcagatgtcaggagagaaactctctcctttccacagggtcctggaacagcataaccagtaggactgtagtataggaacgtccagggccaccaaactggacccatcttgcacagtggagtgtattgcttgctaattgctggattgcaatgcctggggatttttttgattatcatgaccgagggatgctattgaatgcagcaaggaaaggccagggaggctgcagacatcctacaatgcacagcatggtcccccacaatcaggaattatctggccccaaatgtcaatacggctgaggtgaagaaaccaacatgtgcaaagcactgggcctggcaggtctagggaacagtgataattcaggtatgaagcaggagcacagagttaatgaaggcaatggcaagagatgaggctgaaaatgtaggttggagccaggcagagaaggatcttggacaccaaatgacaaggttttactcaaaaaaaaccccaaagcattccggggttagttaaaaggccagagcagagctgactcccagcacagggctctttccatcctatcatttggcctctttccccaccatgtgttagacaagacaagaatgattcatggagaacagaactagcagcccaaagcaagtcactttttaccacctacaggataaaatcagacccctttgtgaacacataaaaccacgtagatatttctatcactggtttaccatctgcatctttgaagaggggctaaatcagtgtgaacatctttccatgtccataaatatacttcctcaccatgctgtaactatttatctctagatcagccttcttgttagattgtgggctccttgaagacaggaaccatgttgaatcatcgttgtatacctggtaccttccatggtgatagaaatactgagtccattgagcaggatggctggaaaaatgaagcaataggaaggagcagactagcctgctgcatggttgcaaggactggggacggcttccccctactctcttttcctggtatatgagaaatacatgctcattgtagaaaaaaaaaaaaaaagaaaaactatagacaatccaaaagagcaaaatgaaaattatgccagccccctgacctccccacccagagataaatacatttaacatttcagtggatatcctacaccctttctagggttgtatattcatgagattcacatgcacatattttttctttttaattaaaatgggatcatattatacaccttgttctgtatcttgcttcttcacttaaaaatattttggaaactagtgcaagaggaggccaggggatttgtcttgaagttgtgtttgcgtagcaatcacccatttttatggagactgcatctttgaagaggggctaaatcagtgggaacatctttctatgtccataaatacacttccacaccatagcatttaatgtctacaagctatgcaactgtgaggttgtgctataatgtattaagccaatcctcaattgttggaatttgtattacttttatgtttttgctataacaacaatgctgcggtaaatacccttttactgaaatctttgcacacatcccagatttttccttcgtttgaatttctagaatagaaactgctagaagaacacaaaaatgcatatggtacagcttttgaatggtgtgatcacatggctctccagaaaggtggtaccaacatacattcccgctagtaatgttcagagagtgctatgttagctctttgtgaacaaaagctatcatgcagggcccatgtaaacaccaagataagctatttccattccattcaaggacccatttatataagtccagcatggaaaaactgtcgttcttgttattttatagtctaccaggtaaatgtacgcagttttggtaagatgagctatgcagttgttcacctgtttctgaacacacacacaaggtaatacatgtaagagcacctagcgcggaacttggaacacagcagaaactcaacaaatgccttccatgcccagaattgctgctgtgcttagagccctatcatcccttatctggatggctaaatccagtctcctgtcttggaaactgataagccaatctacatacctgccagagtgaatgatcaaaaatgtaagatggagcatgttgctcccttgcttacacatcttcaggtgctcctcattgtccatacatggaagtctggactccttggtaaggtttggaaggctccatgacattccctgagatcccacagctttatccccgacagatctcacctctcccagctcacccaggtcccagccatgctctcccagtgggccacccagtaagattcagcccttcattcctctgtgacccagcacagggcattctctctccctgaaacctgttgtctcccttcctcccttgtttgtttgcagaattgcctcctgggaaacaattccatatgttgacagccttttctacttgtcccacccaagcaacacaatccttttcttctatattcccagaaaatcttgcccaatcattataacacatctctcattgcactgtaataattgtttttatgtgtatatctccagctaggctgtttagaatcaggacattttaaaatttatgtccatagtctcaacacctggcgtcaatcttaggacacagtaggtgcttaataaatgcttgtcacataaatgaacaaaattataatgtccttcctctcttccttccatttgtctagccattgcagggctctgtccaccgtagttactattggttactaccaagccatcattatgatgccttctcctttttcaagtggtgttccagtttccatgaactgatatacataatacttctgtcttaggatcaagcagaatcagctgaaccaagtgctttgctaccattgggcctttaggaagagacagagctggcagggaaggagagagggtaggtgcatcacgagaggcagagcccacgggagcatctagtggggaaagctcggctgagtctggctctgtggcttcaacagggagccccacgctgtatctggaagggaggactgaacttcagagggaaaagcaggaggcacagtacaggaagacacagaaagggagtaggataggggagatggacatggaagcacaggggagagacaagcggggagaaattcaggttcaatgaaaggaaaacaggaaaagactgcagaaggaagaagataaggaagcaacagaaaccccagctagcgtgggtgtgtggactgcagatgtgtaagagcagcctatcttcttccgagtccactagagaagtgtggcacaggagagagccttagctttttactgaatgtaattaatgacattgtggctttaaataaaaaccagctattcgtggggaagcctgacagggtttcttttaacttaatgtttgctgaaccatcccttctatctcacttacctgatgtggaacatatgctgggatcagaatgacagagaataaatcaccagatttgcttggcttctttgaaaaatgaatttgggggctgagatttctcatcagtatatatcttccccgagcagcctcttgacagaacatcaagcttgggggatgtcccatgcaaaggtaaacgagtacccagaggtgcccagatgcccacatctggcaacagatccatctccttgagacacaagccaggccacctgtgctaggctggcaggtgtatccagggcaggatgtgaaagcctcctgcagtctcaggaataggatacaattgtggtctttacatgaaatcaacaaacatatatggagctttaaatatgcatcaaaaacaccacacagcagggaggcttctcagctttgccactggcaaccatgagcatgccctagtgtcttcatctataaaatgggatgaagctgccttatggcttagtttgttatgagtttcaatctatcatagatgctaaataaaagtttgtattttctccctggatacagctagcagctgcaagagctcccaggcctctgggctgaaacagaggcagggaccaggaagcaattttaactctggaaactttagatgagggtgaaaagggtgggtgtggacgtgcatgtggtgtgagtgtgagtgggggtcacgttttctgggttcttagtctatgtctgcaagactttctaacttggctcctgacctttcactttaatatctgtgtgatgttggacacataatttaatctctctgggtatcagtttcctcatctctacaagggggagatgagttggattgactaccttaaaatttttttcttaacattccttttcaggttacaaaagtcacacatactcgttacagaaagcttagaaaacacatacaaagatataaacaagataatttaaaacacccattattctaccacccaggggaaaccagtgttttggtgtattctgctttctctatgcatggtgtattagagagtgaaatcatactgtgtatacaattttgtttcatgctccctccctttaatgttaaattatcataagcattttatctgtgtcattagaaaattatctggacctcatttttaaggttcctcctcacactaaaattctatgaagaatggggctcatctcctttgctattaaaaacatttattctcttacagcagcagaaatcacattgtggaaggtgcccttgaatggtgcttctaaactcccttcggcccatgcatcacgcaaggacaccaaagggctctgtgggccacccggctcacccactttgatttaccatcttagctctcaagaataaaaggaatgatgttgcttttaaaaaaattgaatatcatcaaaaatgaccttattcattggtagaaataggggccacttatacgatagattttcaaaggtggggttgctgaaaatttccctaaaccttcttttccctgttcccttgactatgaatgcttaaaattccttttaaaacaagaccttttgttacaaagttaagattttaaataaaaaagatttggggaaagttaacacattgactaaaattcacactaggattaaagcagagacaatgcgatgtgctcagcatataatttcctcctcctgggttcacaggaagacaggcattgctcagccttcctaggaattaggttcaggcctgagacttaaaagagtcctgtgtgatctttcagcccctcttccctcccgtccctactctagaggccacgagttcaaaatgataaagctaaaagttgaagagggctgcccgtgcgccttggaatctgataggaataaggaataatgctttgttgtgctaagctgagattttttgatgtttatttgttcctgcagctttgcctggcttattcagactaatacaaagatataactaactgatagcagttccctttgtgagactaggtttgggtattagagaagacgagggagaaagtacaggctcttgaactcagctgggaggaaattcagtttggagaggaggcaggggtgccactagctgatttagcgacttttgtattaattcagaaaagaaattcgtaggtttacaattctatatgctgtacatgtgcactgaaactgaacagttaagtaaatggatggcagatggtgggagccaggcgtttcactgttggagtgggaggttacagataagcaaaaggagggggctagaatgatccagatccacgtggtaatgaattagtgttggagacatcagtatgaacttatatttagcttaatatagatatagatgttatgtatggaaatatttatagctatgtatatgtgagggctaatatacacacagatatttcccagctatatctcctgagaaagcctactagcaacaacattacagtagcaacaagcacacctaacaatccagagtttggtttctgataccactctgtaataaaaggaaccagggctccttgaagaaatggccaattctagcacaggatcaggaaatacacaagatgaactggagcatcttgtagtgccagaaaataaggaagtgctctgtgctagtttcctagagatgtcataacaaataactacaactgggtggctaagagcaacagaaatttattctctcacagttccggagaatgcacgtttaaaaattaaggtgtctgcagagccatgcttcccctgaaacctggaggagagaatccttccttgcattgtcctgttttctggtgatttttggtattccttggcattccttggcttgtagatgtgtccctacaatctctgcctctgtggtgacatggccctcttctctctgtgtgtccctcttctcttcttatgaggacactcactggtcacattggattaagggcttaccttactccagtatgacttcatcctaactagtgacacctgcaatatccctgcttcaaaataaggtcatattctgtggtattgggtgttaggacttcaacatattatatttgaggaggaggacacaatccaacacataacatattctcttccaaaaaagccacactaatgagggtctgtcaaagggacacagaagccaactgaaagagctcccattgaccaaagatggcatgctttagcaacaaaatagtgttggaggataatccaaagcaagtccatactgatgtaaatagatgactgaaggaataaatacagaaataaataaatggaggagaatagatagactccagtgcagaattccaaataattcacgtagatgccttgccctcaaagaagtagagtatagcttcccgctccttaagcgtgggctgcacatagtgacttccttctaaagaatacagtgtgaaagtgagagaaaaagaggagctttgcagtggaggaaactgaccaatactatttcagccaggtgagcaaggttggcagcaacagtgatgtgccatgttgatagcacacacccttgataggatacgatggaaacagcacttgtctttgtggtcttccccctcgacctcagtgtaatcttgaaaagagcatcaaacaaatccccatcgagggacactctgcaagacacctggccagtactccccaaaattgtgaaggtcataaaaaacaaacagaatctgagaagccgtcacagccacgtggaggttaaggagacaagactgctaaatgcaatgtggtatcctggatgagcccctggggcagaaaaaggatattatgtaaaaactaaggaaatgtaaacgaagtatggactttagttcataataatgtatccatactggttcattaattataacaaatgtaccatactaatgcaagatgttaacaataaagaaaactgggtgtggggtatatgggaaccctctgtactattttgcaacttttatgtatgtcaaatctaaaactactctcaagtaaaaaggttagcttttaaaagggcactgctagaataataataataataagtgaacatagcctcatgttagggtacatgacttggttagaggctagtagcctgggtgtcagtctccacttacgtcctcagtcaggtgcccttgtgcagtgaacaacctgtacaaccttggtagtcctacagtcagacttaccctctatcaccattttacttagcgcttatcctgcacctgaacatagtactaattggtgctaggaatgaacatagcctcatgttagggtatctgacttggttagaggctagtagcctgggtgtcagtctccgcttatgtcctcggtcgggtgcccttgtgcagtgaacaacctgtacaaccttggtagtcctacggtcagacttaccctctatcaccattttacttagcgcttgtcctgcatctgaacatagtactaattggtgctagaaataaaagcatagtcaattacatcatagattacagaggatcacctatgactgtcaaggagaaaccccatgaacatccatgatcagtgaattcattgtcaagaagcacttccttccaagcccggagagttacagctctggttccctacctgtgtggaggtagaaaagcccagtgtgttaagggggatagtgttcttatggagaaagtgtcctcaaatcacattttgcctgtgaagatgaagtaggggagaatcttatactaaactctactgaatcctcgtgggggcaagggaatgtggctggtgcgggccgggagagtgatggaaaggagagggattcctccagagttttgtcctcagagagttgttttttgtcatttacacgtggcgtggtgacagcaagccaggtgtctccttatggaaatatcttaatacagcagaaacaagcattttgagttatgcatgccaagtctgacattaattttctccttttcagccttacaaagaaatgcaccagtatgtttcttcccaagactggccccacctcctgcatggtcagagcctcacttgtcccttccttgtccatcacatgccctgtgatatgaagcgttccaggggagtgggaggggcttctcaagaagccttctttctaaggggcaggagagcccaggtgttaccgtctgatgcaatgtaagggtcctattgtgtccctccaaaatataaaacaacactgctgattaaaaagcctatagaaggccaggtgcagtggctcatgcctgtaatcccagcacttcgggaggctgaggtgggcggatcatgaagtcaggagatcaagaccatcatccaacatggtgaaactctgtctctactgaaatacaaaaatttagcagggcatggtggtgcgcacctgtagtcccagctacttaggaggctgaggcaggggaatcgcttgaacccaggaggtggagattgcaatgagccgagattgtgccactgcactccagcctggtgacacagcgagactccgtctcaaaaaaaaaaaaaaaaaaaaaaaaaaaaaagcctacagaatacagttaagctaaaatgtggattagaaagcaatttggcaatgtgtaccagcagtcaaaaaaatgtacatgccctctggtgcagtaagtgatgtcacttttgtcaacctgttccaagaaaataatcctaagcactaaaaaaatctgtgagggtaatagcaaaaacagcctaaacattcaacagttgagaaatggttaaataaatcatggttcatagacttgatggaatattatggaatcattagaatgatcatttatgagaattacataatatgaaaattgcatatgataactatgctaaatgaaaaaaggggaagataaaaatatgagtaaagataattactaccatgttaaaatatgcataagaaaaagactcaaaggaaattcaccgaaatgctaatagtgtttgtattagacaggtgggatttgagttgattcttttttcttttctttggtttccaaattttctagagtgtggtaatattacattataataaaacttttttttaaatgtgttaattcctgtttcctaaagcaattaatagtagaccagcatttcattttatttgtagaaacacataataatggtcatcaataataaaataaccttcataaaaattaatagcattaaaataaacatggcctggaaaaaatagtgtaatggtttcctaacagagacacactgacttcctccaggatcacgtctgggaaactttttcttatcaaaatgactgaagttttgtcatttaggctagttgaggaaaacaggccaactctaggcctgcatgctgctcacagcctggcagcccagtagcaaatgtgctgccaccgggctccttgggctgaaaccatgaagcatgagctggcctggtctgggcatctctgttggtctgcttggagggcactctggatgaagccctcatttgatttcctaacagggctgaagctactggccaggccgttggttgagatggagagtctgcaggaagggaggacagggcatagagctggtctttcctaatgagcagaaggagctgctattcctgcaagcaggggttggaagggagaggcagtggctctcttcacactcccttatctgcagttagaggaaatcttagcagatagagcaatgggttctggcttttgcctgcattaatggcaaggaaagggccagcacaaggggccagttatgtgatcggtaggagtgtgggctgaacataatgttagttcagccagagggccactcacaagagagaacacctgacagaatgatgaaatgatggagccaatcaacccccacacagatgtattttctcttcccctatggcacaaattttcaggactctgatttgcaagacatggaccagaaaaagacagcctgctttatgtgtggggagtttgcacaattaataatataatattgcaagggccagcaatttgatggtatttattattcacataatttaaatcattgccaaatgctaaaaacaatatagtccaccccacccaaatcaatataaacatatcccaaatacacagcagaactttctccatattgtttttcttgacaaagctgaagaagggagacccaacttttcatgcaaacttctggcatcttcttttcatgtttttcactagaggaaaaaagtctggttcttttttcctggaaagataaatttttaatgaatgtaaatgttctttcaattccttggttagatggaagggatggtacagcttggacagccagcctccggaatataattgacttgcttcttgttatttcttttccctttcactacccagtgaagcacaaatgctctcagcttgtgcctttgtttctgagcttgtcataccctcagccagcagatacaggttgccttagaagggaacactcctgatgaattggcctcactgcattgtcttctaacaatggaagcaggtctactctgacatatctgctcttcaccctgcttcttcttggcattcattaagtttgtatttatcaaatatctattatgtgccaggcactcttctattgaatcctcacaactctatgatgtagcttctattatcatcatcacccccattttacaggcagggaagctgaagcacagagaggtcaagtcaattgccccagctgatccatgaccaacttggtagcccggctctggagcccatactcttagccacgacaatattccgcctcccatagcatctaaaatctgctagacattgtgtgcaaaaagagtgggtgatggagttgggcttgggacaaatgcacaatctggaaggaaatcgtttctaaccatctctttttcattcctatggacgttgcctcccagggctgctctccaagccccaattcttttgcatacatttgggcttccacttccacttgctgagatatggtttttcccactgtgctactcagacagggtatgcaagttgcatttgacatttctgcagggtctgtggcccttggttttgagactgagacagggctgtgcttcttcccttgcctcctctgtccatgttctaacaggagctctgcagagtggcaaacactcctgtcaaagaagtccaagggaacagtgcagccacttctcagggtatccacctggagagaagcctgcagcattaagctcacctctgagggctgctttaagaatggaagaaggacctatgttctgccaggctgtgctgcagttgctatgtcttgggttaaaagtctgtttagcctcaccagacccatcatcaccagtcctccacattatagaccacaaaggccctacaattgctatcaaaggaactgattgttttgatctggaagccgtcagagttcaatctggagtcatccaggcagctgcatgttgtattatccgcatcatagggcaaggagagagaaataatagactcttcggtagatttcagttcccaaatcatgacctccatgtgtagaaaatcagcattgtaaataatcattattatcaaagagtgtcatgtattaagcatctactggagtgtgaggctgggcacctagtcaaacaaatccctgtcaagatttctttgacccaacggtgggctgggttgtgcccttccttcctgctcccataaatgtcctctgaatagctctgtcactgcatgcgatgatgctgtaacacaggtgtctgtcttccccatatgaccatgagctctttaggggcatggactactcttcatcacctttgcttccccagtgcctagcagccctggcatacagttggcacgtaatgcaggtgtgctaaatgttcatcttttcttctttctttctcctaaatttagtatttctcatgaccaaagccaacccttgccacgtgcagtgccccatctccttcgccttctcaaggactccctccctcactcagtccctctccttcttgcatctgaagctctttcttccttccctggaccattcccacaaagcagaaagtgagcaaacccatattcaattatccttcactcctgaaatctcccctggacctcacactctgttctggctgccattccacttctctgtatcccctcctagaaaaattggaaaaagttgtctgtacacattgcttccacttcaccttctctcattcactcttgagcctactctttctggtttttactctctggttccaaaaaattgttttgcccttgttaagacccttgccagtctctcaaactgccaaatcttgaggtccctctgtctccatctccccggagttgtaggaagcattccaccacagtggcctagtccaaacttctccagattcatttctcttcaatatggagacagggtaccatgcactctgtggttttctgcccacacttttcttccagccccttcccagtcttcctgttagcttcttcctcttttccactccctaaatatggaatcccgtccttgaactttctctttctgggctgtactctctttcataatctcaattctgaaaaaatatagctgacaattcccatatttataccttcagcccaaacctttacactatatccgactgctaactggcatgtctcataggacctcaaaacgacacagtcctgaacctcttgatgtctcattattctccccacaccacatcctcttctagtcttctctgtcttagtaactaaaacctctgtctacttagttgctcaagcaggaaacctgagtgtcatccctaactccccttacccactctattggagtggtcctcccatgacctacagatttgttcacttgtttcttgtcctcttgcctctctttccgcaatctgaggtcaccgaacattgcactgggctttaagcattcattgactgattagacggactcggtccacatgctctgttggatgaatggatggataaagactggttgaagaacaggaaaggcccagagccttggattcccagacaaaagcatagcctcccagtcttcatgtcaagaggctctcccctggttagcttgatgacattggtcatcgaagttaaccttcctaacactcagtttcttgatctataaaatgggaccagtaacacttaactcatgaggttattgtaaggattcaatagcataatacctagaatatagttagtgctctattcatgtttaattaaaaaaaatacttgttaggcaaccacccaaccatgtgatccattattttttttcctattgttttggcctgtgtcgcaccaagcttgaggtgaacgtaaacaacataaccaggaatgagttcacgagcagagtcattgccagtgagtcagaggaaagagtgatttccaaccctaatcgcagacgtgggaagagccttgctgtgctgggagtgactggagctcggctctgtggagcagccacatctgcttgggtgggggcgctcttcccccatctctgtcctgcatctaccacaagctgggctttgccactgtctcctgttcctgatcccagggggcaaatgacggatggaaccgtcataaacaagaacaatgcctattgtgctctgcttagaaatggcctgtgttcttttaaaaaatatgaataaaataatatactgagcaaactgggtggtgtggaggatttgtcgatgagaatgcaaatgagcatgatgtcacttcttagctttgggaggaaaaaatgagtgatccttgaaatggtctttttctaccgttaggacaggaaggaaaaaccatctttggtaacaaaagatcagaaattgcctcctgagcgctgcctggctgcttcagaagaaaagtctgtgtttaggaaacctcttattgaggaaagagtacattttggggggcctgtacagggaatttagtggtatttgttgacctgatgagatgagaaatagttgaggtattaaatcgtaaagggagggcaggtgttatcataataggacattccaattcatcgtccctggcctgggctgcatgcagccagctacccgcttcccaggcttctgctcacgggagcttcagcttggcctcagcttatgcggagtgaaagcccagccactcctgatggtgacggcatttgcagaaaattgtacatattgtgcagatccatctccttttcttgcccttctttccaaagaaatgaattcactgggcacttatgaaaataaatgactgatgggagaaggctggagccaagccttttgtaggcaaagggatctgagtgcagtttcgaagcccatagccaggggtcagccatccaggccacagggtccaggggcccagattcccatggccaggccaggtgtgaatgagtctgagcccagtgaaagagggagagggaacagagagggatggccagaccttgccttctttgatttctagaagacttcctttgcttgtagacaccttttagcaggtggagggacagttgtggggctgtaggggcggtttctcagagtgtgaggtatgggaatgtggatgtagcattgattcacacttgctgtctgctgtgaaaacagtttagagggaaggcggggctgctttcaaagaaaaacaggtgaaattcattggtggtgtggttctcctcttctctgtatgccacttttccccatttcctggtgcctctgccgaccttcccaaccccagcctcccttttgggggagacttgctcttagctggctagtaaggaatcgagccagcagaatgttaacgatgggaggcagcgagatgtaaataaacccggctctgaggataggtgggccaggaatcagatccctgttctgtcactcattagctagcagaccactgtgagtcatttaacctcagtgctttccaatctgtagaatggacatcatcatggccacctcacagtgttgttgtaaacacaagatgaaatcatgagtggtgttggcaacgttgtagtcatttaacccttcaaacaactttatgagataggtcctattattaccgttatttttcagttgagaaaatggtgatgcagagaagttaagtaatttgccccaagtcacacaacttgcaagcaatagagcctaggctgaaaccaagcagtttagtgccaaaactcgtgtacgtaaccactggactccactggactcttaagttgaatctttacctgtctaatggcccagcaattcttcaggtataaatcctattgcctccgtcagaaaacatatacaaggcagctcacagcagcattgtttataacagagcccagattggatacaactcaattacccattaataggagaatagatatataaattatgttatatgcacacaatgcgattaacaatggttacaagtaacaacatggataaatcttagaccatgatacgaagtggaaaaagcaaattggaaaatgctatataaagtcttaatccagttttataaagctcaagagcaagcagaactaaactatactgtttagggatatacacgtgtgataaagctaccaataacaacagcaaaaaactaataagaagatgaaaaacagtggttacttgtggggatggagaaggatgacacaggagtggggtgggcaggctcaggttcttctattggggggttcacagatggccatttccttattaagcttacatctctgctgtgtgtattcctttggacctttcaaatattacacaataaaattaaagtgttcactatctcacatgtgttaacttttacctttttagctccccacccccacccacctccaataatgtcttgtaaggtttattgcaaaacagcagaggacaagataatgacctttttagtgagacaacaggccagggcatgtaaaagtcactggaaattcctttagactctggaagaaagccacagtgcacggggctttcttgttgtattcactggggaccatgggtcttattttagttttgctaatgcaataaggttgtagtgctgaacagtgcaggcaatctgggtggagtgagcagtcaggctaggaagggttacttttgttccttcaaaccgctcttagttcctttggatgtgcatgctcagctagaggtccaaggagttagccagagagtgaaggagaaagagagtaggagagacagatgataacaggtgcaccagcccagatgtcacttgcagggagttcctgcagaaggtgcatggccacggcagatgctgggtggacaactcaggtcactggcagtgactcacacagaggaaccaaggcaaggagagcacaggtccttcctaagagggagcagttgaaggaagaggttggaatttgagagactaaactatttcacccaaaatgactgagaattaactaaggaaaatgcgtaaatgattgcactggaccaagattactggagtggaccggaagcgtgctcatgctcatgagacactcagataaggaacaggcagaggtgaagaactcgcgttcctctgcatgactgagctccactgtgaataaatttgcaatccaaatacacatgttgcttctcttcattctcccccactacctagattttaataggcacctattgaaaatctgaaaagttatataacggcctgaaagggtgcatttctaatggttgaatttccaatgctggtgatagactgagagataatttgactagggagagagcagggctggattaaagaatttaaaggctaaaacactgaaaatattatagtatgctttcttacgttatttaaaaatacatgtgattctaagacataaaataatggtaaggaagtccaacagaattcagatatttctcatgatggctgggattaatttttaaaataaaatattaagtgtcaaatttcattcaaaagatgtttaggtgtctttagcagttaccttgtctatctcctggataatttagtactcatagatcatgccagcctgggccatggttccctgcacagtattttctgctttctctctgtgaaggcttgttcagtggggtagactcaagaggacatgggctttttaggcagaagaccagatgccagcccctgctctgagcgcttcgtataaccttgggtttttcatataatcattctgagcctcagtctccttatctataaaataaggataataaaagctccctcacagggtggtaacacagatcacatgagagaatatagggaacatgtccaataatattgatttgtattacaaaaatattttaacctgggtgttttcagaaagttaattacaaccaaatgctggtgagaaacaacaggaacatccctggaatgaatgcaaagtggtacggccacgtggaagacactttggtaccttcttacaaaacgaaacagagtcttaccatgggatctgacaatcgtgctgctaggtatttatccaaaggagtttaaaacttacgtccacctaaaaacttccatatgaatgtctataacagctttattaataattgccaaaaatgaaagcaacctagatgtccctcactgggtgaatggataaactgtggtacctccacacagtgaaattttattcagtgataaaaagaaatgaggtatcaagccacaaaaatacatggacaacttaaatgcacattgctaagcagaagaagtcagtctgaaaaggctaaatactgtgtgatgtcaactatataatattctggaaaggcagacaaaagaaagttcagtgtttgccaggggttgggcaggaggaggaggagagagatgaattgtggagcacaggtgtttgttagggcactgaaactattctgtatgatcatgtaatggtggatacatgtcatcacacatttggccaagcccatagagtgtacagcatacagaatgaactctaatgtaaactagggacttcaattcataacaatgtatctatattggcttaccaatggtaacagatatactacactaatgcaagatgctaataatgggggaaactcagggcagaggttgggagggagaggacgtacatataaattttattttattttactttattttttgagacagagtctcagtctgtgacccagcctggagtgcagtggcgtgatctctgctcactgcaacctccgcttcccggattcaagcgattctcctgcctcagcctcctgagcagctaggactacaggcgtgtgccaccacacctggctaatttttttaaaatatatttttagtagagacggggtttctactaaaaccctgttggccaggctggtcttgaactcctgacctcaggtgatccaccctcctcggcctccccaagtgccaggattacaggagtgagccactgtgcctggccagaaatatgtagaaattatttgcactttctgttcaatatttctgtaaacctaaaaatcctcaaaaaaatgaagttttttaattaaaaagaattacagagccacttcaaccaccagttcttcttccccctgtgcaccccaagagcgtacatcagctctttggaggggcatgtagataccccatgccaggccagcctccgtactgccaggctcgtcctcaccctgggtaaaggctcatgcaggcattgggaaaagcatgaatcagaaatgagagtacatttttcacgttgagctagtaccttgtctgcttatgttgccattcatacagccagtaataagccactccactgtcatgtcttcatttaaattgttatttagactaacctttcaatgggacacgtttttatccatggggtccatggatcttattttagttttgctaatgcaataaagttggaatcctgaacattcttttcagtctctagaggtcatgaagggaagaaggggttaaaaaaaaaaaaggcaagacacaacataaaatcagactgattctatgttaaaatggtgaacaaaaaaaccaaggacttgaccagatgaaaagagaggggctcgatccatgtgagttccctggcttgctgatcccagactgggctgacccagggcatcagggctggggattgtcttggatggaaggatctcattctgcccgtcctgtcccgcagcattgggtgtggaggaaggctgaaggaggggacgcgcagttgtgggtaactggccttcaccttaaatatagcaagttacttgaatggtgcgatttgaaaagcctccagtatctgctgctgacatctgaaattcccctccttcctcatgtgaagtgcctagctggtacccactgggtgattgggcactagaaatgttggcacaagtgccctcttatgttaagcattgcccccaaccctgctttttatttatttttattcttttatttttatttttattttattttatttttgcaacaaggtcttgctctgttgcccaggctggagtgcagtggcatgatcttggctcactgcagcctcaacttcccaggctgaagctatcctcctacctcagcctggctgattttttcccacccctgctttttaaaaatgttggtgctccaattagagctgtaccttaggtagagtacatgaaaatctgattgttggcagagccctcggacttagaaaaagatctgcctgattggggttgtgagctagcacagagcaggaagtggggaagggaccagggagaatgtttctggggtggaggtcatatcagggctggggacagaaaggctgatcctgtgaagattctctgcacactattggaggagctgtctgttgcgggagggaagaagaagcctcattcagatcccccagagcccacattcggggccacctggagttagcaaatcagaggcttggggatgtggcactgaatttggggctgtgttactgtgcagggaatatgagcctaggctctgaatatgggaccaatttgaatttagatcccacctctgccacttattgacctctctgagactcaatttctcatctatgaaatagactaataacaacattgtttcaaagagctgtgttgagcatcaaatgcatctgattctcagcgtaatatctggcacagagaagcactggatgctgatagttttggtggcgcggctgttattggttggaagaatctgctggtcagtgtcgggggcccttcaacttctgcttgcagaagcccgattcatctgttacctgggaagctaaactgtccacacccttctcccatggtgatccccagaagaagctctgagggggcactagagttttattagtggcttaccatggcacttagtcccaatctactccacagcctgtgacagctggggctgtgtgatggggcttctgatggggccctggcagcgggagtctcagcatccaagcacaatcagcactgggtcgatgtatatgaggaaagcacagaatcacatggttgaaaagaactgtaattgtaatggaaattcaaatcactccactgaacctgttttctgattcgtattttgtccttgtaaatcagaagcaccgggagcaatttatttctaaacatcaacactccagaatgcaaagaaaaatgaaataattgcattctgacttgctcaaaatgattcatctgcatgtacatgctgatcctgagggcctatggacactgcaaagtaacacatgggctgtttgtgcttttgctaactcctgtgtgctcctggagaggtggaggaaggctcatatcttggggccaggtggatttctgctccccactgtgagaatctgatgactgtggaagtgatggctcattgcacccaccacagccaggtggagaggaaagatgttcctgtgcctgggggctccaggcagcatctgtgcaacccccttctgcttccctgattcatgagcccccaagggtggcctggagaggccaccaggtggccttccctctctgagatcccgggtgcacagctccttcctctctcagaacacactgattcttccttttctttcccagatttctcccttgccaggaccctcccttattgcttgctggggttcctaacctgctggctgatgttcagggtgcctcctgtgattcttgtccagggcattgagtatccagtggatggcagaaatgaattctctggaccccagaaaagcagaggtaaccaaagaattaggtaaacacattttggaaataattttccatttgatgtttcactgaaataattatcattaggaaaagcaaaacattggagggtttccttgtgctggctttatggattagtattatttgtaagtacatttagcctggagctcagtggggagtgtgggggaacccataatatttttaacatgtagagcctctaaatttcccactgtggcctgcccttccaggttcttccaggtccttttgatttctaaggttctaatggatgggtggccacttatttggggttagcataggggatatccttagagaaaccatacggagcagcattagcctgggaaacattttttgactgaggaggcaaaatgctataaaaagaaagaacatgggtttggggtctaaagctgggttcagttttgtagtggctctgtgattttaatcatgctgtgtctcagtttctgcatctgcaaaacgaagagtacagtgggcccgccacagaggagcacatgcagggacacacacgaaaggacttatgaactaccaagtgtgagtgtgtgtatcatctgtgtgtgcctgtgtgtatctgtgcgtgtgcatgtgtgcatctctgtgtatctgtgtgcgtgtgcacgtattcgtgtgtgtgcatgcatgtatctgtgcgtggatgtgtgtatctgtgtgtgcgtgtgcatgtacctgtgtgtgcatgtgcgtatctgtatgtgtgtgtatgtgtgtacctatgggtatctgtgtgtgtgcatgtgtgtatctgtgtgtgtatctgtgtatctgtgtgtggatgtgtgtatctgtgtgcgtgtgcatgtacctgtgtgtgcatgtgtgtatctgtacgtgtgtgcatgtgtgtacctatgtgtatctgtgtgtgtgcatgtgtgtatctctgtgtgtatctgtgtatctgtgtgtgcatgcgtgtatctgtgtgtgcatctatctgtgtgtgcgtctctgtgtgcatgtgtgtatctgtgtgcatgcatctctgtgtgcatgtgtgtatctgtgtgtgtgcatgtgtgtcagctatcccccaaatttctcctgagttatgaattttgttggaaaaataagatgataagagcttggggaaagaaggtgagactcctaggaacttgagcccgtgtggaactcatcattctgcagaaaactagggaagaatctggtttcactccttagagcagggagccaggaggaaggaatggggtggagcaggaggagccgggagaaccagagagatggcagaaccttttcttcctccctggaaacccctctgcccccagtttttattaacttccagtagaataatggaaggcttgccctgagtgatttcttatggagacactaaaaggagctaagtctgctttccagggattggggaagtaactgagcaaatacacctaaaagcgcaggagcctggctgggatggtgagatgctgggactcagggaaggcatcagtaagtggtctcaactccagctgctgtagaatcatctcaggagttaaatgacactccctagttcaatcaatcaggatctctgtgggtggggctctgagcattggcattattttgtgaaccaaagttgaggaccattcctgacactgttgcaggccacctctaaccagatctccaggggctgggccccgctgcatctaggacacatcagttatgactcaggtctggcatcaccaagaatgtactggtgatctcagggaagtaatctagaccagctgaagactaattaacttgggccatttagaatctgactccgtgagacaaagagccttggacttggtatcccagggccttggagcagccctgtgtcctcatctgagcactcagccacttgcttgagctcctgctctgccttctagtctggggaaagataggttctcacaataaagctggagcttgcattgtgatcacccgggtcagaggagcttgaagactggaggctacagaaacggtctcattagggcattagcataagtggtacagaaggcaggtagggaggtctccagggaaggatttctcccttaattaagattcaactgcagtgaaatatcagcaaccttatacctcttgtatgtaccataaaaaagtgctaggattctcaaatatccttctctcctcccttttctgcctgcaaacagcatttgatagtgcaaccttcaggattacctcaggaataatgagctccaggcaccctttcagctgcattagtgagggaaatgcaacactctattcctggcacacaaacaggccacccctacagccaggtgtgaactccaggctttctggctgcacagaaccattcaacccctggacaatgagtgagcaaactagaagcccaggtatcacttttcagcggatttagctgtgatgggggataatgggatggtggagcagagtggctgcattctgagccacagctgtgggaagctctggttaataggatgtctgcttgctgttggaggttggtgagggacagggacatttaggagtgaggacacggggaacactgctttagcagctgatatttgtggtgcatgcgtgcccacatacctgacatttgcaaaaatccaatcccattgggctttctgatttttagaaaaaccttgattaacttgagtgcttgaaaaagatgtagatttatggttacctaaatatattctgcataattgggaattaatgagaaactccaccccttttacatttcaatttttatgaaaaatatttcttaaatacactagctctcttttctatcctaaggattacagttaattgacaatttttgggtctttggggacatcagcctgatacatcatttttcatcaattcatttactcaaatgttttgagtttccactttaagtcaaacaccatgtgagctgctggagtaatgttgccataggtacagtcaccgatggggatgaggtagcccctgaatacaaatctcaagacaaattccataactcagagtatttctgtgtggggtaaccatccccaaatctctcatatgtggaagtcagatgagaaaacaattctaccccaatatgagccatattagcaccaggatgcagtgcaaagagcgcatggtttgcacgagaggccctgggttcaaatccttgctctgccactcaccagctgtgggaccttggccaggcactttctctcctggcccatttcttcgtctgtgagatggaactgttacacctaccctagaaagtgggaaaggaataagtggcagacacaccagtggacagcatagctcctggcctgtaataaattcttagttaatatttgtttgaaatacaaagtcatgctgggagtagtggtgcatctgtagtcctaactacttggaggatgaggcaggaggatcgcgtgatcccaggagttcaaggctgcggtgaactctaactgcaccatggtactccaaccgggctacagagtgagacgctgtctcttaaaaaaaaattgaatcagtatcctaaaatctaagaaaagcaaaagtaagatttcacctcactgtctccaaacacccccaaatcagttggttgaaacctgattaattgctattccataggcaaatgatgctgccaaacagtcatttgtggctgtgaggaagaatggccaggacagtagacattcagaaattcagttttaatgtcacaggttatgactgtcgtttaccaggtgccttaaccatctgcttgcagtttttcttcctttctttgccttggccctacctcacctggagaagttaaccaaagaggagtaagagatcctccaggtggagtgggccatggtcaaggcaggtgggggcagaaacaaaggaaaagcagcccagggagatggcgttagtgccaggcggcccgtggagaaaagctttcgctatactgaaggtctgtgaataatggtgatcattcaatgccattaattaaaacattgatgagaaaaatatatcactttccagctgggtccatagtctgtgtggcgtcgttcttctcatgtctgcgtggattttctctgtgtcctccagcttcctcccacatcccaaagctgtcacatgaggtgacctggcatgtctacatggcctcagtgtgagtgagtgtgggcatgtgtgtgtgtgagtgaccctgcgatgggagggtgtcctgtcgggggctggctcccgcctggcaccctgagctgctgggacaggctctgggcactgcaaccctgaattggaataactggataagtaattatcctactctttaaatcaatctttcttaaatgtatgtatagatctttttcaaaatgcttaacattacgagtattttggtctttgtttagttcagtgatatttctgtgaccagaaatatgccataggaacttaactcttgtttatatcaattagcctgtgggaaaattggctttgttatatggtgttttgctcaaggttgtagtttccaagaacctatcaatgacattaagtgaggacttactgtgtaagggagctgtattccctggaagcttcctacatgggtattacagagttagctaattgattcctccattcacgtgaaaattaagtgccagcccagataagattccaggtgctttgaggaactgagaagagactgagggggcacacctggctctctgcagtgcccagtctgaggggtccagccctaactgattaaacgcaacatatgctccagcagtggcaggctcatggctcaggggacttcataagaaagtgtgagacgtccatgctgtttagaggaaggtggaaaggccacacagggatgaacacaactgagctgggccctgaaaatgaggaacagagatcaccaggcacagaattggagaagtggcattggaagtagaggaaaccgtgtgtacaaaagcagcaaggtatgagaggtgcattggagaggtgcctagtcgcatgaggactgggtgtcaacaaaggattggtgttaggaaactcttaccttccaaagaaaaaaatatatattctctcaatcatatatatgtattatacataaaaataaatatttattattgtacatgtataaataaatcccactgttagtagtgttaataaaatacacaaattatagtatttggctactgtagaatcagattgagattagctggaggaaatggcctcttaatgaaaagagggctcccaccccagaatgattgatctaactttccccacactcttccctcaggcaattgctggctgtcacctgtgctgtccccacaccgccacccccaactcagtacatggggtttttacctcttttctaacctgcttgttttatgttcaatttgttttagctatcaactagatacactcaagggtaagagctccatagggacctgggatgctactgccacacatacaacatctatatctgttgccaaggcaatgggtaataacatcaaattggaagcgggccctttgtggtcagacatagctgagtggtaccttgaagagttatccaaaccaaagagggaagacaagtggcctttgtggttatgcatgtgtctatgtgtgcatatatgtgtcatctatgtttgtaagtatgtaggcatgcatgtttgcttgggaatacatgtgtgtgtgtttcagacactctggctgtatttcaataagggcatgtgaggtacagtttatatcccagtcaatggccagcaacacgctaggaaataaacctgatgaaaccaaaaacctgtgaccattgaggtcttaatctgtgaaggaaattacagtttaggagtgtgtgatttctcaacttgctgtcaagaatctctgagttctgtggagtgcaaagtctgaagatgaccttttcctggcagaggcgagagtggagaagcctattacagagcataagccaatttactttgtacaaataagtggcaattttcttcctaaaatacataagggtggaagggaaatgtgtataaactgaaagattctctcctatggtaaatctcctcttgtttgtggaaagtaaaaagacagcaacccacttagactcttgtgggaagatgtcagcagaagtgagtctgagtcctccgctgaacttcaccttgacaaatatttctgaaactggtttttggttggggaggaggaggaagtaagtatatgagtaaatatctcttggcaaaagcattttagtggaaagagaaaggagctatgaaatatacctccctgctttaatttgtcacttctttttgtttaaaaaattcatgagtgttcgtaggctgaaagtaactgaaaatcatagatcacaaccttttttccaagcagtggctcacaacctgagaatgttcagatccctaacagtggataaactatgttgggtgcaggcttcaggatttccttaggttttcaaaggcaccactgatacaaaaaaggtcaagactcacactcttgtgacttgttccacaatttttggctaggggttaagatcagagggtggatgaggtcggctccacaatcattttggttgtgggaaagggttatgaggagattaagattcagaaaagttggcttatcatttaaggagcacagttcatagggtctgaggagttttagcaggtgtgtggtaacctgcaatgttttcgtaggtgtgtggtaacctgcaatgaaggagttatatgtgtgtgcatgtatgtattcatacattaatgtattaaggtaacatctttgtattcagattaatcccttcataaattaatacatgaaacaatgcagtgatgacaagtgttctaaaaactatagaggacttgtttatgaaattagggctcatactgaaggtcaggagaagggctgccattcatcagtcagcattgatatggagagggaaaggagattaccctattacaagtcatactgggtggaggagatttaattactcagatgctcttatgctcctcaaaggtcctagtgcacctctttagacagtttcccacacaagcctcagcccatctcatctggttttgttctgaaccccaaggttcagtcaggtgcgctgtcccatcacaggaaaagaaaccttgagctgattgcagactgtctctaggttgtcatccattaattaatgaataaattaaacaaggcttttccactctatcatcttgtcacctgaagaacatttattttcagggtgattgctaaactccacagtacaaagtatgtaatagatattacgtttttatttactactatgtatgtaaatgaaagaaagaaaagggaaggacagggagagggaggaagagaagcaaggaagaaaaaccaagggaggagggaattcttgatagtctctgtctttcacggttttcctgctcagcttattcatccaagttcccactcagcccccagcagaccagagagtcaaacccaacccagtgggcctgggcaggtgccgtgccatcccctccaccttctccgtgcggcctctcccttggctgtcctctgaatgtgcctgtgcccccaaatcctcccttcaatgacatcaacaaatttaaaaaatccacaccaaatctgtcacctgtcaaattaaatgcctgaatagtcaccagcctggcagttgtacaaacatccagaccttgaatcccaatttgagtttaaactgcaaaaagacacaaagagaggctggggactgaataagatgaaaggccagctcagatcttcagggaaagctattgtcttgatttttcagccttgatgagcctcatggaggtaataaaaccatgaataacattctccctcatgtgctcacaacaacaatatgactactaatagtgaggctaataaaaaggacatattgccttcaaatgccatcctttgcctctcattgtccctaatagccttggggccctgggctagcagtcatcttctcctacagatctctatctgtaaactaggtgggttggcaggagaattagtcctcttcagtcctaagattctataattccatgacagggagctcaaaaagtttgagtaattatagaagtccttcctgcagctagatatggcagtttcatgtagtagttactgtcacaggtttttcagtgatactccctgagttgaactcctagttggaccatgtgttggctgtgtctccaactcctaacctatcagttagggataatacgagcattactaggtaaggattggatattaaccatgttgtatatttatttatttattatactttaagttctgggatacatgtgtagaacgtgcagatttgttacataggtatacatgtgccatggtggtttgctgcacccatcaacccatcatctaggttttaagccccacatgcattaggtatttgtcctaatgctctcctccccttgccccccacccccaacaggctccagtgtgtgatgtttacctctctgtgtccatgtattctcattgttcaattcccacttatgagtgagaacatgtggtgtttggctttctgttcctgtgttagtttgctgagaatgatggtttccagtttcatccatgtccctgcaaaggacatgaattcactcttttttatgactgcatagaattccatggcacatatgtgccacatgaccacgctgtactcttcaaaggggatgaaactgagaccctgcaaggataactatctttttccaagttcccaagcaggtttgggagtaggacgtggtctgggaagggaggtaggctgactgccccaggccccacctcctgctaacattttattttctctgactcccactgataaaatcctatacttctaacaaagaaatgtcatctgaaattttacaatggagcacaggaaattgccaggtcactaaggtgaattatgggcacatttccatgtggtgggaaagatgacaggagaaaggacaaacctggggaatgaaactctgccatgtacacatgttctaacctgtattttggcttctagtggttgagacctcattagctatgtgtttaaccattcatgtctaactattcaaatttaaaaatctgtttcaatataaaaatataaaaagtcaccccaaatctcccagtgatatgtgcaccacggtagggaacacaggtttcgtgcattcatagacacacggaacctcatgcaggtacccaattatgctgtgcccttccccatctccatgcctttaaacttgtcacagttcctgcctggagtgcttttccccttaccattcacctggattttgaaaaatcgtcctttaacccatttctaggaggcttctgagattcttctacatgtctactctgatgtggttggagagtcctttaatgggtgctgctgatggctatcgctgatgtagtgtttacccactaccaggcactctgttaggcactttacatatattgtctcaaataatagtcctcataggaaggtgacgaaaggaagctcaagttgtgtgactaatatgcccaaggccatgggctgcaacctttttatctgtatccctcagtgcctggcatggtgttatttttcccaaatgcacatttgtgtgaggctcagcactggataaatggggaaagaatgaatgtctgaactagtgtggattaggaggaaggtgagcaaagatgttgcactgcaagtggtagatgctctccaggccagctgcaggactgcagatactgacctggggttgaggagcaattgtatgtagtttggagaatagggccctcatcttgaggctgggagcataaaggaaagagggatccatggagtaagaggtcccttcaggggagtcattagcaaaagagaatacttatttgaaaattaaatgtcttcacttcttttccaggaggctccatgacctgtttttggcaagctacaatgggggtgcagctttcaaggagtcatttcagcaatttagtccttgctccagggctaactccccctcccctgcccaatgtggtgggagggctctgctaagatgtagagcagttattaaggccttaagataaaggcagtttttcatggggtctgtttttttcccagtgacctcctgaggcagcagactccacaggcttactgcagggctatacaaaaaggtattttatgtccttagccttataaatcaattttaattgtaacaacagaaacatcagcagcaaaatggagccaaatgggcgggggcctttttctgcgctttttaaccatctcagattaaatgctgaattgtattttggggtctgagttttgtcatgcaaacgaagaaaaacaacttgctttccaatttccacatgcatatatagaatgaattgttgagacggagaatatattttgccatctcagtgcttctagaaaagataaggggctcttgtaaaaagttctacaatttgtcagctggcagcttattaaatacccaaaacaaatgtttatatagcatgagaaggccactgtcaaggtcgggaggttccagaatggactgattctgctttattcataactgtttgaaaaatctcttgttcttttctttcccccaaaaaacaaatgcaactattctgttttctttgccttaggaaaaaaaacaggcaaggagccagcccttgtgtacaggcctctaataataaacccgcaagcatggctagttgttcagcagtcatgagcaaccctacaataacagagtctcacaacatggaggctttggcttcagcaaaaccttcattaaggggtggcagagcagaggagggtcacccagtcatgaaaacaagctctgactcacatgccctaggagcaaatgaaattgggcaggagtctgaagagaagatggaatctcctccgtgctctaggaggtgcgttataaagccataggtcttgttaataagagggaccccaattcaatccaatgaccatttatttaggtgcatactaagtacaatgtatgttgggtgacacagaagacagacaaggaactgaccgtgccccccaaggatattagaatctgaaagggagatagggtagacaggtacttaagtaactgcagtgccatgtagaataataagggttataagtaatagcaaatgcaaagaagggagaggcaacaagaacaaattaaatattctcattcctttgtctttagaccagtaactttatttgagagctttgtttaactaattaattaattcaatcgctgtatgctaactggagaggttagaggactcacagaagtcactagctgcttagaggttaggggcacagtgcctaaggccccgccctgtacagggctttgctatcatccctgcctctagagaagagatttgccctctccaagatctacatggccagttaaggtgggattacagacaaaaccctcctgatactgtctcctgtctccttgcatctccctccttcccttccccactcaatctccagaatcttttctcacatccagttaacttgagatggtctgaattttggcaaacgaggttgtcctggggctctgggggtctaggtgtgaaaaagttatctctctgtgatgacatgtcattcgcctcagcttgtttcatggctcgaaatagatgtctctcattcttaatgatggcccaatttggtttgggaaaggcagcgtgttgagtcactgaccactcagggcactggagcagcaaagtgaaggatgatggggagggggagtgctgtcatccccttgctcacactggactaagagcatatagttcacatcttctgtaagcttggaaagttatcatttgaaagttgttgctctagagtgccttgacaatctaacaatacaaaataaatcttctattcacacctctccagcaagccaggatcccaggaatatgcagcaacagcggaaatcagtgataagctccctgttatgttgtcaaaacttacagcagcttcacactgccctgattaccatatattagctttctgcagacacacaaggacttgctgggaggcctttcttctggtcagcactttaaaaatattttatgtaaacccccaagtccctttggatccttccagaatctcggatttccacatgtttccaagctctaacatgctcctctcgttaggttaagtagcttgcaaacaccccgtaaatgggagtatggaaccgcaaggaaagacaataaggccagagatcatctctgtgctcaggccctacacctgagcatccctagcattttagaggctgcttgcagccagaggtctttacattgaagagggaaattgcttcccaaggaaaggcgcagaaatggcttataaaatgggcatctgtttggaggagtaatgggaagagatgaagacctcatggactactgagtctgaaacaccaaatcgatcagggaggccgagcaacagagagcagtttccagctgtggttgcagttctgactgaaaccctgagaatatgatggctgttctggaggttgtcttaagcccctcaagcccgggctctctccctgacagctgtgggtgtgtgtgtgcacactggagtgtgtgcagggaggaggtggtacgttaatgagccttgcagccggtctgacaaaccccatctgcttcgttctcttggccacccaagctgtctgccttccctggctacacccatgggcacctggtggccctgctgagggccaaataggagtgttgacatccccttctaagctcccgcagcagccaggctcttaagcagccagctagcaactccatgtgttgttaccccacctgacagttcacaattctgtctttcctcctgctgagaattcttctgttttccaggaggtgtccctagtacccttcccacccgctttcatcctctttcttcagagagaactttgacccagaaccgagtgactgttatggagctacgaggtccttgtctgaattctccgtgtggttgctggcctgtaagctccaagagggtagggggctgtgtctgaattttggttaattgctgcatccctagaaccctgaaaagtgtctagcacatagagtattctcatagctgttgacaaactggacagatacatgagtaatgaataggaacctgtgcattggacggggacggtgccagctacagctgacccttccctcacagcatgcaacgttagcaatgaacttcttttttttctttttcttttttgagatggagttttgctcttgtcacccaggctggtgtggaatggcatgatctcagctcattgcaacctctgcctcctaggttcaagagattactctgcttcagcctcccaagtagcggggattaccggcgcctgctaccatgcccagctaatttttgtacctttagtagagatggggttgcactatattggccaggctagtctcaaactcctgaactcgggtgatccacccgccttggcctcataaagtgctgggattacaggtgtgagccactgtgcctggccagcaatgaacttctaagagaaatcagatcaagccctcaaacattaatttacagtcaagagacaatctctgaattcagccctccccgtcccccagcactggtattgacatactgcagaccttctattgttggtggcaaatatgagcaggttaaggcacttttcgggattagagaatcttcaaactcaatatgcataagaacaatttatcctgatgaccagatataatagattctgttcattaaggaaactgcttgccatttgctactatttaacccattctttctattgtgatcataagaagaagaaggccaaaggatcattaatttccttactttggaactttggggtccttaggatagcgctgtgtatatggcaggcactcattactattgttttgtagatgtggctggtgataataatgagaaggactgggggaaaacgaagtatgctctccaggctaaccgttggtggtttaggcagacggaactcctctcaggatttattcagattcagtgacagcacttcttgaactctgacaccactccacaattaatattgtccactgaacagaatggtgaaccctgagcatctttcccatgaaaggcaagacagatgcacacgagtcagttctgccactccagtactccgcacggtgtctggcacacagtaggcacttcacaaatgctaacaacaatttgacaactagattgcaagctgtagatttcagatgcaaggcaatggttagtaactagattttcttagtccgccctgactttgggcctttgtccatacagcaccacactgggcgtcagggtccttttgttgggatgagtggctctgtcactctttcactgagaccaaggctcaggcaatcaagcaatgcatttcaatcaacttctacaatgatccaatttctgggtctggctctgtttctctatttcccagttacttgcccaagaacatggctccatctaaaggaagtggcctacgggaatctgcgcacctctgctgtgaccgggaagctgggctctcattggaggttgttgggctgcagttcacggcccaggtgagaccacactgcagaacataatgtgcagatcaaggcaatgatgcctgtttctccatttcattagccacagctcactatgtgtcaagtcttgttttctccagtttagactcagaaactgacttccatcattgaaatagggctcgtgtctccttgtagtaactgcaaggctttagggaggtagaaaaaatttagtgaaaataattcagcaactcgtttgagctgaaaataacttgattcaaggactgtgccttcagatacttgggaggcatgaagatgaaggcatttgcagtcttgttttcctttgtgactggggcattaataaggctttgggattcacttcaaaatcattaaaaacatgttcactagtccaaagcacctctcccacctgtgtatgaaacaaatgaattggtgggaccttggatcctcgtagtttgctgctcctggggtagtccctcactaagctccttatcacacatttgcactgccaagatgatatttttggttaaaaagttataaatattctggaccaaaatattaccttgagattttgtccacctgacatccacttcattgagtgggaattctgcccaaagaattactgaagaatgaattcccctgtttatttagagcttgatatcttcataaccattttgactaacattaaccatttagtcattaggacccaggagcacagataattggtattgaggttcacatatgtggtgaatttcaagcaaagaggtctcaaatatgaataagtgaatagtgcccttaaagcttcttattcagaatctacaaagtgatgaaacaaaggcaaaaaaaaaaaaggtgggatccccgaaactagaaaaaccctagaagaaaatctaggcaataccattcagaacataggcacatgcaagggtttcatgatgaaaacgccaaaagcaattgcaacaaaagcaaaaattgacaaatggggtctaattaaactcaagagcttctgtacagcgaaagaaactatcatcagagtaaacagacaacctgcagaatgggagaaaatttttgcagtctattcaactgacaaaggtctaatatccagagtctacaaggaacttaaatttacaagaaaaaaaaacccggttaaaaagttggcaaaggacatgaacagacacttctcaaaagaagacatacatgtggccaacaaatatatgaaaaaaagcttaacatcactgatcattagataaatgcaaataaaaaccacaatgacataccatctcatgccaggcagaatggctttttttttaaaattaaaaagtcaaaaagcaacagatgctggcgaggttatggagaaaaaggaatgcttttacactgttggtgggagtgtaaattagttcaaccattgtgtaaattagttcaaccattgtggtctcaaagacctacagtcagaaacaccatttgacccagcaatcccattactggatatatacccaaaggaatataaatcattgtattataaagatacatgcactacatatgttcattgcagcattattcacaatagcaaagacatggaatctacctaaatgcccatcaatgatagactggataaagaaaatgtgatacatatacaccatggaatactatgcagccataaaaaggaatgagatcatgtcctttgcagggacatggatggagctggaagccattatcctcagtaaactaacacaggaacagaaaaccaaacactgcatgttctcacttctaagtaggagctgaacagtgagaacacgtggacacagggaggggaacaacacacactgggacctgatgggggtgtgggttgggggagggagagcactaggaagaatagctaatggatgctgggcttaatacctgggtgatggtggtgggttcatcggtgcagcgaaccaccatggcacacgtatctatgtaacaaacctgcacatcctgcccatgtaccccagaacttaaaagttgagagaaaagaagaaagtaaaagaaataaaaaggtggattcctttaggtcaccttcttgcagttgtaccctaaatttagaggattcatcattgacatgcagaacacctaaacctgttgatccattcttttgggtgtaaagctttaaaaaaaagaaagtctcttacggtgttggcttatttaaaaacagatgacaaaagacacctggcttgcagttttgtctttattctccaggaccatgaggagcaattagcttttacaagttcatttccataacaacctttagcacacgatatttctggattgagttaaggatgggggcatcaagagatgacttggctctactcaagattccacgtggaaggaaggggcaagcctagtgaatgagtcacaccctgattctgttcttagctctcacttctcccactgtgtgacctgaggcacacaactgacttctctaaaccctcatcttatttctctgtaacacggggaaggatagccgctattttgtgaggttgtggaggggatgaatgggacaaattttgaaagcacacagtatctggcatgtagtagcatttcataaatgtgagctattataattttatttatttatttttttgaggcggagtctccctctgtcgcccaggctggagtgcagtggcgcgatctcggctcactgcaagctccgcctcccacgttcacgccattctcctgcctcagcctcccgagtagctgggactacaggcagccgccaccacgcccggctaattttttgtatgtttttagtagagacggggtttcactgtgttagtcaggacggtctcgatctcctgacctcgtgatctgcccacctcggcctcccaaagtgctgggattacaggcatgagctgctgtgcccggccgagctattatttttatcatgaggtatattccttgttctcttttccctttgaggcagctcttgttgactcttaataagcaaaaaccacacgacgacagttttaactggcttacgtaaagttcttacagatccagagctgagttcatccactacagatgaagaggaattagtgtgtcttttgaatattaatgaataaataacctctttccttgttatttatttgtattcaaaatgccattgctagttctagtgataattattgaattttcaacatttatagaaaaacagcatatactgtataaagataattgccgtattggagtcttaagaaagagttagttttgtataaatatggaatgccagtaattatcactagtgctacatgttaaaattagaaagtaggtaaataacaaggacagtatgtattctttataattcaaatgcatgtcagctcaattatcctacaattgcatagacaataggtgaactgtttttctcctttaaggggaagacttctttccgagtttacgtttcctgaagttgagtgaagattccatggtttgacaagccaatagtatgataatgggcaatattatttaggagtgggctgatggcaggtttgatctctctgtgcttggattcactgcctcaattctgaattatgttacaactgcttagaattttaaagttagagacccgctgtggagaaataaagtcctggctatgtttccattttataatctctcaggctgaattttgaggccagacctgagtacaaatctgtaacccaggaatctcccacgtgctcacaaagttccaaggatactatttaatctcctccttttcaccaaccccatctgcaccccagcagggaggtcagtggctacatgaaagcaaaatctaaggctcttctttgcgccaaagcctggtctccatgttgttacagaccaaagccactctgaaagccgcaggaggctgaccacaatcaataatcgttcaggaaacaaacgcagggaagagaaataagtgacttattgaaaaggcacccggaaatggcattagcacagcactgcttctaatcatagactcagcacctcagaggaacagctgagcagagccttgttaaacaaatgtagatatcatgggtgtttaaaggaaacacgttactttagggaaggaagaacctgttgcattaaaaatagagctaaggtaaagagcatgtacttgtaggcttgcagggagaaaaataacaaatgaggaaagccaacactattaaaattaataggaaagatagaaaaattaagcagctggaccatggataaacagcaaaaaagccaagtgtataaaacagctcatctaagaccagaggaggcagaggggataaacagctcaccctgttgaggatgtttacttttgcatctgtcaactgaaaaggaaggaaatgaggatttgcctgagtcagaatgagtttccaaggaaagaggatgcagtgtaccacagaaaatggtggtgatgatgacagccagtcaacagaagctgatggtgacttagctggcatgctggccatgggatgcgagtgactgagggcttcagcttcctcattgtgggggacagaaggggatggtttagcaatatcctcaggcttctaccttcccatttctcccaccaatcaggcattagcatccccagtcctctggtgtcctatggttggaacccctgctcggtactccctgtcccatgcccagaaggggatgccttgctttctcatccttccagcctatgtggctgcaaaatgacacttgtaaaatgacatgcagaagagcaatgagaccaatgccagatcccagaggggtcagggagctccaccgagcttccctaacttgttcacatcctgtcacgctagctaatgatagcatttgtagggcagctggaataaacatgtgatggacccatatctagaggtgactctggcactctggctgtcccaaccccaccctgatctgaaggctgagggggtcattatgtggacccactacaacccacgggtgggaagctctagatcttggcaccccgtcctcttggctctggctgagccactcagctcttgaatcagaggcttcagcaggaggagaggctcaaatgagcccaagctgattaaggaagtggccatgctccacagaaggacagatcaatcttgattagagtattaggaacgtttcgaggatgcctcgacttagcagacaactggcatggtggctgtatcaggggggcaagagcatctgtcaaagatcaggttgtaaggtgagtctaagtgtctagggccatggacactgcacagccaggacagaagccagctgcgtgccagacgaagtgttttcacagctggggaaaggaaaggcacagattataggacagctgtttgcaattgcttctggcccatcaataaggcaaacagtgacttaggaatgggaagagtgaagaaagtaagtgattttagggaggcagtgtggcagaatagaagaggctcaataggctttcacataatgcagaaggaacttgaatcctgcctctgccatttactagttgtgtggctttaggcaccttccgtaacctctctgagcctatttcctcactacttatgataacatctcttttacggagttgttgcatatattaaataaaaacatgtctatacctagaatactatagagtttcaataaaatattaaccattcctctttactatgtatgctgtttaaagcagaaattgtgtagtagtagtagtagtagtagtgtgtgtgtgtgtgtgtgtgtgtgtgtgtgttgggaagagggaacattagacttatctgaaagtttagaaaatactacagaaagacacatccttattgattgacagatattctcctgcaaacactctgtcttctccccattgtgtagactctggaaagttattgtaattgttgatttcaggtcagcctctactctacctgcagcttggtctctggttttcaaattctgtagaaatttttacagctgtttgacttccttagacatgagacatgtactagatggcaatagcaggggacgtatcccctacactcctgtcctggtccaatgcctaacccatggggaacactcaatacatttatttgaactgaaatgaacctggttggtgggcgaggccgctaggggtagaggcagttggggaggaaggtggcagccatgtgcatgttggagatatgtgagtagctttaggtatctggaccccaaccagcccagtgaagagggtagagatgcaagacttgtagatatgacatcagagggtggcaaataatctgggtccctagcatgctgggcagcctgaggcgacggtccggtcagccaggctcagccaagcccctgagagcatctcgcaggaggtaccgttctgtccccagctgagaggcactaaggctttcccagcagaggttcagccctaccagagccgctcaggggaatgtgcagaaggaggacaagggaagcaactacctgacatcactctgccctgcttgtcaagacaaaacaacatgaatattaatttctcaggcataataaggtgtggaggagcaggagtgggcagggccattgtgtgggaggctgctccttcctgccatttgtcaccggcaggagtgatagatggttcttccaggcagcttcccaattagatggatacagccaccccaattaagagcacgttggccatctgcttcgcaggtacgatggcattaggtgctttgggcggggctcaggccagactttgcaagacactagaggaggcaggaacgctcacatacacatcggtgagcagaggccacaggcatcactgaggccaatgcctaggcctgtcaagaggattgtacctgcagataatctgccaatgtacttatagccttttgccagactcactaccaataactaacaattatctgtaagacagtggctcttgattggtgagcatcagaattatccagggagagtgtttaagaataccactctcccgacgcaccccaaacattcagagttggactttccacacttgatcagggtccaggacacctgggttccacttgattacggctaattaggttatttatttaatgaacagctcattaagatagtcatctgaaatttgaagtgctttcaacaactttcattcattctctcattcattcatgtaagatttttagagcacctaacagatgctaggcactattctaagtcctgggggtacaccaatgaacagagcagaaaaatccccctgccccattcattttgttcatgtgaatactttcttggtgagagtgatttcagctagcacatagtttagagagaatgctgcagagggaggcagatagctgagtttcagggttaacccggagttgcagagttgcgaggcctgctcctgaactttctgaatgaagctttgtagcaagcctttaaaaaaaaagtaaccaagaaggtctgaagataaagcaagccaaccttttcctgcaggaaaagatacacgcatagaagatctgtgcagctagagctaatggcagcttccatgatgatcccaagtggaataactatataaggtgtggattctgacccagaggagtttataatctatcctggggaaatgaataagacccaagaacagagaagaatacaaacacacgataagaggtaaaaaattttgttgaaggagggagcagaaaaacttaaagcagctggggcagacttcatagcaggcaagttgtagggtgttgattcaggcctggaaggatggatgggagggtctggacaggtgggagatgtggtgggagataggacaaggcacaagcagagtctcagcgggcacagcagcaggctggaggcaggacacagaggccagagctggagttgaggccaaacagccctgggtttgaatcctccttttgtcactcactggccgttatagctgtggagaggatacttatcccccttttccaggtgtggaaactatgggtaagagacattgacagctaccttgagttttcgtgaggactaaaggttttatatctcaaggacctggcgtgcccccaaggtgctggatgggtgtgtttcgagcttactaggtctgagataccacgggcacacaaaatgtttttaaagaactccaaaacattccctctttatctctcttgggactgcaaaaggttgatgcactggaatgatttgtggcttcactatgaatggagtccccttatcgcagagttcattatcagaaggctttagtggatatgagaaatgttgtttcttcaattctcagggacagataagcaagcaatctcagaggggttttcctagacaaggcttctctcccttttgttagggctgaagaagctggcagggggacaccccccagcagtgcttctcaccactgtaaagctgatagaatattagattttcatgggtcaacggataaacacagtatatatatatatatatatatatgtaacttccaaccaacatcccttcctttggaaagggcttacctggccatttttggatattcttgctttttaacctgggaccttgtagttttcaggagaagtggcatttgatatgtgtgacctgggcaaaaattatttaactattagggtccccagctccctcatttataaaaggggagacatcattattcccatcttacagggtgaggtaggcagaataatgtaccccctcctaagacatccatgaatgtgtgaatgtgaatgtgttatgttacatggcaaatgggaattaagttgcagatgaaattgaggttgctaatcagctgaaattgagatgaggagagtatcctgggccatctcggtggcccaatgtaatcacaggagtccttataagtggaggagagggacagcagagttcaggtcagaatgacgcagggtgcaaaagatcccaccagccctagttggtttggaagatggagttaggggacatatgccaaggaatccaggcagcctctggaaggtggaaaaggcatggaagcaaattctccctagagtttccagaaggaacacagccctgcagacacattgatttaattccagtgaaatgcattttggacttccgacctccagaactgtgaagatagttaattagtgttgttgtgagtcaccccatttgtggtgagttgttacagcaacaatgggaagcaaatgcagagttaatgagagaatgacatattacaatgctttcttgatctgtaaccttgggcaagccccttgatgtctctgtccctcagctttcataagtataatatgggaatgataagaatggctatcttatggaattgcctagtacacatgaagtgttggaatgctgagacatagtaagggccctggaagtgttggctaacggtattactattatataattactattatataaagcacatagactggccatgtagtatgttctcaaacataactatgcttattatttgttgtatgggaaggagaaggagccttggtgagtgctctagaacttctaatttcagtagctctgcttacaatgtaggcacatatcacaaatttcaaggggccctgcccttttaggctttgcccagttcctgttttaataggaatttatgtttccttaagaaaggtgatctgaccctggggactttttgcaactcatatagtattgaggttttcctttcactgttgtacaacaaactaccccaaaacttagtggctttaaataaccactattatagctcataattcatgggttagaaattcaggcagggcttggttgagtggctcttctgctccatgtggcatccactaaagtcattcagagttactcagctggtctgagcaggagggaggatgaggaagctgatgtctgggttgggctggccggaagagccagggtctggccagtgttgttctctctccacggcctctccaagtggcttgcttggacttcttcagaacggggcttctagtaagtttccagagactcacacctgcaccaggaaactcacacagtgttatatccactgtatactataggtcaaagcagtcaggtataccatatggattcaatgggatccaatgaccccacctcttaaagggaggaatgtcgaggaatttgtgagtatctccaatccaccactcatctttaatactcgctggagtatttaatactcactggagagaactcagggagtgagaaacagatgagatgtgagagactaaacggtccatctgaggcaactcagcaaatccagagtccatgggcctgcctcacactaaccattctggattctactaacattgattatctaccatttagaaggactggtgctaggtactttcatatacttgatgtcttttgctgctttgaaatgaaagcattatacttcagctaagggataaaccaaagcctggaggacaagtgggggtgcaattgaaagttgctcatctaacctccagggcctttgcttttcattacaggctcatataacctggtctttatgcctccattttttctgactctaggcaggcagaatggcctcagcaggaatgcagctatgttagacatctgtgtcctgggagaccctggggcactttgaatcctggtcagaatggaccctaaatgagctcatgtttctaaagtgctctgagctcctcagagagcagaatccatttaactccagagcctggatggtctcattggtgggtccctgcagtgggggacatggtttgtcactgctagcaccaggctgggaccttggataaatagggagaaatcagtctccaggcttctctatctgccatcttttcagccacaataaattaatcttcagaaagatagaaaacaacaaaagaagggagaggggaaaagaaacaacgacctatctgacaagtctgaaaggaaaacaagctttctgctgctacagtgccccaggtgaagtagggggctcaagctggcaggtgggtctgaaggagcagacgaggcaccctggtgctaagcacactccgggaggccggggcaggtgggcagggaccaggtgaagagccagggggtatcttgctggagctacctgtagattgttctggatttgttagcatctctcaaaataagatcaacttgatgctgattaaagctgaaacaccccacaagcctagcatgctgagtgtctgactctagggcccctgaacaaattgttttcccttttcatgatgatctttgtgaactctttggttcagcgtggctcgcccatggggacagggctggaaatggaagcacaggtttcctcttggcacctagctgtcagaactgtccccaggcatcccagcaggagggagacaaacaagcattctcatccggcaagctgatgtctgcatatgcaaatggactgaaggaccctcagccttgaatcctattcagaaacagtctacagagtgcctacctgtgccaggtgcattcacagaaatgatttcatttcatacaacagctctgtgaagcagctaggtattatttacctaagatttgttataaggacgctcaagttcagggagggtaaacaactcacccaacgtcacacatctagctgtggctgagacaggtctcaatcgatccagaaagtttatttaaggatgcatgcccaggaagtaggtctgtgcctttttccaaagatgattttgagggcttcaatatttaatggggaaagggacgatgttaggaaaagaggaagaaatttttaaaaggtgtgggtaaatcagagacaaatggttgcattattttgagtctttgatcagcctttcactgaatacacaattatatgtgagagagggtagaagaataaccatttatgccttggtctggctcagtaaatctgcatttttacctgagaggaagcaatcagatatgcatttgtctcaggtgagcagaaggatgacttagagttctgtcttttgtcccgcacctgtgaagacaagctattgatttacactgtcggaggtaaaattcaacagaaccattttagggtaaagatcttgaggcccacaaggaatttcctctcctagtggacaaattgtgagggacgtatgtagcctttttaatctttgtagttatcttatttaggaataaaatgggagacaatttgactgatgcagttcccagtttgaattttccctttggcttagtgatttgggggtcctgagatttattttcctttcatagtgatttccaatgataaatatgggctcctgacccagtctagggtactttccaccaaccagtagctacaggtaatgtggctgtatgtagaccaatcaaaacgaagcgcttgggcataaaatgcctcttgaaattatgcttcatgtctgtgcacttgacctaggacaggaattttaaactttgacagcctggtgacgctatgacccccttctcagaataatgttttaaaatatgaatataaaacaaaatacctaggattacaaaagccagttattacattgaaatacaattataaaaatattaaaaaacaaatttgtggtatggtaatgtgccttcttctttattaatacagtgaataatgagatctagcaaaggtttaataatgactgtaatttcaagtagtgatgagcataaataacattttgagatttctgcaaaaacattaacatgatctgaatatacctgagattttaaatggtgataaaaatcacaggctactgctgttaccactgggtttgttgtctatacttacaaggaaagggaatactacattcctgttagaagttactgaaaataaaatgcgatctttttccaccatccaggttcattggtccctttgattcccttgggtcaagcactttatgtatttttacacatttaatccccacagcaacccagtgaggtaggtacttccactatcctcgtttcacagataaaaaaactggggcacagagggattaagtaacttgcccaaggtcacacaaggccgccgagttgatacgttaatcaggttgtccttttctctccaaggggggattctgcaaccctcttgaggaataatcatatcaaggagaatcttccttttggatttttcccagttgggttcagccttttctagtcactccccttcctgcagaatttgtcgagtgccggtccttcctctcagcctggttagctcctagtcactcatcagatgccccctttccaaagaaggcttgaatagttccccaccccattacgcttgcccccagctcttggatgtcttccccatggtatttgtgaaacctctgtctgtgtggtcattaagttaacacctgcttttcttgctagatagtgcacacatgggacagaattctgccttgttttgatgatctctatatccctaacacctaactgtctgtccggaaaaatttagatgctcggtaactgcttgcagattgaatgaatggagaataaatgaattactagtcacagatgtaaaactgatttcctcatcatgattactgacttccttgatttcccatatgaccatgcagccaatcatcagctattttttttattgctgtttattaagtgggtccctttgtctctctggccttcagagcatcattctttctctcctgtgaaccttctccaattttttaaaacattatttctgctttcgacttcctctcggcctgctttgatcttccacgttctgcgtggaagttatttctgctttgaactttcacggctaagaagttttgggaaatacgtgttggaggtgttgggaggtatgactccacacagaagctggctctccttcaaagttctgtgttctggtctgcagcaaggtagaagcctatggggtttcaacctgacagcaccatttctactcacctctaagaatgtagctgtgagacaggattcaaatgtttagactggcaacaaatgagtatctatcacgatgcttaaagtgctctcccccaaaacaaatgttgtcattaggacatttaatttctgactctagagtctctcctgcagagggaagactttcttcctcagcttctttgctgcagtgttgaaaatgaggcagagtagcagaggtcatccccctcccttttcaggctgctgggattatggtgggcagagggctttccttgttctgcttttggggtgctccccacccaagctgcctttaattttgtctgtattttcctgttttactgcttggtatttggataagctatagagaggaacaaaatgacattcacccctcagagcccccaaatgttaagaatcaatatggaagtcttcccagattcagattttttttttttcttgagatggagtctcgctctgttgcccaggctggagtgcagtggcacgatcttggttcactgcaatctctgcctcccatgttcaagtgagtcttctgcttcagcctcccgagtagctggggctacaggtgcatgccaccacacccaactaatttttgcatttttagtagagatggggtttcaccatattggccaggctggtctggaactcctgacctcgtgattcatccacctcagcctcccaaagaactgggattacaagcatgagccactgcacctggctgattcagagattttattacatttttggggggcattttagattaccttagagaatgataatattgcctcttctaggggtgagaaaaacagtaatgcactttcgaggatattcatttgaaccagttttgaaaataagtctaaaggatttctaaaaccatataatgtatggctgcaccattacataggtgggcatatcccaaagtgactgccttaaagtcgataacaatcatttgggtatgtaagtttaggtgtgtcatttactttgacttgcacctgagtaagtgaaaggggttccaggtatgggaaggagatcttcaaatgacaggcagcagagaggggcaattttcttcctgtttttatctgaactactctgaaagaggagagggcactgccttgtcatctgattgccactggataatgttccgataaatgacacaatggtaagagcattgggttttggaattagaatgacttggatccaatcttagtggatttgtgaccttgggagcaatgtgacttatcttttctgacacagtttctcatctgtaaaatggggataatatgacttacctcaaagattattatgaccattaagtaaaataaagtatgtgaagcatttagtaaagtgcatgacatatggtaaatatttgctaaatgccagtacttttaaaaagaggtaattcatccgattcttcatcacccatgctgtttattactcagtttactgagtgctttaacaagcagggtcccagttaatcccaacgcccaccccctagagggcacattcttttccctattctgagctgagaagccatgctggcaaggtgatgcgacctgcttgaggtggcccaggtagtggcagggaggagaggtctgaaaggcaggtctcctggcctcatctggggtgactttccctacatcaagccttagtctctcctacaaagtcatcttggaagtcactgaataaggggatctggactttttagaatgtggcagtataaaataatatggaattctaaaaatgagtgtggttgtctaatgtgattggtaaacagcaggaccaggggagtggggggcaagacaggtgtcaacgcagcagacatgaagggtgcactctgctgggtacagatctgccctcactggacccgagaatggtgcttccttaggtctgcatccctgtcctagtcttgcacgtaggctctgcagtcacgcttaagaatgcctgatcaatggcagcttctggaaagactgcacaacctttaaaagtgccagctttgaaatgcatccccatctaggtgtcttagttctaagagtttttatttatttaatttttatgtttttaagatcagagcttagccagactgagcagttgggttcccctgaaagtggtggtggtagattgggaggtgatcccaggaagcagatctgaaggagaggggacagtgagatgggaaaccaggagaagccagcaggagagacagtattgaggccactgctgtgattcctctggacctctgaagaggtctacagaatgcctcccaaatttgtccctgaaggacaggaggctggagagcttgtctgcctgcaagtgttccctgagcagtaacttctggatacctggggaatatttgcatgaaggctgaggggacatccatggtgctggcgaaggctccaaggtgggaaggagcaagatggaaacaggaggaggagagcctgagctcctgcggagtgtccatcccagttcaggctaaaaatcagtggtggatcaacaggatctgtcacgggtgctaatggcaaagccaagagggtttttctgcatctcataaaaggtaaagggtaaaagttacaagacaaggaaatagatgtgaaaaagaatcaatttgcgggtacaccattcatgaatcaataacttttgctaatcaatcctagttggttaaaaagatctttttgaccaagattcacccactagattccataggcattaagaatccagctcagaggtagagtaagctgcctgtgtgatttcaaggacctcgtgtggtcttgtgccccaaactaccttcttacctgccctggagttacttaaaatccttgtcttacagatggaccctttgcattgggaaacctacttcccaatgctcatgtgttcatttacattgtcattcatcaagaaatagttagtgagaacctactgggtgccagggaccaagcatagggactatagtgtggtcaaaataggaagaggagaggtaagaatgggtatgtttgaagagcttacagtatacataggaaacaaggaaatacacatgtgaaaacctttatcattaaaaggcaaactctgattaaatgctaagagagtgtaacagagtcagacaagtgcgacgggaatgtagagggaggttttcagaagactggatttgccaagaaaggctgttgggagggagtgagttttgtcctgagcctggaaagatgtgcatagtctttccacagttatttctctaaccacacaagcaatctgcctcttttgtttttcttccagactaaacctttcaaggtacaaaaataaatccaagagtatggcattaatagccatgttatgatcttaaacctttggttgccttgcaaaagaaaaaaaacccatccccttactgctggaaatcacatcgctggcttacctggaagttgttcatgaatgaacaacccttgctaatcactctggtcaatatttatcataggtacattttacaagatgaattctgtcaccagtgttggcagcttctcaccaagtcccaccagcagctgcaaatattcattaataatattttgtttgggttcccacttgccactttccatcctcctgcttcataagtatgaacagcatcattaccaagtggcgcccacagaatggaacacaaaggcaacttggaaattttaatgaaaacagatgttgagaaatgccattatcccatgcacgctacaataaatagcattaacatttctaagtgacaggcctctgaattggactgcaaggagctcacatttacaattaaatgagggacttatccttttgcatccctggattctacaggtggctcggtgacagtcatctcttagtgtttcgattttagagcggctgttaagagccagctaagcagggattggacaggcaggcacttaggaaggtgttcgtgccagacgcattcattgtctaactgcctggatgcaaaactaacttagcatagcagctgaatgtgaaagctcttgaaatgatttcttctcaaatagtgcactccctgtgccaaggaggggtatcattgtttatgtcactaatgactacatcctgggcctccatgcattttgtaacccctgttcctttattagagcaatcagaaaaaagatcacataattaccaagatgttgctttatgggcaaggggtacggccacatatgccttcattgatgtgaataataccaccctgggcattactatcacccagatttcacagatgctaaacccccagcatagcagttaggagcatggactgtggatcataggagattggggttgaagcctggcactgctacttattagctcttggttctcaagcaaattgtttattttgtatgggcctcactgtctgcacctataaaacagggacagtgatatttactttcaggatgttgggtaagtatcaaatacccggcatgatgctcactgatagctgttggcttaggctcaattttgaggtcactattatcccacctattcactggtgtgagatcaccttcaccaaggtaatgttccatgaggacggtgatggccagagaaatgttggactgaatcagggcacagctttcttggaggctatgctcaatatttattgtcaatctctctgcctctctctgtctctctttctctctcttaagtcagtctctctgtctctctctatctctctctctttctctctctctctctctttacccaaccacttttcttttgaatagccatcccagacatcaggtaaaccttgccctgactgaaagcattctttgaaccactttcttcaagcaaataggtacatttaattctaagaggaccaagacaccttagaagcaatacatggaaacctccttaattgactcagcaattgcagaatgagtccctgagtgacttttaccccaaatttagaagttggaaaggggtcacttacaacagaaaatatgtattttctagtttttttttgaagtatacttggcctatagtatttcctgaggggatcctaatgcctttctattaaagcatgaacccgaagttgtaaatttagagaaacaatttgaggtgagggtttgacataacagatggccaagggactaatgacaagatcatactcttggctgagcatttggaatgtctcattatttgtaaaacattgtttagaaattgccttcctggcatagaactggttgacacacagatattaatgcatctaaccctctaaactgtacagataatgtgcttcttaagtctttatatttaattggctttatactacttaaatattggaaactgaaaaattcaatgttatttccttatcaagtatttctgcctttacacttttaagatgaggaaaatgagccacatgtcccagattccacaacaagagggagtccaaatgggacaatagggtcaagttattctcacagttgacagcacataaggatgatcctaggtgcacacactgtgtgaacagacattcctccctttggctcagtgctgggttaaacgtgcacactgagcgtctactagtgtaaggccaaggggtcaatgcatgtttgctttgaaagtgaatcgctcacaatgattacacgccagggagataaatgtgatggaggaaataaacaaacatgtgaaagttataatagctttaaaataaacctgttcctagaaggagacccctggaaatgcttgtacataaaggcaacctcctccctttcccagagctgagactatcgtgaggaaagcttgaagcgggactgtatttgaagacagcaggttccttgcatgttcaaaaccactcagagctagtgctctgtatctcattatggcagagccagatcgcgagataagcttgtgctgccacaatattactgttgcaaatgtgtggtcctgaagggtcttctttggaagggctctgctctcagaaatggccttggacttgcacgctgggaatgttttcatgagcggacatagattttgaaagggtcagtgtggctcaggaggcagcaactggagaaatagaaaacctactcctttttggtctggacgcctttcttgtgcttcgattcttcaaggatctaacagtgtttgtttcgtgtttctgtttggtgtgcagacggcatattccctttaacatggatttgttcgagtagacttcactatggtgcacagatcaagctatgttaaaataacgttaaaggtctgcactgaagcaatctgaagcagagaattccgcgtttcaggctgccacaccacctttaaatcaacggaatgtgtccgtgtgcggctgtccatagactcttctcactgctgttatcctcataataggatcattcaggttctcttatctggtctcctagatgcttgtctccaactatttcaaacagaagtgatttgttacccagcaccaccctacttcctgcaagaggcacaaggatgaagcaagcttgctctaatggggacccagttttccctgtcctcagttaagtattttatttacagagctaatgagcccttagaagcatgaaataggcacacccacacattacaaaaaggcacacacaagtgcaagttaaaataatttatagtagactggattcactggtggctctgagaccagtttgcccactgcaggtctgcgcagccagatgcaaccctgttgacagagatgaatttgatcacctccacctgcacaccttttgctgtattagccaagtgtgtgtttctttatccactcatctgtggctcccacttaactggcaccctttgaatatcagcagccctccctttggagagccagggaatgggagtcacaaaagtgtttcctcatgctgaaacatgaaaattggaatttctttatgaagacagttggtgatgtgctaatatgtacaatgaatgtatggcctcacacctttagcccccgagtgctgcatgtctccaggtaggcagacaggctgcagacacacacagctccctgctgctgttcaacaaatgctgatttcaaatcacacattgcccatcttcctgagggtcacatttctctttgctcattgtttttgcaggtctgattaagtcctatattcctgaaaatgaggttcagcctatatctgactccagatttatgagggagaattaacaccctgctgcttcctaaagctttattcccttgcaagtctacgttttgtttcagcctttggagttgaccaccttttcttgcaacttctgttgctctcagcgtccctgtctccaaatgcattgacccaaatgtaccagtgcttgggagaaagtttgtcttctattcatttaagattctttttctactttataattatgtaccaggaatagcctaaatatcaccaaaatgtaacctactgcaatacataaagaaatttaagttgcagtttgaggttcgcctctagttcctggaggcactttttagtgctttctgatcccagcacattatctctgttttgcaagctgggaggtgaggttgtcataggtcatttggcccagaatttgggtgggcctttgatttctttccagggcttactttccacacaactgcagccaccagaatgagtcagagctaggctgaaactattaatcggtatcgtggttaacatcttatccaatttgggcctaagagaaaagcctgactcacagataaaatgtggaagttatttgccttttcagaagccccaagaatcctttctatcagactggctcccggcaggaaagagaaaaaactgatgacattggcgatcatctcatctgctcactattgaggaaaaattagaaatcagatcactcaagagcactgtgaatgccgtgacaaaaaattattttgagatgcgattggtttgaaattctgacgtctaagagtcttgccctatctgatttgtaaagaagagaattctcagaacaggagtctcagcaacatccttgaaggccttcctcaccggcgcacctcatgctggactgcatagaatggcactgccaaagcactctcatctgtgcagctggccctgcggccctggcctgtgccaccattccagacacacaaggaatgcaccacagctggcacataattagaagctcacagcaaacaaatcattgcttttttgtcagtgttcctcctactgaccatgctcagagcgtggcagctccacccacgtgccaacaaacacaggacaacaaacagatatagggggaaacaacccaggtgcctccagttgtgtgttttgcagtggtttccctgccacttccctactttccagaacataattttgtttgaaattttctgtttctaccatcgtggagtttcccagtgaaaggcctgtgattaatcctcagtgagttgaattctcctgaagacttatatttaataatgacaccccatgcagaaaacaattcaaaacaaagaagagctgctttaggctctatacctcccagggcttgggaataattgtctcctataaacatcactgacatgcccaagaaggtatgtggcacttgctcaggtttaagaaggttctttgaccccttgtggatgctaaggtatagccaaggaataaataggctggtagaaactttaacaatgagtgatgtcctgaacttgaatgtaggaaaagaattacattaaaacaaaccataagtcagccagaaaagaaaagcagagcagccagaaagattgaagctccttgcaaatccaaagatggacttccctatcaaattttaaacaaacacaactaaaatttatgaaatgcccactacgtgtttgatcctatatgtgctgagtattggaggcagaatgagaattttgatgtggtccctagccccaaggaatttataatatcatcagtgtgaacagaggcatggacaaagtgctatgggggctcagagggggacacagattctacatgaaggagtgtacctaggagatgggtattgaagtgtggtgttgtaaagaatataatcccctaaagaggtctggcttttgccagtacctttgctagtgtctctagtgccttcctttgcctaggggatttggttcacacttggatagtctagtaatgcgatttagggtgggggctttggctctcgaggcaccagtgcactagagactgagatcaaccatatgggcaatcaatcaatcaagcttgcctctgtagtggggccccagtaacaactctgaacacggaggttcaggtaagctgccccgtctttgacgatacttggtatgaattgttacacattgataccaggaaagtaacatgtcctgactccaggggaagaagatggacaaagctctgcattctgtacttctccagatgctttcctgtgttcttcttcctgtagcttattttaatcatttccccacaataaaccttaacggtgcaaacaatagttttcagtcagttctgtgagtacttctcaaaaattatgaaacctgacagtggcttggggacccttttgcccttgcagttgatgtcagaagtaatgtggtctcttgagagacctattcattctgatggttcagttggcataactcacacaaagatgccacaggaaaactactcaatctgatacctttaaggttcctccctgatataaatcctgactccaatgaagccttgataaacagcctttgtgcccttaccaggattctaaagtatatgataagggtctgagccaagccaatatacggaagatgaacagagtgcctgaacttaaactaaacagttcaaaacatctttactgtattgacaatctggttaaaggtgcctacctgggactcctagaggataaagttctttttctttatcttatttaccaaatgaaacaatgtggtagcaagaaagccaactttctgttgtgcatatgacttgtggagagaagagaaaatgttgagaattttttccttaactcctcattgcagaatgagtcaataaaagagttatcatctcctagtgcacaaggtggacgttatccagggggatgaagcatgcaagtgttgcatggtgagatttgacatagggctgcatcctccaggaagctttccctgaacctggtggtcatggaagcctcacagatgttcgcatgacatcctgtgcctgactctgctgtagctcttcttacagaacaacaaacttatttgtgtgctgccttctaacagaacctgagacccctaatggttgggtcagtgtggtccttgctttggtattttcagtccctcagacatttatgggcctgacccatagaagatatttgttaagtatttttttggggggcggggggttgaatgaatgaactaacaaacagcttcagagtagcgtggtttagaggaaagaatagaacttttggattaaaaagccagttgggttcaaatccaagcttggtctttaacaagtgtgtggccttgggtaaatgataacttcatctaaaatccagtttattcaactgtgaaataggtttaataaaaccagccttagaaccctgagggagacaatacatgtaagaacacttgctctgtgtctgacagctagtaaatgttcaatacaaattaatctcctttctttttccttgagtacaaagaagaaaattatcaaatatagctgagataatatttcaaaactctgaattcaaaactatgaacttgttagataaggacatgtctagactcagagtggaagagaaacctggtgaattggtgggtaggagtctctatcatggaattacttccacaataattacgagggaatcggatcttgtctaggacacaggtccagatttaaaagaactcctcttcccacctcttccaatcctcgctacatccaggaacttactctgctgtgaaagtgtcacagcaacacagggaataatgactccatctcctctgaactgaagcataggtaggctaactaaaagtaattttacaaaagatgtcagtggtctggcaacggtacctcagtgacaaactattgtgattaaaggtgattttgtcaaagcataacactacctctcacaatggaagctttgtttatttcacatgggacagcaacttgctatccatttctagcagctcgcagtctatgtccaggcatacatcctatctctctacactcctaaagccccaaagaactgccatttacagaaataggtctaggatataatctgtagttaaatgcatagttgatttatcattatcttgggttatttggaattcacgttatttatattactaatcctgtccccagacctgtaagtcattgcccatcatccctctaacaaataataataacaaaaaatctccctcaacattatatttggacatcatctgtctgaaaggtaataagatacagcaactacaatgattgaaatgaagggaaaggattgttaatataatagaggtttctactgggcatgctttaaatcaatgtgcagaagcaatttgaacgacccatcctgtcatcatgtttaaaatacattgatttctctctttctttttcccccttgtggtttttatctcttaggttatttttccccttcctgtgaatttggatagcgagccaaaggaaaagaaacttcaacaagaagactggctcaaatcactctagggccagactgcaccttctataacatttctaataaatcatggggaaaaagaaatctctgccatagtggcacatttgacaaattgaaattaaattttgccaactctggagaaaccaagataacctgctttgatatttcttccctgttaatagttaatgggtaagaggggacatttgaggtttctgttttttaaagcgcctccctctgatcaagtgtgattctcaaaaccctgagtccatattcagcatggagtatgagttcaagggctaacaataaatatggatatttttgcatatagatgtatatgtatttttttcctttaattctgaaattattatctcagacagtggtaaatggaattttttgctagcagtgaattttcagtgttatcagctgtcaggttggaaaaatgtatggcagtaataaaggggggaaatatatgatccataaataaagaaaaacgggacttgtttggcatgataaagttttaatgcctctaggtagcaaagtctccaaacaaattcccttcctttaaatcttatgctcacttcagattgtgtctctcacattcctgctcccaggcctgtaaacagtgctgtggctggagagacctgcataccaaggaagaagaggtactgcatgggctgcctccaagggaggacttggcttttcttcttctgtacgggtcagggtgaagagtatgtcaagcctctagccagcgatgagccatgaaaaagtttttcacagaaacagcgtccatggagagcgcctttgtgcctgtatttctagaaatttccatatgctgctgaaaaacaatgatcaagatcatcaacatgtattgatcatgtacaacagaccatagtcaaggttgggtgcagcaatactggggtgaaggcacctgccttcagagagctcattgtcttttgggggaggaagataagacaccctatgaggctgctgaaatagcctagaatagtgtttacatgcaacacgtggatgaagattattagttgaataaatgaatataaatgtaaggttggcattaattaactgggaatggaaagggcattgaaaagttgtgttttgttttgttggggggctggaggaaaaggggttggatgtgtatcaatgcaggaaatgactcctgatcagggaggagaggaggaaatgccgcattggttccagaaagctgttcttcaacatcactttatattacatacattttgtttttaatgactggtttgccttgggtaaaaagacaatgatgagtcagcatattacaggcaaacaatcgaggccattgtgtgaaggtctttgctgtggtggaagtgtgttatctccctgaaacatccaggcgggttcctctgctgtcactgtacaatttgcatgcttcggtaatgttttatgtattacgctacttatacgctaaaatgtacatgcacgctcctgcaaatttaggtaaattatgaataaattaaatcttatctaaataaacaagtgtctttttgaaccaaaatgcaagctgtcatgaatatttaagtggacaaggatgaatcctcttcctgctgcacttcgtacagagtgcattctatactcttgattgcaggaaggaaagtgtacacagctagagaaacataatcgacttctcactagggacatgaacgttgagaaatctggcctggcagagcgatacattaaaaaataagattcattatggaaattaagttatatgggtgtctcctgaccctggtaatctctgccttttcacactatattggagatgcagagtttgagcacagagttattattttgatctttcttttagtggaaagaggcatctcatgcatatttcaactctagaacctaaggaaatccggactagttgcttgttggtttatatatgatttctgtaggaagctcatgagcataaggattggctcattgaaaatcaaagatttcaagaacattcagcgcccagggtcaagtttaaggatctcagttaatgttttcaggccacatctccttagtcttattttccattactcataggatctgagaatctgagttgaaagggcagttggggatggagttagaaaataatcaacagggaagttttataaacttcctccaaaaggccacgctttcccacctacacatattagtcccccttcatccaaggtttcacgctccgatttcagttctctcacaactgtggactgaaaatatatgtgggaaattctaggaacaaaaaattcctaagttttaaatcgcatgccattctgggtagcgtgataaaatcttgtgcagaacagctccatcctgctcagaccttgaatcatccctctgtgcaatttctccaggctgtctatgctatttgcctgtaagtcactcagtagccctctgggttttcaggttgaatttcacagtatcacagtgactgtgatcaagtaacttttattttacctaataatggctccaaagagcaagattagtgatgctggcaatttggagatgccaaaaagaagctgtaaagtgctttctataagtgaaaaagtgaaagttctcaaatgaggaaggaaaaaattatacactcaggttgctaacatctatagtaagaatgaatcttctatttgtgaaactgtcaacagcatattgttattgttctattatgtgattgttgttaatctcttactgtgcctcatttataaattaagttttatcgtaggtatgtatggataggaaagaacatagtgtatatagggtttgggactatctgtggtttcaggcatcccctgggggttgtgaaacatatcccctgcagataaaggggtctactgtcctcttgcatattctgttccttctgtctagagggccctcatcctgtttgtctggaacaactacagctttcttgcttcaagacttgggtcttctccttcatggagccttgtctgagctccctaggcagagcgaggcgtgttaacctagttggaagccccaggagggcaaggcttatgtctgcttcttctccacatatccccagcagccagcacaatgccaggcatgtagaaggcgttcaaaaataaatccctcctaaaaaaagactctcctgtggtgtctgagcttattgaataaatccctctatggcaccataagattgctgtaattcattattcgtttacaggttagtctggcccaatggatggctgtgccctcaaaggcagaggtccatcttattgatcttgtatccccaggaccaagttccataagtatttgacaaatgtttgtttattgaaagaaagttatatccattacattgcaattaattgcagcaacaaacctgagacttattagctcctgtgcaccctacagcgtcatcttcatcatagtcagtgtctaggcatccgctttcattgttgttggcagtggtcttctgaatctcaacaggccccgaaggtcttagtcatgctcacctacccaatagttggttttttcctacttaaatcctccaggaaaagacaaaggcttcatacatcgtcaaggtggaccacggggttgaaataaggaagcacaatagcagtcctagggggtaaccttgcttcccgtttttttctccagctctggatcagccctgggcaggccctgcaccaggtgaggatggggtagggtgaggagtggatgcgtgtccactgagctttgcagcagagaagaggcacggcagaggagagaagagagcgctttcagaggaggtggtgaggagggaaggggagccgctgagcctgcctgtgagtggttgctgttcggagggccagctctgtcaggagctctatctggactctgcactcaggacaacagacagagacagcacattgatatcaggtccagtctgtccctttccacatggatgcccctgctcaatcggccatgtatgaacttctaagcaatttctatgagctcattttagaatgtaactctctttgccatgaaaaaaacctcccttcatatcaagtctaaatctctcagggttctgtaatgtaaatcctcttctatctactctgttctcagtggagagggctgacacctggccccttccttctcaccataagcatatatccactgcaagaccatgaccatattggggttcatcctcttctttttcagactaagtcccccaatatccttcatccaccttcacttgggacctcatcctaggaacacagtgctcatgtgggacagatggtcttgtctttgcagagcttcagggtcagacctggcttggcctacacgtgttggtttataaaatgaaactgaagacctcattcccactgcaggtgatatggaggtgatggagcaacaattaggggctgtaatgggccagttaatgttattggtaatgaggacacatttactcacagaaagtggactgccacctgccaaatggccaatgtccctttgagccctgtcatagacagaacactgggccgaccatgagtttgactcaatatcatatcctttcagtcagactgagagctggcctctccatcggagagaatatgggtcaagttcagaaggaccaagcatcacagatttttttttttctttctgtaaatgcagggcctttacttggtgctgtgaggaacttgtgagttctgagttcatctgatccctggactccctgcctaactgaacacaatccaaagtcaaactgaggggctggctcacatttctatataacagtgtcctcgttctcacctgccctttaggacaatatcctgcattatcagagcagcaagtgatgacacagagcagctctctgggaggaagatacggtctctgagcaagacaaaaacaagaaaaaaacactaatggaaaacccactgatgcagttcaaactgtgtccccatcagtatgaaaggcaagtttgcagggctggagacaggctttgatcttgcctcgaagtcaaaggcaatctggaagatctccaagtgtaaaggtgcatgagaaatgcttccagtgagtgagatttcatgggaggttggagtgggtgagctcactcactctgccgtatatcctactggggagaaactccattcccaaagtcctgctttcaattgtgatctgcccagtctcgtcccacagagacttccagcctagtcagctatgcaatcaaaccaaagcatgcctaagcgataactggagtcccgacggctagtgagtgggaccgtcagaggtgtttgaaccagagcaactccatcctgaataggggctgggtaaaataaggctaacttatttagccttaaaataattttcccagtaagttaatcacagaatgagataggaggtcagcacaagatacaggtcatggagactttgctgataaaacagcttacagtaaaaaagctggctaaaacccaccaaaatcaagatggcaacaagaatgacctctggtcatcctcactgctacactcccacccgtgccatgacagtttacaaatgccatggcaacatcagaaagttaccctacctgggctcaaaaggggaggcatgaataatccccttgtttagcatattgtcaagaaataatcataaaaatgggcaaccagcagccctcagaactgctgtctatggagtagccattcttttgttcctttactttcttaataaacttgctttcactttatgctctggactcgccctgaattctttcttgtacgagatccaagaaccctcttttggagtctggatggggacccctttccagtaacatcttcctggtaacccaggtgggacaatagtgaggaaacccccaatccaaaggctaactttgggtaagtggtgggggtccggtaacatctttctggtgaccacagaagagacaatactgagaaaaccccgacccaaatgctaactttgggtaagtggtggggtccggtgacatctttctggtgaccacagaagggacaatactaaggaaaccccagacccaaaggctaaccttgggtaagcagtgtggtgtggtaacatctttctggcaaaccatggaagggacgatactgaggagacctccaacccaaaggaaatagactgcagcactgattggcagattttgggtaggtggtggggtacccagataaaggatgggattgggttaggggcccaacttagggcagttggagtctctcctaagacagaaaccattaaaggctcctctccataaaaggcaaggacacttgaccgaacttgagtttgaggcccaacttaggaaggttagagtccttcctaagatttagggaattagaggcctctcttggtaaagtctctctcagctaagaatgggtttggcactataggatgttaactgctattctctttggattattttacttggcactctttgctgaaggctatgggtgacagagttaagcatgtataggatcttgggacatggggagctttttcctccctaaaaaagggaaacttgagagccaacaggtctgctggaagagatccttttgctaccaacaagcagccacctgaaattgtcagtgttgttgcaatggtgggtcttactctggcctctctgagctctctgccttccccaccctgctgtgcacaatgcttttttctctttctctttttgatcttttctgttactcagggcaaccatcttggccagcgaccacaagttgaaactcctggtcagagggtggattaacgatgatggggcccaactgggggcaagtttgggccttacaagtttgatattgagtactaagcagagtgccagtgtctatgttttgtcacatgtattttgctctggaaaaatggaaaaagataactttctcttatgttgcagcttggcacccagggctatggtgcagtgagctgggtcactagggctgctcagggaaagggaacccagaagcctggcatgctggcaaaagggtaagaacttcttaccaatcagacttctgggctctctctctttgtgcaaactggttgaatgaatggtaaaaatcactgtttatctcctctgttcaaagtttttattaatgagaaaaagaattcgtgaggctaatcttaagctgcagggaatctggtatgctctgtgtgtcttttttgtactgttttgtcataaagaggggtaccttaggatagaatgagggcctaggaccccaaaaacctgctgttcaagatggcccggaaaactggtcagccatgtccttagaagcttgatcttgttaccatgtggccgtcctttctcttttcagaatggcagcctgggttcatggctcaattcccagcttagagaatgggttattcttggcttaatatctgtttgacctttaccatttgtttattctcttcccttctatgaattaccttaaattttcctttttctgagcaaagaaatgttggctgtttggcatggctaaagttggataaaaaaagatttaaaggactttttaaaagagtgctatagttaaaagtcatcttaattaaaagcagatattcaggctccaacggcctgtagttccttgggaaaaacagaggaggtaccacagaccttgtttggggggaaaaaacacacaaaaaaaacacaaaaaacctctgttttcctcatggaacctcaggaattaaaagtggatcaattcctctcaaaatctaaggttctcttctgttttgcattgtgttatctgatggttttaacttttggggatatcagaaattactttgcattatgagagagctttggtgtgtagtaactaggtaggaaacgtacttttgggaatgggctgattccctttttgggattcaggatctggtgtaaaaatgggtaccttaatttctggagatctgtattgccttccagttgtgcctgcttattaggccctagaaacttcatgctttaaagagaaacttaaaaactggcaaatgaaaaatcttacaactactggatcttcttccatctgtctgtgcatttatatgttatgtgtgtgatgtttatatatgaaagagctttaattaattcgtttaaaaataatagaagcttaaatcaaatattttaacagaaaaataaaaattatcatgccttttaggtcacatgacttcagtaatctttgggaaataaaaatcactttaaagattgttggtaaaataaagacatttggtcttctgtctggtgtcctaggctccacacctagtacataatgaaaatcccttacttaccacagttttcaccaaaagtaaaaattgctaagagttaacattgtgacacgtatttgagactactaaaaacaaaacaaaacaaaacagacaaacaaaaaaaaatttcacacgcaaggtgtataaagaaagtaaaatgcatttttggtaaaagattataagaagctgtgagaatatggatttcttacttaagtttggaggtttaaaggattgttttaagttagataagataaaactgaacagttgaacaaattgtgaaagatttgtaaaaaaattagtcttgtaaaaaaattgtgtatgtggacatattggctaaagttaagggggtattatacagtttttccataaattaaacatttgaataaaagcataatgagtttttcttagagtgaaaagaaaacctgcctataatctgctctttaacaaaattacaaagggttataaaaggtttatgaagatcttaccttatggtcaggcattacaattggatagatttatctataagcttttattaagaatagggtttaacagtaatagtataccaacggaagggtgaaatttggcttttttggtataaaaatcatacaggaagcattgtcaaaaatgaaatggtatttggctttctttgggctgtatttgtataaatatcttactggtatgtgttccaaaattatgtgtaactcctataattctgatagcacttggtgtagattatcagtaataataagaattgttacataaaatcattgtatgccacagaggtaaccacatttctttgttagtcatgtttttgactgtggctgccctaaacattttgtcatccacagacaattgttgtcttgttttaatcctcttcaaaaggtggcttataaaaaaagatggcttataatcaatataggaccttaacaggtgctcttaaatgcaagtttctgataactttggagattgtgacactagaatggaggaacaaactttcaggactcatggagagctgaaatgttcatgaacatcaagcagaataggagttaactgcatggactaaactaatagtaaactaatagaagtctgaagtaatcttttttaactttttgtttaaaacattgctaatcctttgctttgtttttcagagttaagaaaactcttctgttgagctatttacagcttgaagcaattgagtaaagtacactcctgtaaacagaatttggaacacatttgtttccctctacctgattgcttcagaatttggaagttactcgtgttcttaacttatggcaatatagttatttacataagtgtaataagaatctattttcttttgtaacaggacacaattggagaaactggttattttaccatgtctctgactgaaatggtgtgctttctttaaggaatcaaacttatagagccaataaaagccccttgggaaactggcctcataccttctctacacagtccctgtacagggttcctgacctgtggtaagtaaagaatgtcactttctgacatgtctaggagcccaggtcatcttgggacctcaacaggagagtaacttacccaactcataggtatttgagggtacaaacccaccgcagggcttggctttttaaaaagccttatctgagattacttatggaacagagtttcatcaaagccaattttaaaagcctatgtgaaataattattcttgctgcactttatacaaataatcaggccaagtaaaatcaagtaaatcagtctcaccatgatttgtctttagtgaaaatggaaaattggagagagaaaaattatgtttcaagaactatggtatacctgttattaaattccagtctcatcagttgtttgtttttttcctgcaatgtaggctgaccccgcttattcctgtaaaccaaccagtaatctcaggctgctactcagaagaaacaagaggtctgagtaatgtaaaaatctggattggatcaatattctaatcctggacatatattggaatcaactagcaactctatatcagcttggttcccaacagttgcccagttcatggaaagccttctaatttagtttacatgggataattttgcttattttgttatattgctgttggactctctgtgtaggaatgcagaataagcttactcaatgttttcttaaattgaatgcttatcactcttccagatatcaccttttgttggaactcaagagttataaatggcccttgacataccaaagctttctgactgagctcctctctaccctaaatacaagagaccttcatagtttggcaaaaatatcatcacctctattcagcatgaagaagttacagaagatggatcttcgttcctctacaacccttaggattaagagttctcttataaaagggagttgggaaatgtcagaggtgtttaaaacagagccactccatcttgaataggggctggataaaataaggctaagacctgtggggctgcattcccagtaagtgaaggcattcttaatcacagagtgagataggaggtcgacacaagaggcaggtcataaagaccttgttgataaaacagtttgtgttaaagaagccagccaaaacccactcaaaccaagatgtcgatgagagtgacctctggtcgtcctcactgctacactcccaccagtgccatgacagtttacgaatgccacggcaatgtcaggaagttaccctatacagtctcagaaggggaggcatgaataatccaccccttgtttagcacatcatcaagaaataaccataaaaatgggcaaccagcagcccttggggctgctctacctgtggaatagccattcttttatttctttactttcttagtaaacttgctttcactttactctatggacttgccctgaattctttcttatgtgagatccaagaaccctctctggattgaggcccctttccagtaacaggaccacacagtttgggaaaggaatggggtcccgatggccacctgctcaggtagaggctttctatttctcctgtccctgctgaccggaaatcagctgcagaaggagaaaggcttgggcaacgcagagatgtctagtcacagacatttgactaaagggcggtggggagaacgggcacttgatggtcatgatggggcactacagagaagggaaagagacagaaggtggagacggtgtgaaatgggcagcacccaggagtcacaggtgcggcttttccaatggatgcacctgttgaggatggaggtgcctggacgcacgttcaccatggcacaggcagcagtgaggtccatccattttcaggagactgacagaataccagcagcctgtctcagaactttacttaataaatcaaagctgacaactcccaaaatggtatgaaaacgctttttagtgtccatgaccggcatacattgtattcatttcactttctgaaataagagttgaaccataatcacaaacaatccattcttgtcaggtatcaacagtacatctttctttagccaccaaagcgggggtccctgtaatctggcactgcctgggcctggggtgaaggagtcagagtgaaacagcaaacatcgcggagacaacagctcccatctgcagagcactttggaatttccaaagatatttcacccacatgatctcttttgagcaccatgaccaccctatcagatggattttattaacttcccttttcacaagggcaaatgcaggtggagagggcatagctgacactctatgcacaccacagttgttgtggtgggcagccctgtgtagtgggagaggcttgccctcagacacctgccctcccagtgcttgcgagtgagctgctgggtgggctccctttgttggcagctctaggccttgagttggggtagaggcaaagctaacccagacctgtcctccaggcctgtcctcataggttctcccaactcctcctctatccaaactgctgcctcttttttaacactttgcttcagggtagggttccctgtgccttccacagggatcatgagctaatcataaaaaccactaagggtcaaggggcaagagtgagtggcagccatctttgctgccaacagaggaagactttaccaggaacttcaaaaggcagcgttccagccactgcttatccccaaaataaaaggaaggactcaactggttgaaatgtcagacttgggagcctcatctatgaggggcctcagctgtgcaggggacctgaggataatagattaggatcctggagtactctgcctgggagaaaccttcaactggttcactaggagatcccatatccacagccaggccaaagcagcaatcagaacaaaagactaacagttaccggacaggcccaagtcacacatacactgcaaaataaaccttaactccaatcaagtaagaggcagagcagcactagctgttgaaagttcagccaattaatatggtcagcccacctgggtctcactaggcactctctgaaggtgatagggccttgaactgtccctggtggggttgggtaggaaaagaattctgtataaagaaggctttgatctcagatcattctgccaatgtccaattacacttaggacccgactgccattgtgtgaatgtgtattgtgctttaaggtgacatagtgaatgaaagagccatattttggtagagtgtgtgggtcacttcacttagatgatgtgctggtggttcactggaaaatgtctgagaccagaggtcagagcatcacttgtacactactggtcctgaaaagcctattcagacatttggggtgcatatgtgactgagtccatgcagggaaggtacctctcttgattgctgctttctcagcgatatcaccttggtgctatatgtgcaaatatttacatgtaaatgaaaggatgtgatttattgttgaaattcctaaggggaatgccatgggaggcactctggagcaattatctactccccgactcttacgccacacagcgtgtttcagacagagagaacatctcgaatgtcctctctgcccggccctgggaaccacatcctgaacccccaccaagaccaaggtgtctttattcaggccaccttctctatcttccagtgtggttttctgtctttcctaaactgcaggatgcaaattgtggactcaggcttccagtgaaagcgattaagacatcctggcagggaggcaagctctttatttgcccttttttgatgggacagcataaagctggatcatttctctgagctccctggaggccatcaaagtctacatgggcagatggagcatataaacaagccgggcaactcactagctgctgtaaagcagaccgtggctcctctacctcgaggagagtagggcgggtggaagtcaggcacagaggcctttgcacctgcagcctccttgcctgaccctactggctttccatttgccactcttccatgagcacatgaattcagaaggttggggctataaccttttttttttttttttttttttgagacagagtctagcactgtctcccaggccggagtgcagtggtgcgatctcggctcactgcaacctctgcctcccgggttcaagcgattctcctgcctcagcctcccaagtagctgggaccacaggtgcgtgccaccacgcccagctaatgtttgtatttttagtagagatggggtttcacaatgttggccaggatggtctcgatctttcgacctcatgatccacccacctcagcctcccaaagcactgggattacaggcgtgagccaccagcgcccggccgatcatggctataatcttagctctactatttattacttatctagcctaggaccaatcatctaatctctcttaagcccatttgcataacaaaatgttattcataccagtttgcatggtaggaaaggaggaaactgactacttctgagtaccaactatgtgccatatatatagtatctggagaccgtaagtcctctgggaaggtcaaccagcattgtgactccaaagcttgagctatctctactttaatatgatgagagctgggagcatcatgatgaggtgagcaaagaaagctcttgagaagctccaaatccatatacaaatttaagacattacgtctgagctgaaaacatgtgttgtgcttttatcacagtaattttcaaaggagaaactgaggcatggggtcaaggcactgtactaaaggtcccccggcaaggcaatggcaggctcttaaccctgggatctttgctcttggcttcttgtccagctctggaaggcaggtggactccctgagcagaggctgcaccatcctcagctggatgggaaccaagacgccctcagggaatgtccagggagcagaagctctttctgtgtcatttgccgagttccttgggatgttatttctccggggaaacctgttattccttcctagagtcactaaaagctcacagcaggaacttcatgtaacttaagttttttgtgtcgtgcaagtttttttgtgttgttgctttttttttaaaatgggaaaaatacttcctttttccaaatgctatcaatttcaatcaaactgtgtatactgctgaaccaaaaaggctgtttaaatcgctgtgtgtgttttttcccttcagtgtctctcaatccttctactagcttctcgaagaattaagatttgatcttttcaaatgtaaattaagcaatttacaaaatatgtattttggcatataggaaacttggctttccaaacaaactggaattttatcgattctatgaactgccatggagttatcttgtggccataatttgaatctctaatatgagactgttttcatttataacaagaagtacattctgcttttatctaacttcaatctccatttctgcatttttaaatgggtaaaagaagtgatgtcagttttaatatgcttttcatgagtttagtttctcaaatgttatttttatcattttgtcaattttacttattactgaaacaatatttgatgccacaaaagaaattgaaataggaaaaacatccacccacagcttccccagcctaagacagctcttcatattcacccatgctctctccaagtttttgacaccctgcatatgcttttatggagttataacaattctgaaaaagtaattctcaaaataagtttcacataaacttaaaaaaaaaacaaaacaaaacttccttgacctcctttcaaggtctccggctcagttttgcataaaacttttctgcatgtttcattctaagtatatgacagggactttacatttcagagattaagaatacagttctcagtgtctagttaatgatattaatagtggggcagaacgtattaataaatacatggtgactgatcttcaaggttaattattcaaccctttgcatcaacaagtagtgcacatgaatcatctcatgggagtctcctcttacagcattcagggaaaagggttctccagtcttgattgtggatcttttttttttctttttagtaaaaacaaagctcctgttaacatatggcctaaactcttccagtaataagtttcttgtgtgtgtgtgtgtgtgtgtgtgtgtgtgtgtatgtggtgtgtggttttttgtttttctatttttctcttaatagttgatacttctttttaaaaattgtgttaaaatgcactaaaataaaatttatgatttaaactattttaatggtagagttcagtggcattaagtacattgtacattcatattattatgcagtatgaatatgccactaccacccatctccagaaagtctgtacccattaaatcctaactcctcatccccattacctccagcccctgacaaccaccttctactttgtctctatgaatttaactactccacggacatcatataagtagaaccatacaacatttgttcttctttgtctggcttatttaacttagcatgtattccaggttcatccatgttgtagcatgggccagaatttccttcctttttaaagctgaattatattctattgtaaatatagaccacattttgtttatccatttgtccattgatagatgatccggttgcttccaccattgactattgtgaataatgttgccatgaacacggatgtacgaacatctgtttcaatctctgttttcaattcctttgggtatatacctggaagtcgaatttctggttcatatggtaattctatgtttaattttttgaggaacctccatattgttttcaacagtggcagcaccattttcacattcttaccaacagtgcacaaagggtccaattcatcctctgcagtcatttcaatctctttctctctacttggaataactagccacagccctcgttatagtccttcacagatatagattcacccttgtctctaagtcgtggctgtggtacagatgtggagtccgaggcacagagctgttcagccccagcccgaaggcccagggcagggcagaggcaggagtcatcccagcggcagtctggctcaggagcctggaaacttcatcatcatcacggtgttagattggctgtcagagaaactgctcttagcccctcctgcaaccttattgatatggtttggatttgcatccccacccaaatctcacatcaaattgtaatcccctatgttgaaggagggccctagtgggaggtgattggatcatgtgggcagattcgcccttgcgttcttgcgatagtaagtgagttctcaggagatctggttgtttaaaagtggggaatgccggctcctgcgccttctctctcttcctccttctccagccatctaagacgtgcctactttccctttgccttctaccatgattttaactttcctgaggcctccccagccatgcttcctggacagcctgcagaattgtgagtcaacaaaacctcttttctttcataaattacccagtctcaggtggttctttatagcaatgtgagaatgaactaatacacttatttttcaaatttgctgttcttccactcagaactgcttcatgaaaagtagcattatcatatgtgtgagacattatcatgtgtgagactcagtgagaggtgaggctctggcagccagatggggcaggcttgcccatcagctccatcaccagcctttccagtcctgagagcttatcctcctttgcttccctggctgtgagtttgggtgaggtctaatgccagacttgacatgaccaacctatgactctaggagatggtctgtgcccttttccctcccaccaccatctctatgccctctgggctccttcatcagggtttctctggacctggtctaggctgtgggcaggcaggaggggacagggcctatggacccagcaggggctacatagggagatttggaggcaccaaaaggtgttcttgcccttgaatttcttgaaaaggacactggagagccccatcttccctctgcctgcagcctagtatttcccaaagttggttcctgggatgaaagtccctaaaatgcacctttcaaaaagggttccaatgctaagtaagtttggggaacactttgtggggtatgtgtctctgcagagccatatgcactttgatatggtaaaggctctggaaaattccacagtaatgaaacctgtggaattaagccacagtatccaccaagatcttcattaaaatacaaacacataaccaggatgggaactaatcaaagataacaatctgtctacctctcagctttgcttctgcattgaaatgttggaacggggaacaagtgaagacaagatggcctttaaattttttttctcacattatttaattaaactacttgatctttctaagtcttcatgttttaaagtatgatttaacgtaaatgtaacacttgctcatgatagaataatcagacaagtataaaattaaaatgaaaaataactcataatctcaacagccagaaataatcactattagcatattgagtattttctgataacatttttctaagtatatatatatatatatatatatatatatatatatatatatgtatatatacacacagacatatattttttttttctttgagaccgagtctcgctctgtcgcccagactggagtgcagtggcgccatctcggctcactgcaagctctgcctcctgggttcaggccattctcctgcctcagcctcctgagtagctgggactacaggcgcccgccaccatgcgcggctaattttttgtatttttagtagccaggatggtctcgatctcctgacctcatgatccactcacctcggcctcccaaagtgctgggattacaggagtgagccactgcgctgggcccatattttgtatttttatgaaatggtgagcatgccagggataacattttatattttgatttttttcttacctaacattatagcatgagcatccagtttaactgagtggaactgtctcctgaaggtttatgagaaagaaggcactcacatttacgtgcacctatgaggtgagagagcatctgcatttgaggccacattttattctcacatcaactttatggtagacatattgcctcctccatacactgaaggacatgaagcccagtggggtgagagggtggagagcacacgatcgatgctcctcccaaccctccaacatctcttctagagtcctgggtgcccagcccacccacctgtgtgccttgctccaatggaccccacctgtgactgtgtgctgtctgctgcccttgggccagcccaggtgcttcaccctcctgcctgccccaacttgcagagaacaggaattgcttggcagtttatttagccaatgattgctgtgggaggatgagtatttgcttagaaagtccaatacactctaagctatatgttacatcctagagcttcccagcaggatcaagctgagactgggactttacttaaaatcacacttctgtttggcatcatccctgtctctattctgcttccctttcttcttcctgtttctcttgggagcatctgcctaggaatccttgctcagggtctgcctctggggattgatctgagactggtatttccttcatggtcatatgtcttaaagcagaagcagcatttccaggacttgaacttaggtcttccagacctcagagtcaaccgtttttctatcacagacccttccttgcctgattccaaaggaatcagccaatgcgtgtgggagaaaagtcttcaggctgtgggggtggggtgggtgaggctgggccctctagctgcctgggatgtgaatggaaggaggactgcaggtggctgtgtgcagtgggaagctcatgaaggatgagaaacctaccgctatcctctgtatacacacaccttggggaaattcactgtgtcgtgcctcagccttgccccagacagccacagggctcagggcacaagctgcagatgaaagaagtaatgggcttaccactttaacatgctggcacccagccaggtccccacttaccgtgtgaactgcctcgccaaatgtgccaggagcctcctgtacgaaggccagagaaatgtgactgtgggctcatgctgggaagcaatttggtccatttcaaccatcatgtcatggcagcagaatacacaaatatagactagacttgtccaggggagcttttctctcattaaccttgaaggatgacgcacatcccgttgacggctgctctggagcctgtgactatgagaggccaggtttgatgaagcaataggacttaaacagcagacattagtgctgccaaatgcatttttcttcttaatacactaaagatccatcataaatactgagaagggtgtgtgtgggagggacagaaaggctgggatgatgtggcagggtgcatatgcttgccattgggtgctgtctgtcgtcagcaaaagagaataatctctcagttctcacctcctaagaagttagcaatctctctgtctctgtctctttttctcctctctctctctctctccacatgcacacacctccagtgtgagttctcctctgccattcacaaggcagactcatattttggctttgatctcataagaggtcagtagcagtgtctgtgatgtgtgtgtgtgtgtggttttctgtatgggttctgtgatcagaagaggggcagaaatgcttgtgatgaaagatgtgtaaacagttctgtgcagagacagctgataggcagtgtcttctgcaaatgatgctaagggaaagactgtcctcaaagccatctcagtcatagtgctatttatggctggagtggcagaacactcttcacctggatgtcaggttgctagaagggacagtggattttcctaggaaaaagattatttcaggaaagaagcatggtttaaacaaggctgaggttctgctcctggctgtggcatttaggagagaagtggcagccgctgagggatgaggactccagctatgtacagggttcctggtttcccacaaattgacttcatgtgctgctgaggcacaaacactctcttaaagaagttctgcaaagataactgttgacctttgctgagctaccttgcaggtagagccttataaaggagactttataatataccaaagagaaagaagccctgtccttggttccaaggatgggaagaggagaggaacacaggctatctgggggtgaaaagtggtaatgataatgaaagcaaatatggaatatattagcttctttaattctcacgatgggcccaagagggagcttctatcattattcccatttttactgaggaggaaactgacacatggcaacttattcaaggtcactgagcaacatttagcagagcttggattggaccaaggcaatctggttccaggggccacattttgaatcatggtgctatacaagccattttataaacaaagagcaactgaactggacaatggatagcagcctcaaaggacaggaggaagccaggccaataggaggaggaggaggggacccccaaactatatctgagctgcaaaagcttgttcataatctaatgagagaagccacacacataaacactcatggaaaaggcttataactctgacaaaaacatacataaattgaattgacattaaaggtaaaactacacctcaactggggaaggaacataggtgtggaaataagtttctccccaaggtttcttcctcttcttcttggaagagaaagtgacctccaaatgaaccaggtttgaggagaggaaggaggatgaaccgagagtccatgaggcagctagggttgcttgttatagcaccaaccttaacctgagtcttgctatttctgtttttggccatggcaacatatcactccttcctacctcaccctcctttctatctctacatatctcagttgaaaaccaatcttttcttttttggaattgtcttcatcatttacttcttttctgctctgatttacctttagagctgtattaactctgacgttctactattgtctgagaagcgtaatctgaaaggggacagacatttttgaccaatagattaagtagcaggaattcaggaagggagtaaggaggataaggagagaaagagggaggatgatattggaattaatttcaatacaacaaacaggtaacgagcatttgtgatgtgcccgttgctggtacttggtgctgggaatataaaagataagttctccaacaccacactgtgagctcccagagggtaggaactgacacttaaatgtgtaatgacatgacaatctgattaaatttaataaaggcgtgggcaatgggtctgggagcacagagaaggttgcctttatttatgtttcaggcagaaaagctgggaaagttatagaagtgatatttaagagcctcaggtgttgggaaggaatttgctgaatgaagaagggaggaagagcattccaggcagaaggaagagtttgagcaaaggaggagaagtgcatgaccttctcaagacgtagtgattgctctgggtgtggccaggcagcaggcggcgtggaggcagaggggccaggcagccaaaggccttggattagggctgaagagttgggacctaccctataaacaacgtatagttgttgaaggtttctagacagaagaatggcttggggggctgtgtgtttgagagacttcttcccaaccacagggtggagaatgggtggcaggccagtgaggaggctcctgccctggtccaaaggagagaggctgagactcttagaatgtccaaggagagggcagaggtacaaatgcaagatggcacccgtggacacattgaaagtttagtgatcctacacttgattcttctcgcagtttcagaaatactacctcctttgtaccactcttggtacgtgccacctcctatacaaagcctctcctggtgctaccagaggcaaacaaattctccctcctttgtgccctcctgctttatgtgtgtagcctttctctctgggttctctagatttattttaatttgtgtactcgttttgtttgttctcacatgggtagggaaaagggcaaagctctggatgtttgaaaacttgttttgtactaaggatattgttcttgattgctgcattgccctgggaaaattaatttacctctttgaaggcttggtgtcatcatttctgggaatgtaacatttaggctgcaggcaggaaaacagcacccatgcaggtgtctgcaagggagagtgaggcagcccagaggttagtaacagtaggcagccaatcccaggctagaggtacaaaggaaggaggtagtatttcctgaactcaggaatcaagaccacccagtgggaactgggaccacccagaagactcagctactctcttagaagtgatacggggcagagaaagagagatgcagtaccctacttctcccatcctctaccctctaaccccttgacagtgccttccgttggctgaacctacacggtagccagttggccaggaggtttgggaggtggagttcacagggaatagtggggaatggatctgagtgtgccaactggcaaatgaccaatataaaaaattcacaaaaagtctctggccctacttatttcacaggatatcagttagaatcaaatgaaatgatacatgtaaaagccctttgtaaattacagagagctatgcaaatgtacgctggtatattcacgttttatctggcagtcaaaaaaatctgcatttagctgttatgaattctctgctgacctggatctgaagtggagtgtggactgactgcttctcgagggatagtccttgaggtgtggacgtccaaaaggctgccagggatgtctgggggcacatggactgtaccgtgtgatacaaaaccttcctgcagaagataagcttctgggcacctgtctctaaacctttcccatcagaccagttgagtgcacatgagcatggctcgtaggcacctgggcatggaaaaggacctctccagctctgcccttcttggcagtgagcagttagcggccctgaggaatgaagccacagccgagtgaaggcgttccatgctgtccaggtgatggagggaggaaattgaaaagacattcaagagtttcctgagctgagctcttcccctagcatcatgctgttcatactacacatgttgttttgctcctgatgataaaggagatgctagggtaatagggctgacgcagttgaaccctgtagtctcttcagccccattaacccacatccacccaaatggattctcagccagtcccattaagacatcctgtcagaaccttcccacgtcatttgcagagtgaagtgaatatcaataaaattgtaacgagtaattatcccagcttcactgactcttactggaaatgaagccagccctctgctgtgggtattgacaaaaactccattcctcctgggagctgcttttcttccgctgggtaaatctgatccatctcagcagataccaggtgtgctagtttaacattcatgggcacatgggcagcaggtttggaaaggggactctagcccctgtcccttctgggcagtgagaagccctgatgaatgaagaggttcactgctctccacgctgcgtcaacagagcgagtgttgcaccaggaggcagggcacctggcttccccagtcactatcgactactcccaccgtccaccctaactccatcaggcctcattattccatctataccacaataggtcctttccagttctggcattctatgagctgagagacagaacagccacagagaaatcaatctgccagagagtgatgcatttgacagtgtagacactcgaggcccggtctacattgccaggcatttgagaagcagacagaatgggagctttgctggcagtttctcaccgtggctttctgaccacagagagcccaagcatcacacctgctctgtggtcatgacagccagcactgggataccagagctgtgagtgacaaggtgttaattcaaggcttagggagtgtgatggttagggactggcccaccctttcctgttctctgcctgctgtctgaaaggctgtcagcacctcctgctgatggctggctgctggtgacttgctgcctgcttcccccacatgaaagtgtggaacacagcacgaaggtgtttctgcagcacctgggctgctggcttggaacgtgctacctgtgggggaagactggaggactgctcagttgctgttctgtgctgggattccagcctcctcttcctggctgctcaggaaaagacagcacaggccaagctggggttccagaagtatgaatatgtggggaggtgggcatgggtgcatgtgagtgtgtgtttgagtgcgtgtgtgtgtttgagtgcgtgtgtgagtgcgtgagtgcgtgtgtgagcgcatgtgtgtgagtgcgtgtgtgagtgtgtgtgtttgagtgcgtgtgtgtgtgagtgcgtgtgtgagtgcgtgtgtgagtgtgagtgcgtgtgtgtttgagtgcgtgtgtgagtgcgtgtgagtgtgtgagtgcatgtgtgagtgtgtttgactgcgtgtgagtgtgtgtttgagtgcgtgtgtgtttgcgtgcgtgtgtgtgtgtttgagtgcgtgtgtgtgtgtttgagtgcgtgtgtgagtgtatgtgtgagtgagtgtgcgcctgtgtgtagcagtgtagtagcggaggaacaaagaggtacaaagaggaatggaatcagtgaagctcagatccttaaagtcactttaagttgggttttcaggggggattttacaggcttctggggaaccccaagtaggtggtattcctctgccctgcctccctcccgtgccaaagctcacacaacaaaggtaggctgcaggtcttgcctggctgccaaagctttcctagagccagggggccaggaacaagttctgtggggacccctgttacctggctacaccatgtgttaacccagtgctggccaggttggttcagatgacacaggtggtgaagtgggtactagtttcctccgctcctccccaaccgggcatcctccttaaagctgaacacttggctgaagagagggtctgaccagacaatttatattacaaagtatagagcaggatgcaacttataaaagcccttccttatctatttttcatgtgaagtggagaaggtggagttattattctcattttagggataaggaaactgaacccagcaatgaacttggagtgccaaagttcaaacccagtacctcactccatcccaggatctctgtctcttacatgaggggacagtggcttccaaaataattccaagggtgctgataaaggagcatctccgctcctttttcctccatgaaacttggagaaaggcaggtgtgggaccaggagggctgcacagcttgcagtatgcctgcctggccatggtgacatgtgacagccacatggtagaggtgagggtggcacagttctggaattcttattccctgggaaggtgcattgccccactcctgttagcagcaaatataagacttgggctatgtgtctgaactggtcttgggtagtctccatttcacagactccagtctgaattaagcatcaacctgcttgatctttttccataagaagtagtaaccaacattgaattgcactatgtgcttcacatgtattcatctctcactgtaaacccacacatttggtatagaattatccttgtttacagacgagaaaacaggaatagagggaaaataaattgccttgagtgcatgcctctaaagctgatggagctaggattcaaatccaggccacaagggctactttggatcctccctctccatcatgcatataccacaccatccttcccatgcagctcatccaccatcatctgctcacctgcctgttttcctactggccttaggtgtgaacagagtacatgtcctgttcatgattccatggccggatcaaagagctcctcctcactcctccctgcaagcacctgtgcatgaacccacccatacctggggcacttgttataaggctcagggaattatgtgacttgcctccaggaatcaaggcgcctccagcttggaccagtttcctggatcccaaggcctctttctcttctgcccctgggccacattgctaaatatatccctgtatgaacccatttaccatctgtagctaaaatgcctcttgactgttctgagccaagattagaagtctgtctaaacgtcaatgattatttcatcggctaaaagcaaattgaccaagctcaccctccctgcagactaagaaggctctcagtctatttgtagctcagtctgatgtgcaagaggcggctgctctgagttgaggctgcctgctgctttctgtaccaatagggtttgctgagcgggtcattgatgtgtttagtctgggattagtagatactttggtataagtcagcagactcgggttatcgaagcaacaatgccccggtgcttgcacaccctgcagggccaccacagcagaatcccatgggggtggggagctcaggtgggcaagtccctcatggaggtctgcacaccttgttcagcagtggacatcctgatgctcacaaggaagagtttgaactgaacatggtctttgagaaacgtgcagagatgtgaccaattgtacaggaccctgagggatcgacgaagtctctgtttctgtctattttgaatttaaggaatgagagcagggacttgggtggaagaaaaatgcacaaagaagtacagaagttttcctttccaaaaaacttcagcagaatttttttttaaaagtgagagctagagaaaaatacttatatatgtttcagaacatgttttttctttctttttttttaattttaactttgtttttccttgtgatcccaagcttctcacctccaccgagtttccggctgcctcctctgcgctgaataatacagtagccagcccagtagacacagcccattgctgggcaggaggctcccaatacacagggaagggattgttcatttcatacatcatttaaagcctgctgcagtgatttaccggtgtcagcctgtctttggagcacagaaggagaagaaagagaaatatgtatgcttccattgtgtatctggacctggatcttagagagtgatgggggagggaggccgactgggttttcttccttatctaaacactgcggagaagccaaagattaccccacagttaggaagaaagaggataggaaagtggttgatgtcttgcagggagatgctgcttccctttccacctggcctggccaggcagggagggctgccttcctacagcctgtgtatagtctcctcattcccaggtcctctcacttagatccatcctgcacccctgtaagaattatcttctcaaaaccatgctgataccatgctactaaggacgtaacaccttttccccaggcaaatggaatcgctccttgccagtgacagtgaaataggaggggggccgggaagtgcaggaagaaggatggggtccctggggggggctccaccctctggcctgtgcccacgggcctaagtgaggacaagccactcctgttttcacgcccaaaggttgcattttccgagaccactctggcctgccaccctcctcactgcccccccacacacactgaccagcctataaaaaccccgagaccctagcagggaggaatacaccagcagaaggacacagtggcagacgctggcaggccatcaacggcaggacgagaatgacgcagacgcgaggagaatttatttggtcagaggagagtctgaccactgcgtggcctgactccagggaagaccaccttcccattccattccccttgtggcctccgcatccaccttgccgagaactacctccactcaataaaaccttgcactcatcctccaagcccacatgggatctgatttttccagtacactaaggcaagaacccaggatacagaaagccctctgtccttgcgataaggcagagggtctaattgagctggttaacacaagctgccaacggacagctaaactgaaagagcacactgtaacacacgcccactggggcttcaggagctgtaaacactcaaccctacatgctgccttggggttggagcccaaaaaacgttccccacaatctgcctgtctgcctgctccccccaggggtttgagcagcggggcatctatgcagcgagccacactcctatcacacagcctgccatggggataaaggaaattctcccgtttcaatagcaggtcttcaggacctgtgctgggactctcctctcattacctgcactccaatgggtccaggtgcctcgaggttctacacacggcctgccttagccatcaggcttcccattcggctgttctccagcttggaatgctgtttctcctctctcccacttccaaaactctttcaaggaccaacctaacacccactccatctgttactctttctgtaactcagccagccctttctgataagtcacttccccaaacttccatagcacttcaagtcagcaatgactgggattagataacagataatactagtattagttaataacattaatacatttcaccgaatgattaccgagtgccatgccccatcaggatgtgctggtaatatttccaggtgaaagaaatgaaggcacagcctctcttggatacttatttaaagctacattcagctaggatgtaagttggccagaatctgaacccagactttctgccttttttatgagcctttaaccacaatttttactgccgctcagtccagtatgacttctaaggtaattgatttttaggtttgagtttagttctgcaataaaactgtggactccccacggatgccatgcatgtcttatatatctgtatcccctacagcacctaacctcagagctagacatgcaataggcattcaatataaacttgatcattcattgattggccagacagctccctgacttgagcacttctctctcttcccattatggaaatgtctgagtaatacagctctcaaggaagactgggggtggggggtgggtgtgaagcgggggtgggagagcatagccagtttgtctttaggagagtctcgtattggactacttcaaaattaaccagtcagatgtctattaagcatgtgctatggcataccacacacatggaggatgagagagaaggaaaaacattcctgttacgaaggtggcaatgctcagattggaagaagctgcaccagtgcggtccagcagggcagcccttgactgagggcttggctgtgtggggcagagtgtggataagggcgttagaggaccccgtagatcgatgtgggtcgtcagcaaggctggagagggctcaggagaaagtgtggctggtggggctttgagggagggccacgtcgccctaggtggagagcaaaggagggctgggagaaggaaattgcccctgattcacagccttccctctttggtgactgtaatggtggggctgggattcatttagccttttctcccactcctgatgactactaagctctgatgcttgctcagtctttcttacaggttggttaggagggtaaagtgtaggagtgtcatatactataagcccggattctatccacatgtaggggccgatcattatttgttattgtctctgatgctgttagtgccctttcttatcctctcagcagcattcaactctactggcagtctgcttggggctgctataaccgaataccatacactgagtggctgacaaacaacagagatttacttctcacacttctggaggctgggaagtccaagaccaaggcactggcagattaggtgtctggggagggcctggtttcctgcttcatagacagctgccttctggctgtatcctcacttgctggaggggcaagagagctccctgaggtttcttttataaaagcactaatcccattcataaagcctccacccttgtgacctaatcatttcccaaagccccaagtcctaatactcctaatctcatcaccttggagactaggtttcaacatatgaattttgaggggacataaacattcagtccattgtatctacatagaaaaagctgtttgtggtgaacatgggtgaccctctgcctgagggctttttttttttttttttttctcctagcaggacatggcagaatccctgggtagttaatgcctcaaatgcagccctcagccaatgacagagggaggtgggggaatgaacacccggcttccttgccccttggtggggatgatgctgagggctattctgtacaggatgagacctggctgccatactcatgacttgctggataaggaaccgttgctgcctaccttcactccctgtcttcctgcccactctcctgcagtgtctccagggatcacctctgacatgagttactggcactggaattgcagggtctatttctgggcgactgaaagtaggacatggtagtctttaataattgaagagatatgcatatttggtgaatagataaattcctctaattgtacaaatgggttcagctcaagtctagtaaaccaggtggacccatttccagtgtctagacccagccctgtcatgttgtccatgttcacagggagctggctgcatccgcctcagggtgctctcatcatagtgttcaacttacacacccctgacctcaccccactcccaactaggattgtaaagtcctggaaaacaggggccttgccacactgagtctttactgtaagaccctcgcacagaataagtgttcgctgaatcactttctaattggatccagttaagcagaagaaaactcccctctgtgcaaaggcaaagctatttccagtgcctttctctggcttccaaagtgatgaaattcagttcccaaggccacagtggttcactagaaccttgtaatgggttcattatttatcctgttgtaccacccctgagtgacctttcaaatggtctcacaaatgtcctttccacaattcatttcaaatgcccctaaacagtcctctaatcttgagtaaagttcattgggcccatgtacagctggcacttcctttgaatcaggggcccatgagcactgtgattaatgaccaggagtgagtgtgggcgagtgtggggcacagggtcgtatgtcctggggcagggctccctgttcacggtctaaagccacatcctgtctgccccaggctcatattctgccagggaccacactgaacaccctcctcaagatgccagggctgcctgtgccatgtactgcaagacagctgggattgtcatggacatcaatatgaaaggcagtgcaggagccaggctggattccaatgctgtggctggctggaggtcccatccagtcaagtggctcgccacttaggtctgaaccaaagagctaaacaggagctggagagctctccctgaagcttccatccctggcctttagagaccgaagtctcctgaaaggcaggtccttgcaagaggtaaaaggctcagtagaatgcagcttcctggcccggctcccatagtggcccctcctggctccaccataccctcaccatgccaggcttggcaggccccaaactggacagacagaagctccctccaacctcgtttccaattccactcatggccgccatctatttgcacagctcatctgggaaggcagcagtgataatgtgagcaggagtccaagaggtcacgaggcatacccagctcctgccattacagaggaggacagctacccagagcacactgcccctccccacttccagtgtagttcctgcactgcccctccccacttccagtgtagatctgggcccctgtacatgtggcaagacctggaagtgggttccctgcacagaaattttctgcctaccttacagaaagactggaccaaaactgttctacatggccacaacaggcttggatctcattgctccagagaagcaggtctgcccatgccctggaagctggctcagtttgggctctggagccaggagcagacatcaagagcatccacggagcctcttttgatgaaaggagcagatgatgcgaaatacagtccaaatggactcttcggaatcagttcatccctcaaacagcggtgtactgccactcaaagcatgccgaggacactgccgtctgctctgacacctgagtttgagttgtgtgtcctttggaaggaagaataagcaaaaataagtgactccccctcaccgctcataaagaacttctaagtctgagtggggagggacatgcaggaccacctttgagagaaaatcaagaaggaggccctcagcacaaatggcaggcatgctgggttgtttaggtcctgtttcatgctacattatgctgtgtgactttgggtaagtcacttaccctctctgaatcttcaaaggcttcatatttgcacaaaactcttccacacttcacagagtttgaaaaaccacaagaaagaaaggaagaaaaacttttatccaagagcaggtatgaggcttctgaataaagctgaaagtagtcattctcctggactctttcaggagagctgagttaccttgtagatctactatgagaaaacctggattattgaggggcaaaggggctttttggtcatttgcagtagcctctcccttgaagaagcaggaatcacccttgtggcatttgtttgagcatcttcatgataatgggcagaaaggagcttgtctttcttgggtcaggagcagggaggtgaggagtgatcagaggagacctgagtctggcactgaaaccagctatactttcatccaacacatttcatcaggtcctgaacactgaagacaccagtgaacaaagaaacccccagtgcctgtcttcatggggcttacatctgtaggacaccctgccatcagagagtggaagaggaggtgtgactggagtgactcaggatatcctcctgtttcaccacagttccctggactttgtacttaatgcagacagtggctatgaggtaggaaatcagcagagcttgttttcccagcagtggtcacaacctgggttgtcaccttgctgattggagcaggatctggtagaaacaaggtgcagtgaacaagctggccaaaaccagcagacagtgatgaaagtgacctctagttgtccttactgctcattaacataaaaagatacttctagtagtgtcatgacactttacaaatgccacatcaatatgccatggcaatgacctgaaaattaccttgtatggttccagaaactccctgccccttttctagaaagatctaagtaaccacctcttaatttgcatgtaaataaagggggtataaacacagttgtcagcagcccatatgctgctattctgggcatgggcacggggcttatggggtagccctgctcagcaaggagcggctcccctgctgctgctgtatgctgccacttcaataaagttgcaaactgatttctttcaccatcatctccccattggattatttcctgggtgaagccaagaaccctcccggactaagccccaatttgggggctcacttcacctgcatcatttacatcaaacagcccctctaagggaccttaggccttgttatctttgaaaaaatgctccagagtgtctatcttttctttctctgtctccctcctatcccaccccatcctgggcttgttttcatctttgtcagtgtgggtactttcctgctctgtgctgccagaatggtgctgaatatgaatgagaaagtaaattagatactgatcagctctccatttccatagtgtgttgaataataccccatgacaactggggtttgaaaggtagcccagctctgggagcaggcctcctgggcatctaagtgacggccactgttcaccagctgtgccgagttactacacagcctggaggtcaagtccttctcccataatcacttggatggaaaattaaagcagcctgctccctcaatggttatacattctggcacagaaattaacaaattcccccagaatccataacagatacatctttgttcagccaaagaactttgatataaattgtagctttttaggacggctctgtcaaaagtgtaatatatcatggaatagtgaatacaagttcaaaagtacatataataatataattaagatagcttgacaagaatgtattttaaaagtataaaatacctgcaggtataatagcttcataaagtctgtcagatttacttctgctgtgaagaaatttaaaatgttttactttaatgtgatgcaaatgaaggctgaggtatgcatataacacagtccttaaaaaataggtagagggaaaagaataaaagtcagattcaggccaaacaagacattcaactttgcgggtgactggataatagatcaagcaaacagattggggagcgatgccgggctgtttgtagaaaacaccaatttcacatttccctcctttgctggctgcaggaaagtatgtgtttttattcaaaattaatgattccctttgtgcatttttctttttgctcacaagagtcaagcataattcttgtttaaagcaaaagcaatttttatataattactagctcatgaaaaattatttttcaatgtattaaaagctgaggagaagagtgggcgagtcataccctgcacacacatgtccggaacacctcaggtccacaaagaagagctgcctccaggtgaacaggagtccaggcatctgtccagcctcatccatacactgagcaacagtatccctcacttggctgactgggtgcttggacaaaaatgctttttcaggcaaagaagcagtaactgcctacctcgtgtacaagaacaccaacgtatggaattacaagattaatgcaatcagcagggccacatattggggcacccagaccaccttccacttctaactctcctgctaaaaacttttttttccaagaattctatctccccagcctggtggtttgcaccgtcaagacaaacccagtaatgtccacatctttgcacctccccttcctgtgcagatctgatgtactaaggtgatgcaaaggcacctatccccaaccgttacttaaatgaaaccttctggcctgatagcatttgccaagccttcattgctttctcattttctccttccccattggcattagatcgaaaggtctctgagttagctagctacctggtctcaggaactctcctaaacttccccagccttggtcatggtttacagtagagtcaaaagtcccttcccttgagacatggcagaaaattctgatatttcagctctccaaccatgcttatgagggtaggtgcttgccaaagcaaaaaagttaaagaatggagtggggagagccttgcaacaagaggcatctcttattcagggtaaaaattagaagcttgaatcatgaaacagtgtagtttaaaaatcagcactgccggtgcctgtgctgctgatgactgcactcggaagaattttcaaagtaaatgtacttttcaccattatctcactcatttgcattctgctccatttggattctgaaactcaactggacgctttattttcagggtaggtctgcatgatggcaaacaaacagtttgggaaggaattagccatatgggcctgggcattattttcttaatgtgggaactgggtcaaccctctacaaaatgtttcctcaaatacttaaactggcacactttccttttgagaggggaggtttttagaattaagcatcccagttggctgtgcgtggaatggtggctgcatagattccagcccccagaggctcatgaaacatcaaaggtgaagcaacgtcagacacagcctggtctggcctcctcattttctgactaagacatacaggcctagagaggtggagacctgggcaagatcatatagccaaggaccgagtccatgtcatgctcccctgtgtctcactgccctaaatcgggagaggtctgtgtctgccccttccttttcctccctatgtctaagaacactcgctgtcctgtagggggctcctcatctccatgtctgggccccaatccattaccccaatcctgtgtgattttagaggtggcaagtgtatatcaatcaatcaatcaatcaaccaaccagtcaaccaatcaaccaatatagtcttcagcacaccctccatatatgaccttgtgtccaaagcgtaggccattggctcattttctccttgtcctttctctgttcttcagaaccagggacaaaatgaaaaaaaacactgaagagaccccccagaaaccactcttctcccctagtgaaaaacgagagacataatgtggggaatgacactgtcaggggtgtcacaagtgaaggataacaatatatgaaacagagcttttaagggtaacccattatttttgtaatttgtttaaacaaaactgagtgactctttaaactctaattcacatcttggaaatgcaatgcagctatctcttgtttctctctctggagtcgtggcaataattttaatgccagcagaaggcattagacattagaggtgagcaaggcagaggagtctggcttttatcagataattaagatgctaccaaagtcaaacctttatcaacattagactaaaaataaactccttccatccagtgggctttctagcaagcattcaaagtgacagtgctctggataaggttttgcttttaaaaattgttcattgtttttcgacttttattggcaatccattctcattatgcccaatgcatttgtcttcataatatgtacttcacaattacaatatcaaagagtttgtatctacataataaaaatgatctatagaatagtacagggaaaacataataacacagtgtgattgttaatgaaatgaatactttgagggaaaacatggcatcccttgagagaacttgttcctatatcatgagatgctagaaacaggcaaaggctgggaggtgaaaccgaaattgaatctcgggttccctggaggtagggagtgcagcatggcactgcttggctttggtgatgggaggggcacaggaggggtattggaggtgacctattgttggaaataatgacttcaaagggcagccgtcttctactagctcttcagaactttctggccccaatactactagctcaacagacaactgaaatgaagctcaggtcttttctctcaagaataagcattggcaagttcttttcatggaccaagatttgctgcggctgacctgcagaggtgctgttcaggaagaaacagatctgctggaggcaacgatctctagactcagtttctcagcctgaaggcacggactacagaaagggaaaatgtggagaagcagatagcaatgtggtaaaaagatgcttggtgcccatctggataatttcatcctacagcacacccagggagaaagaagccacatagctggcaagtggggacacactgtgctatccctgctcactgttgcacctgatacacctatcctagtgcttggcttacagtacatactcataaatatgctttttttttttttttttgagatggagtcttgctctgtcacccaggctggagtgcagcggtgcgaccttggcccactgcaacctccacctccagggttcaagcaattgtcctgcctcagccttccaagtagctgggattacaggcacctgccaccatgcccagctaatttttttgtatttttagtagagatggggtttcaccatgttggccaggctggttttgaactcatgacctgatctgcccgcctcagcctcccgaagtgctaggattacaggcgtgagccaccgtgcctggccataaatatgtttttaatgaatacaaaaagaatgtcttctttatggagccaaaattttcacaattgataacccttacagtagattgcagaaacctataagacagactatcactgaactcataaaaaaagagttatattactgggcacccaggaaaaggaacaacagataaggaagaggtgcaagctgctgaggtctgcataagaataaaggttggttgtggcgcttggccaaagcagggctggggacctcttgcagggcgacgaggagatctgacagatgttccaaatgagaaagaggaggacaagcagacgttcagctctgttaagagaccattgattgaggagcactgttatgcctcttagttgacagccagtggcacgaatccactggtgagaagagttctcttctccagccagccaagagctgcattacatctggaactgggctcagatagcaaaagagcgttctatatatacatgcattttcaaaatattgtggcttctgtacattcaagttaaatgtaagtcaggttgggcagggtttggtcagtaacggggcagaggaagtagatcatttggtctctgaaacccaagcagtctgtagtgaaagtctgcaatcctgcaatggaaagaatctctttcctccactcactcacttccctccccaacttcccatccacacctatatggacacaaggtctacctccaaaaatgaaattcattatatttagagctaaaataattccagaatcaattgacgtagatgaaagcatttttgacttggcttatttgaaaaattatcccgttttatcaattttatttggctagcataactggtgcatgtgcaagtataattttgaacagggagagaacttagttgaattgtaactaaaataattctgggcacaggatggtgtataaaaatacaggcatgacaggaacaatgtaacagagaaagtgacatacagtagtatgtaataacagaagtatcttgaacctatcatccacatgttttttgtgcctgaaaaagcagaatattattataataggtgcaaaaacagttgcagcgtgttaaggctggaactcccccctagagacatagtccaagcttctcacttcaccaatgatgggacctagaatcaaagatatggaggtgactcgtccaaggtcttagaagtgggatgaaaacctggacaccctaggcttctaactcagtgtttttcaattctaccctatggcctttcattcacagagagataggcaggtaggtacgttgatggaagacagataaatacttattctccaggtagtgtcagcttttagacaaaattattctgtcttcagattgaacatcccataagcacatcaaaaactccctgtaggacatttaaactttactgcagagttaaaaactgtggagagttaaaagtcccctgcagctattaaaatagtgtgtagtgagaacagttgtattacaggtgactaatggggtctcaccacctcccacccccattagatatatatactgttgcatttctaagcaagatgtccagtatttttactcctgggggagggagcaattgctgactactatttttttcaaaactgcactaaaactttcttttgtaagaaaaacgagagaaaaaaatcaatagagcatgaaaggacatgaaaagtgcattttaacccatatataatttttttctaacagtgcgattttttaaagctctctacaaaaaataaaagtcaatgtgattctcaaagaaaaaaatgcaacacaaccctgaattcaggagcaaaagaaaaaaaaaacaagaataatgaagatctaaagatttgacctagtaatttgaggcacagatgaaaaatggtgtaagctctggccacctctgggattggcaggtcaaaggggtacattaaatgtgatgggaaacacattctgtttttggatagttcagcatatatccatattaaagcttttaagcctcccaactcagtgaaattactccgagaaaccaagtgtccccttgtggacctggccacacttctattttcgtcctcaaagagaaatggtgtggccaagaatgtgagacatccctaacagggctcaggtgaaaaggaaaggggaaaaaagagtgcaggttaaatgcaatattaaagacgatctctctcctaatcagtgtatctttcttccttacagctaagcaatctttgtcaattacagggcattactctgcaggccaaccggcaattacaatggcatctttcttcccatcactgacagcaaagggaggaaatagtctgagtccagctaaatgtaaagagggaaactggagctcatcacggaggtaatgtacagggaacctataaccaggatgcagatgctatatgcagctgttatgcaaagaagctcttgctctcagagctgatgtgtttatttagactagtgctgaggctgagttaatgccagtttccagaaaggattaatatacactaacgtggaattactgaaccgtcacacacatctggaaatgtatgtttcaactctttcttttttgtggcagccagctgtaccggagaagcagctgatgaggttgcagttgctcctgggccccagctgatttgatgtcatgccgttaagataactataggtccttctgatcaacaccatggtcctttctcccctctgatcctttcaccactcctctttattttggtctcacagtgagtttcttaccttcattttcaagtccaggctataatctcttccatttctcccatttctctcacctccaagccactttccatgtagccatgaggcctctcaaaagaatggagagatagccttgatatttgtggttcagtcatttaacctttgcacatttctgagtgggtcatctgagagaattatcctttggccaagagaccacttagaggaatggtaaaggacatctcaaggagctcaactggtcttatgaccctgaaccttctgtctccagagacaaacaacatcatgcccctcactgagtggttagcctgcttttgtgctcccatttcagaacagaccattcccccaccaccccgccgccatctcagttattcaagaaggaagccatggtatgtactgggaagtcttgtgcctatggaaattccttgagatagaaaagctaaaggcatgaggtattgtgaaagcaatttggctgccctacttctctctttcctttctctgtgcctgtcctttcttggatgaatggattagccaatacagatgtgcgaattatccttaagtatcctggaaaggctttgcctatttgaccttgggtgcggctgtaagtgtttgctcatcagtaattacaaagagcctggaatctagaagtaccttcccaatatcaaccacaaaagcaatttctagttgaagattctgctggggactcttcgacaactgttttctttgacccactcaccccaccttttgcttcttagacatccaactgttcagaaggatcccactgagagaacatcagtcaaatcgtcccttcgtctctggttccaaagtaccctgcaatcatttgtgccttcctccaaaatacctctttcactgccacatcagaagagctctttaaacgctaacaagaaccaatattttagattctactgctaggcatttcagctcaagtcactttattgtaaaattagatgtcattgtgaaaagcatggatataaatataagagcaaaaggcccttttcttaatgcagaaaccaaggtaacaatatcctatttttccttgttgtcaaaagttgtggtttttttttttttttgatagctcagccaatataatgcactgcatgtttacacttagcattaaataactattatgcaaaagtactccacagtaaaatctaagtatatttatggaaagctaaattatattgccaagtttattttagaccaaagaagcccctgggaagggatattgtgtattttaaagagtaaatgtaaactattaaatagaaagaggctttgtggaatgtaacacattctacctaggtaaatcacagagcaattacacagtaaacttttctttgatgaagcactgaagtgatgacatgtaattacttttccaatgctgtaccgtgtgtttatcaaaatgttaatgcaaacataataacaggctgtatgtttgtgctgagaatgtcagagccatccagctgtcaatcacatctgaaaataaaatcgcaaataagcaggcagcttgataacaggagtgacagccaatagtcactctgctgacaagtactttgctcccctccaccaatcacagtgtcactgtaacgtacctaataggaggaatatatcttttaggagctggaatgaaaccaagtggcataaatcggctgaactttgcatgcgactccccctccccctctctgttaatggggcttctttttggggccagcagaccccattccctctccccacgttccttcagatcagtgcccttgttaaaggctgcagagcccacaaacgggctggcattgtgaaaactcaattcagaccaggtctcccagccaactggcctggtttaatcagtcagcgtcaagccctgcggtactttccttggtcatggtcaccaacataggaagtcccagcctagatctgtcgcagccactggctgagctagtttttcttaaagctcttaatgcaattaaaaaaatcattttaatattttttgagacagagtctcactctgtcacccaagctggagtgcagtggtgcaatcttggcttactgcaacctctgccttgtaggttcaagcagttctcaggcctcagcattctgagtagctgtgattacaggtacccaccaccatactcggctaatttttgtatttttagtagagatggggtttcaccatgttggccaggctgatctcgaactcttggcctcaagtgatctgccttcctcagcctccctaagtgctgggattatagatgtgagccactgagcccggccaatgcaactttaaaaaaccgaaacaacaggtgtctgattttaaaggacaagtgccaaaactgctagggaatcagaatgaactaattagtgcttgcagggatacaaggcccatttgagagccttcctggggtgcatgtatgtaggggtgtgcgtatatatgggtgtgtgtgtaggggggatcaagccctaaataggcccctgattggtcaggtcttttcccatgatcatttccttgtactctggaacatctaggaaatgagcagttcagtcctggaaactttgttcaccctgactcctgccctcttgactttctctgagaacacttttcactgaaggatcctttcaaatgtatctaaaaattgccaaccacttgttaaagtgtaagcaggtgcatacatctccttctcctttagattaatgattgcagatattctttccagtatggggcacattttagaattttaccttgctgtgtgcagcagggcagaagaatgggcctacatccattgctgaacctcctctttctatccttattgttacaaaattcacctccttggttaactgaactagcaacacaaatcatccctacctatttgcattttgctgttacaaaatatagagatggtttgtccaccctgtcccatgcaattgtgaccaggagaaacgctctggctcctggtacaaagagatagtctggaggcatcccagtagaacgcagaatgcagggaggaattacgtccctcaatcctctggtctgcagtaatcttatttccattatttttcatgctttctggtgctgccaacaaatgttgcaaaggcaagagccgatctttgacattctcgactgcctaaagtgcagcaaagagctgctttaatcccccttttgtgcctgcaatgactagaagaaaatttttgatcccatgcttggactgactaatggtgcattttgagtggcagccttccacttctgcagaaactgtaaaactcaaccaaacctggaaacatttgaagtttctgggttcaagaaccatgggttcagagaccctcacctccatgaatatgacttgttggacattcaatgactgtgcagtagagacaacaggggtgagtgtttagatagacccagtagctctgcctgctgagcccctctgccagtactctaacttcaatggatgtgcatgattcttccgttgtagcaaatatcattgtagtaaaaagtaatacatctcctcgtttaagtgacagcaggtagggtttgttactttaattcactttgcctttctcttctgaaaattaattgagtcagatactgaatctggagcctaactccttggcagctgagcaggagacaggaggatcatcatctgctatagagagttcttgagaagccaggaatagttaagaggaaattgaggcaacttggaaaggcaaagcaggtcaccagaagtggtaggagagagatcttcaagcagcacagcagttaaagaactttatagcctcttcccaacaaatgctcattgtcgcacttcctgtcacctctctctcctgcatccctctctatctatgttccaggcacacgggactttgcattacttccaaaggtcatggtcaccgtcacaatttccatgaccttactcatgctggcaactctgcttgaaacgtccttaactcatcttctccacctggaaaaaatccaaacctttgatgaagtttgggtaaagtcactttctgcagtggagaatgctccaggaagaatgtattgttcttacgtcagcactcccataaaacctctattttagcatttacttccttacacatagactttttccattcccacttcacactgtgaggatctcctggacaagcattagtctcagaacttatgtttggaactcttacacaggctggattttctaaaagctactaaaaaaatgcttgtttgaaattaaagatccaatgttagaaagtatgttatattaaaaaatggccatcctatattacccagaatcaaaattggaatggagaggtggagacataggttttgaatcgatacaaagaactttctgatcactggagcagttcaacaatggaagcttctcaaagacatgagccccctgttcctgcaggtattaaagtggagggtgactggccacccggggagattgacaagtgattgcaatgatccttatgatgcttttcaatcttaacactctatgaggcattgggcctacatggataagtaaacaaaattgttcaagtctattaattagaaaaagttctctagtaccgtggttctcagtgtgtataagattcacttgcagagcttgttaagaagcctgggtccacccgcagaaattctgttcagtaacatggaggtggtcactgagaatctgcattttaaacaatccctccagatgactctgctggaagcagctctaggattgtcattggagaagcatggttctagagtgtgccaatcgatgggcctccctaagccctctgttatttaacacatctttactcatgttgacataaagtcagcccaacctgcaggtatgtcccaatacatgtgcattaaaaagtttatactctgggctcaaagttcaagcacagagagaattgcaaatctacaaagcgtgaccgccaggatgaggggctatccctgggaaaatagctaggagaggtctgaggaaggctgactgggttcatgacagacacaccacaaggggaggcaaggtctcacctctctaaagtcaaagacaacatagcacgccacggggtaaaatagcaaatgcataagcaagcaaggatcgtgacccaggaaactaattaatcgattcatcaaatgacaggttttgaggcatcttctagagaaatgagataaggagatttgccaagattgtggaagttctcagaagcaatgatgtcatctctcggtggaggctaatgaagtggaaaagcatagcaaccatctttcagtacagagctgcagtggtgagtagatatcagaaatgcaaccaatggttgcttggcaatggaatggcttccaattagacagtcaacacatgacagagtctgcagaattaaacttcatttggagttgaaaacttaatgttgagtgaaaaggcaataggttaagagatttgtgtattgtattttaaacataaagactcttccacaaatccaagttaatagagaaggcccttggattcagattggacagtggtaggaaatagggttatttcaaagaccttgcatatgggagaggaatatgatgcccacagatggccatgggtactatattctttattcttggacaacgacttacttttccattttttacatttcagctttgagaaagatcccagatgcagggctgtgtgaagtcaagatgtttcaagtgtaactggatcccaaaatgggaacacagtgggaagcataaaatatcccagtatggtgccatcttctacagtgtccatgttggcttcatgaacaccccagagaaagaaagacagcaacatgaaaacatagagtatgttctcaaaatggacacttggagaaattttcaggcgtatgtttatcaaatgcatttggtttcttaggaaagacaggtttagtacagataatcctggaatcccagcatccctaagatctatttaattttcgtttgcattgtttgtgaatacaatgatcatatcaatcatcattgtcaacctcatcatcgttatcatcatcaaagttattctctgagaaataactgagaaaaagccagaaatgctgaatctgccttatttttttctagcaggtaattctttcatggttactgggcatcccttcttttctgaataagagagtatcacttagctgaaggacagagcagagggcagcaggctggctcccgagctaccttaggttgtatgcctcaggcatgccccactgtgctgtctaattctagggtactttgggctttgaaagaggtttcacttttctatttggcaacaaatgtttcatctaaaaaagtgtgaggctcacagataagcatgattttaccactgtctacattaactgattatgggatattgaacctaatcagtaaagataagaaatatgactaagaaacagttttctttcttcccacatttaatgcgttcctcactttaattttgcattctcatctgctcttctctagctcaatgtcttgactcttttccactcttttctctttgctgtgctttgatactccctgcccacatgacattcctgttagtcctagtgaagaggctaagtggttttgacccacgaatacttacagatggtgctgcaaacccagctctgaggatgcaaagggtgcagaaatgtctcaatgttgggagatagccctgaagtgtacaaatcctaagtatagctccctgcatgatgataatggactcactaatatctattttcagcagccccacactgcctcttcggaatctctcctgagggctaagtgcatggatatttcattgactggcttcatttgtactgcctcagccccactgtatctcctaccagcgctaataaaaaaatatggctcattagacaagaagtgggctcactacttcttgtctgggttaactttgttcaccaaagataaacttcatttttaaactgaaggtcttctgcctgaaaacacagccatgttttgtgctacattccaaaacaggtgttggataattcagtaattagtatgcacatctaacttcatgcagcctctgttgatctctcaattatagttagctgggtcctctgaagttttctgtagttaattagagcattattgaacagttgggatggagagccaagctctgcaatcagttgacagcttggtcccatgaactaagcattgggctggtccttgactggggaatgacagtcttcagggtgacccagtgccagaatgggttagattgtcttttgaataacagctggagggaggcctcttttatgagctgagaataatggtcacattccttattctgccccactcttgacaggaaaattcacattccaatggtgatcagtttcagaaatgtctcctcaggggaaaaaggaaactttcaacattcaagaaaaaaggataattgttctgagcaggctccagaaagtcaaaacctaaggtgaacacgtgagttagtgctcagtctccctatctcatatggtttcaccttgactcccctcccagaagaattcaggaaaagcacagggggacagcaggaaggtgcatgaagggacccacatgagatgcactgcacaccaaattctagaaggcaatttggaaatgattgcttctgaataattgaggtatcatgtcatctgcaacatccgagtctgactgtccaaagctcctgataattgcccaggttccattttgaatgcagcccgtgagtattagagcaagcatgcattcatcactttaagaccaaaagacaagcatgtcttgtcagtggaacggaggggagatgctttggggactggaggctaagaagcaagaagcattactgattatggtcatggtcagcgtgctttccaaggagaattctccccgctgcccaaatttagcttctgtgctgttctttttccaaatttatgaagtcagaagggtcactgctctctcctcagcaagttgtgaggcatgttgttctgtaacccacccctcactgcagggatctgggctggcttactgagtaggttttcatttcccagcctctcctctctcccacccccaccaaccaagggtccccaatgtggccaagaatgtaaagacagcagaatgacacacatggctgaaataatgtttagatttaactaaatgttggaaatagaattggtacagtgaaaagaaggctgcctttggcaggatctcatctctactcaaccgctgagtaaccaatgtaagtattacttttctccatcatattagaaaaatgaagataggcgtaaccttcagaatcagttaaacataggtgaggtcacctgtctccctggggatggaatgagacagcacagcacaggagagagggggtgggaacaggggtcagaaggtagaagcttgattcctatctctcctctttgctcagtgagtggtcttgggcaaatcttgtattaatgtggacatcaattcctttaaccataaacaggaatcaataggacctatgctatacacccacagtatcaaggggaggactgaaagtaaaaactactgtgtgagagtactttggaatctgcaaagagtgatataaacaaacatacagcacatactggagtgaggcaggtgtgtgatcaagtgggctgaattgattgccaggaagcttgggagaaaattctgagagtttgggacactagacagcagccacaaaggctgacatcagacaatttacaattcagagctctctggggcctagaggagtctttgaagtgagggagctcagttcagctcttctacctcaatcccactctgctgtgctgtgaatttaaagggcccgtgccagattctcaccagggcccgtgccagattcttaccaggctgcctacaaatcagggaagagcataggagggcgcaacaaaagttctaggacttctgtcttgatcaccaccccacactgctctttccttcattaatcattatttataaaggctagaccagaggccctgaatcaggcactagactttgccaagtcccacttatcttagaatgtgttgctaagaccctcacgaggccctcccattccaagatgtatcatttcaggattccatggttcccaatcagaagttcattaaaaagatagtaattagaccaggtgacgccgctcgaggtttactaagtgtccttcagctcaattcaataaacattgcagactgaccgtgggcaagacaacagaccaggccctagagcagtagcactgacccatttcattgtcgacagtgattaaaggagatgaaacccatttgtgagtttatgaatgtatacacacctggattgctggtgctgttgttttctcatgttgatgttcctaacactcctatggggtgggcagggaaggccttatcattcccattttacagagtaatccacagtccacggagattaagatcccatacttagataaatggtggagccaagacttacccaaggggtgtgcctgtgttgtaacagatttactgaagtatgattgcacacaataaataacgtcgttaaagtagtatacaaggtgaggggttctgccgtgtgtacactcatgaaaccatcaccacgatcaggactgcaaacacgtccatcacccccaccaaagttttctcttccccttagtgacccctccctttttccctccccctctttattctccccctgcccctcaagtacccagggatctgctttttgtcttgaaagactagtttgcctttttaaaaaatacttcatataaataaaatcacataatatgaaccttttggctggcttctttcacttggcataattacattgacattcgtcatcattactgcgtgatcagtagtccattcctttctactgctgaggaatatcccattgtgtggaggcaccatgatttgttttggtttgatgtccaatgattttttaaaaattgttcttcttggaaaaaaaaaggagaagaaaaaaagtcaattccctcttctcctcccagaactctaaatgattaccactcaagtcttgtttctcaaatatttcctggttaaatggacaaatatattacaggccacatcagggcttctatgcacagcttcgggaagaatcagtttcagtacgttttattggaacctgcacattgagacgacagcttctttgcttgtagacaaggagaactcacaaaggcataaacaatagagaactttggaaaaattatgagagcaatttaagagtggataattagatatcttttgcagggtgttagggaaattaaattagctttttttaaaaatcaaggtttgtgggaatcacttcataaaaaatatctccgtgactgattatttttctaacattcttcgcctttcttccttgcatatccaaggaagtggcacttttagcccttagctgtggcagccaatcatagcctctaattgcattcactgcataaattgtcagtgtcatgaataataaaattagtttaaataaacccccagccacaatcacaaataactatctggtggaggatcttgtgtcctttcattctagggggatgggtcagtgcaatctctgtagttaaattcttgagttaaaatgaagataaaattattggggaggtggggatagagctgaggggtgaaagtgggaggagaatggtttctggctcccggcaggttcatgaaagagaaagggtcttcttcctgagcagccttccgagagtgcctcatacctaagacagtcagccctgaccagcaacaatagccgagaaagggcttgtactggccatgccagagtctagagggaagagcttggggctcagagactgagcagtcctgcgtgctcctgtggtggcctaatgtgacctattatccagcaactcccatctatttctgaaaactccacgtgctggtctggcactctaattgtccaatctgctgctcaattttcaacaggatctcatcaagcactttgccatttaatggtgaccaaatccctccagttttctgctccctggctgtggacagaaggcacctggaggggtgctgtgggagtcccgtggctgcacatcctggcaaaaggagttcatttcgatggccaagcagcttctatcagcttttctctttctttacaggccctgcccaaatactctgccttctgtagactctactgaagccactagggtgagtgagagagtagacgactgcaaacatgagcgtcccccagtcccagcaccacagcggcctgcctgtgcccagcgctgccccagcatcctcccaaccactgtcctcagcattgtttcaataggagtcacatgattttccaaaacacaatcccttctttcaacctgagcctcagctccctgatatgttaattcccaggctgattccagtgctgttggtcccccgcttggttcattacatttctgagcccactctgctgcctttatttaatgaggtttattgtttgtgcttagtaattttcaaaggcccatcaccctctttgagtttgcccttagatcttcagcctgccaaagaggtgggcttttgaagctacctttattaattcagtacctagcttctgcatttaatggcacatgggtttgaagtgtacataagccacagtggaaacatctgagaagcgtcccaagatactgcaaattataaagggtgattaggaaatagcatggctctctatcttctcatgccttagaactttattccttatatcaaaaagatcctgggatatcaaaatatcactgtctgactctgataatgacttcccagagtttcagacattggtggaaaaaagatataattttaattatcagcagctccacttaaaaaaatcttcagctattgtaaagggcaaggagctggaaggaaaggcagaagaggaggcaagaggtgagcccatgtcctactaaatgcctgcaaagtggctgtctttgagagcgctccacagtccctgccatggatggattccttggaaagagatgcacagggtgctccgactgttagtctgtcctgctatcactatcactgtcagggagcaaacggcagaagccagtctcagggaagccagtggcctgacagttaaggcaaatgcacagacttcagaaatcacaccaaagcagcttggcttctaagatgcagccctgaccggctgactcaaaggaagttggctggcaggttctgcgatccctggagatgggcagggctggggtcagactccggtgacagcagcagtggacacaatccaggacttcccagtgaggtctgtcttttctttgaaagggacagaggagtgtggtccttgggacatctagcccagggaaagaaatcttgcccaagaatacatatgaatatctgcaaaaacaaagttggggtttgatatctttcaggaagcctaggaattctaggccactgccagcattgggaatggttggctcccttccccttccttccatgcccagctggagacagaatgctggactctgggtgcctgaattctgatcctggctctatcagtgtctctgtgcaccagagagaggccacttagcctcccttggcctcaatggcttcttggtgatcttccaataatttttagcagtagaagctttcctttcctaattgaaattttacagggaacaatatttaaaatagctaagaggggctgccatgcctgagggtggtccctgcctgctctgttttcttcatccccttcgtaccctcctgctcagcagaagctgagggactccaggggaccccagccctcctcaggacccaccgtggaagcagaactcccaactgtctttctcactgcttgtggtttgtaagttttatgactcgattttaatctgtaccatttaggatatgctcaggaggggccctgggagaggcacaagtggcagcttttttttcttgaaaaatcagctattatttatccttaaggaagaaaaaaagcaaccctgagaaaatgattttcttttcacagccttattacaaatgctgagcacagctagaagtaaggcctggctctgtgcacgtgtgtgtgcatgtgcacgtgtgtatgtattatgtgtgtgtgtttccggtgggcaggtgtggctggaggcatgaccccttttctctggttgatttcatctccagtagccaagtagaaactacagcatgacctgacttctatgcccccagcactatggccatgacagcctccagataggagaagggtctggcttcattgacatttccacggtagtgcatacagccctcgagacctactcaagagaggacaaaagagaggctcgggtagagcttatctagtggatgaacctgctcctagacacagagcactgcctggcatccctgctgcagaatcgggctaggatagggctgagtattctaattgcctgtgggataggatttcactatatccctgcacagctgttttcatgctgtggttggattttgacgctgtcgtaatttcccccgttgtttgatattctcgcatttacattaaagaagtacaggagaagaacagtgttcttgggagaagatttcagcatttaggattcatacaaataaatgcatggactgcccacgcttccctcacatccgtcaaacaactcagttaaaaacaccttttcaaaaggctcttctataattttacttcttttaaaaatagtgatggggttatgtctgatgccccggaacgtccgtcatgcattgattttatccagttcagtgccaggcagcaattagcaaaggtaacactaattaggttttacaatgtaatatgtgtccttctaaacttaagtcatagcattttaagcttctaatgattgcaaggtcattttgctattcttcataatagcagggatgctaatgagtgcatttggtatgcgtggggatgcccctgtttcctcctggggcttatcagcatttactggggacactttacttaatttgttgccgagctcatgacctaaacggaaacattgaaccggccacctgaaggtctagaagttttagactgtggaatcagcgctgtggaaggcccggctacccgggttaccgtgagctgatcatttgttttcctctggacttagaagctccgcatccaccctgtccaatctccttagctggccaatctccctctcccacgtctgaatgcacttaaatttgctccttcctgctaagaaaaatgttatcctattaaacgatgcgtgttataaataccttaacattcatagtttcatgttttaatcttgctgctagcatattctgggcatgcttactggaatcagttttctatttcttagattgtaagttctcaggaggcagattaaaaactcataagatggtctctgtaaaatgtctttcccagagccgcgtgtgacttggtatttcatgtgggttttagatgtggctgtagataatgagatggcgggtatgacagtgttgagattcaagcagcttcagcaggctctcccccagtgcagctggaaaacatgacaaaatacatttccactgttgacacgtccacctcgtcctgttggggtggccccccagggtggtgtgggtttgagagacattgttggggctcagacttcctgccttcctcttaaggaaaaataaggaagtgatgaattgaggggaatacacgcaaagtagagaaagctagggttgtcttaatttcatttatttgctgggtaagtttctactcacttgaagctatagtccaggcattgtgttaggtgtaggggtgtcgtggtgagcaagacaggtatcatccctgcctccagagcttacagcccaggctggggagtccacagtaggcagcaaatgctttgagtgattcttatttcaaatcgtgttaagtgctgggcatggtgcctcatgcttatgaccctaacagtttgggaggccaaggtgggcagatcccttgagcccaggagttcgagaccagcctgggcaacataatgagacctcatctcaaaaaaaaaaaaaaaaaaaaaaaaaaaaggaaaagaaagaaagaaagaaagaaagaaagaagctaggtatggtgtcacatacacctgtagtctcagctactcaggaggctgaggtgaaatccctggagcccaaggggtcaaggcttcagtgagccatgattatgccactgaactccagcctgggcaacagagagagaccctgtctcaaaatcaatcaattgatcaatcgtgttaagtataataaagaggctccagatgctatgaaggaatagtgggcctgatctattcagtggggatcaggagattcctaaaggaagtgatacttctgctgagctctgagggatgaccagaaatgactagacacacagtggagggaaagccattctaggcagagagaggcatgtaggagggtcctgagataagatcattcacagtgtattccatcctctctggggattttcaaggggagcactctgcaagagtcacaggattagcctaggaaagaccgggctttaaaacaaggagctcccaggcacagagattcttggttctcaaatgttgcagcctgtgacgattcctagtgcttcaggatggctgcttccccacacggagcttccttcttgtgaaagcaagaagaaggccgggtgcagtggctcacacctgtaaccccagcactttgggaggctgagatgggaggatcacttgaggtcaggagttcaagaccagcctgggcaacatggtgaaaccccgtctctactaaaaatacaaaaattagccaggcatggtggagggcaccagtaatcccaggtacttgggaggctgaggcaggagaattgcttgaacccgggaggcggagattccaccactgtacactgcagcctcagcaacagagtgagacactgtctcttaaaaaaaaaaaaaaaaaaaggaaaaaagaaagaaggaaagggagaaggaaagcagagagggcatgagggaagagatgaaaggaagaaaggaacttccaaagcaatgctctgggacaagcctttgggattctcctgccatccttttaagggaactgaaggccagaacctgagagggagacattagttctaggtcttagacccagcaagggtaaccagacagggttactactgttctggttactgaaggctcccgtgcatggagtgttgcattccccagcctctggagctggtgggggttggagcttcacagggtcacctccctaacttcccctttactgctgtcctgagcctggttcagaactcattctgtcaggaaccccagtgaccacatgacccagctgcccccagtaggtggctgcctcagaccctaggcaataaacactccttgcagcactcacttaatgtgacataaagagaagaaactgcagcggtgttgtcactagagcgaatggcaaattctcatagctagataatgcagaaataaagtgcatttgtaatagacaacaaaaggattatcccccattcatttcaaagcaccttcatcccactcagggattacatttctcttacttatcttgcaagtagttttttctattcttgtttatccctgaagagcacatgtatagcttatagcaaataaaaagctggacctgttaaaggcaaggccttcattagtcagagagaagtcattctccaggactctgtgagttctctaatccactgctaggcagtaggatacctaagaaactaaccctataccatccaagacagaactctgctagtctgcaaggatgaacatggtccatgagaaatagcagcatctcccagaaaacctgagcaggtcaggggcttctctgactcctctccacatttgaccttggtctctgagatgctctttgtggctctcctgtatgcctgttgagatgcccatgccctttccagagctacagacaggcatgctgtcatcagacttccaatctttactctgaatgagaaaaacatcaaaatctgagaagcaggagagctaagggtatcctagtgaatggaatgatgatgcaaatatcctagaaagctgtgtagagaacgtggggcctgtccatgggcttcagtgcccaccatgcagtgcatgggagaccgagggaatggctgggactttaattcttttgagggccgttgctcttctcagacacccaggggaggggttccatggccacagcaagctctctggcagcctctgacctgtggagattcattctcaccacgtgttccaactctagaactatgtaactgctcagatcttacccaagcgcgtgttctcctctttcatagcttccattcttacccccattcacatatcatcatgtgcttcacacgcagtggggatcttaacaggcattgccatttcttttgcttgatatttctggctcctttcttttgttactctaagactttgcagaatcaaaagattctaagaagaggccagggaaagagcagaccatccaagtaccaaaaatccctagtaggcagccttctcctctctcttccctgctcttcctcttatccaagttattaaaatacgaaagatcatctcacgaatacgggctacaaacaactccacaactaaagcaaacccttctggtcaccctgggtcagaggagcacaggtggtcccatggggaagggcagcaatttggccccaggacaccaggttggtggcagaacctgctgagtgttttcccaggctggcggggaatctcatgaggaggagatcagtcctggaatgtccaggactgaggggacagtcatgagggggagatgacacagtttaggacaggcttccctttaaggtatttaactttatagaaaatggaaagccttccccaagcgttctcttattttggggaaaaaaaatgaatgtgcaattcaactgtaccccagaacagtccatcatgaacttggacctttgtcactcacctgtcaaccccatctaacaccacccccaaaaggagtagaacaggaaaccagctcccacagagggttaaaggcacagcatcctcctgtttgtatatagcagaccattagggtatttttatttctcttctctccatgttgcacaataccacatcaaaaatacatttgcagcaaagcttattttctgaagatagataatttggttaaatcttttccactttgatttcatctccagtttcggacgagcagcagtacaacatgcagcagcaaaagcccattttattctcatgaaaaagaatttaatgaccctctgatataaaattgatcctctgataagatggcacttgtgggttactttgacagaaatgttaaactaagtaagtctgcacatatccactgatgtatggcacctcgagttgctgctgggactgcagaggacacatcattctgcctctgcttgggaagggggagtgggtgggagcttggactgtccacactggtctagcactattgtgtcactgaattcctacagaatcttagcagtcattgtgtggcctggagctcacatgggttgggaagtttggacaactgtcttgtagaatcaaacattttatttcaggcattcccaggtggtgtttgccctggttccagtctctgatgccacagtcgcctatctcgtggacaggtggaagtaaagagttaggatcaaagctgttagtaacaaggacaatgaaacactactttatgccaattaggttagcaagaattagaaaactgaaggataccaaggactggggaacaggtggggaaactggaactgctctgaaccagtgttgagaatataaactggtcggatattttagaatattcctggcagtacttaatgaaattgtgcatgcatatatcctaaggcacataagtaagtattgtgtggtggtatgaatgctggattctcacacagtgggaaattagaagaaacctggagatgcaacaaaacagaatggataatgaaattttgtgaatgcagcaattagaaacaatgaagtgggcagatacctaacaatacgaacaattcctaaaagcagcgttagttgaaagcagaaacagaattatatctgtagcacaatgtcctttaggtaaattaaaatcatgcatataggtaacaccctgtactttacatatattttggaagacctttatcaaacatagaatagttacctgggggtaaaggaagggaaatggaagtgaggaccagagacgaagatggaaaatataaaaaaagagagttcttagatgggttatgatgtgtcataagctgagaaatatgactaactcaagtctttgcagcttatattcaatttaaaaaatagcacataacttagaacatggaataaatgccaacttaagtggtgattttgatggctacaatccaggccccctttcccaactgtcctccaaacctcctttatcctcttgaacaatcagagggggatgctgtaagatgagacttaaaagccgcaggggagtttggggggggtctctcgcattcctgaggtccctttgactataggtaataaaggttaacagaaggtggaaggctggttagagagtcaattacaaactaactgactcacaaggatgggaaaaaacccaggagatgcactacgatcttgtaaaagggagatttcctatatatatatatatgtttctcatttggggagtgcattgactttttgacttgggtataatgatcacctggagaggctgatcaaaacaggagcctgcctgaatgctttatagcctttcactccttgtagacatgaagatagctaagaaaaagtaaatggaggtcatcaaagtcatttgcacttgtaaaatgtgacccagcaactattaaacacaaaatctctgataatagccgtaaaagaaaagaagtgtcacctatcctaactgacaaaggaaaggaaggagggaggtgaaagtcagatgcagaacaccgattaacttcctcttctgagaattaaaatggtgaccacttttctccttccatctaaccaatttgaaacaaagacaaggaaggcaaagcttcctcaaatctggatcaccactcaacctttgaaaggctattccattgtcaccaattggcatatctgatcgggcaaatcaaggactgaggtttggaaacagatatagcaaaaggtgctatcaagtgaaagggctgagcaggaaggttgattaagtccaggctgagtaggaaggttggttagctagggctagtgaagcagctgcccctgaagttctgtaacaactgggtacaccatgtagtttacaagtaatcctcaaacctggtcaaaaatgttgtcattgaggcctagtggttgagtttttagaacagaaaaaagtagcaagtggagactctggaagagctcctagacacagaacatcttcttagagctttcctagtgctcaaatcttctacaaagccaaaaccgctctttagttaagcaaatttgggatgaggggaagtaacaaatagtcatattaattgcatggcagtggttgttttgtaaaaggaatagctagctggtgggtcacttcctctgctctccaaatcaattgttttgcacaatggagacacactccttgggtcaggaaactaaatgtgagtgtatctgttcccatgtgtgtaaatatacagctctcatgtgcctaatttatagcaagtcacctactactagaacatcggcccttcagttttggatcacttgaattattcaaaccaaagacgccttcaccaccaatgatcagaggaaaagtgattcagatggggtttagaactactcagagtcttccttgagtgcaagcagttccggcttgtgagaaattcagagaagtctagaaatagaaataacaaacacaaaaaagaaagcctgcatgtttattgataacaacctgataggaatgcatattccttctccaattccctttccttctgcaaagagttaaacaaaaaagtaattaaacaataatttctttgtgagtgctggacttctgaggcctgttttctctgttggaaaaaaaatagatttaagataatggccctattctcctcagaataaattaagctcagagataaagaattccattactaatgcctttcagcaaagcccaggcatcttttaaagtcaaactttaaagtataatatgccgtgatcttgttaaaatctttcctgtaatgatatttaagtgatgggcaagggtatcaatggttcaggcaaagtattgattgtatatcttcagggctgttgagctctttcagagtattctgtttgagggaatgcattgtacttatttaaagacattttcaaaacagttgcaagttaactcaagtaactgattttttgtatgtaaaactgtaggaaaaaagggaaagttggaaggggaggatagaaagataggaacctgaaggatactcaagttataaatcaatgacaaagaccaacagtaagtggatcacgaggtcaggagttcgagaccagcctgacaaacatggtgaaacttcacctctactaaaaatacaaaaattaactgtgcatggtggcgcacacctgtaaccccagctactcaggagggtgagacaggagaatcgcttgaacctgggaggcagaggttgcagtgagctgagatcgcaccattgcatttcagcctgggtaacagagcgagattccgtctcaaaaaaaaaaaaaaaaaaagactctgggatattcctataaccagcacagcacatagaacctgcttcaagttaacgattcttttaggtgcttagctctcaccattttcttttctgttgaagtattgacaaatgactcatcttcacccttgtggtaagaagtagtcccttcttccttggggagcagggggtttcttggagaggagatagttagttgctagtctggaaaatctgcagagtctcagcaaatccagctccattctctccggaagagaatgtgaagagtcagagggagcacaggaacaattcagtgagcaacgatggaggatactgtctgcagaaagcatgggtgatggcttgggactatggtggtcctgctggcaacctcttggtggtgctgaaagcacctgaaccattatcctatttaagtcacaacttggatgtctaaagccatcatatatgatgtccacatacagatgatgaccccttgaacatgggtttgcaattcccattcatctcccctacatgactgtatgtgttttaagggcagagtttgaaaatcatcccttcctcacttgataacctgaataatattcatggctctggagagcaaaatccttcaaaaactggttttcctccttgaaacaaagaaacaaccagtgagttttcctggaactaatgccatcctagagttcgcagctaaagtgacaccagttgtttgccaggtggcttcgggcacaccccaactgcagcatggaatgtctcaagggtcatagggctgggccctgcctctccactcttctcttatgcaggagaatgactaacaccccctaggtgttagttggattctgcactcggattctgcaaagactatcctggctcctgggcatcaactttcagttggaaggagctatggaggcttgttccagtggtctcatcatcctggaacatgcacagggctttggggctacttggcctgatagctcgtccaccaaaaggtgctgtcattgatgctggcaaggaaatacccactgtgggaagggctgtagatatcctacaaaagaaatccagttcctggtgaggtggcacacactttcgtgtctttgttatagaggaagaggatcccattgcttaacatttctggcttacatttattccaattctttggattgaattaatctatttgaaatatgtgcatgcacacacctatatgcacatatttatgggatatatagttgctcgtgactttaaaatgtatatttcttatgaaactaggttaaagttttatagaacagaatgtgaaagaatgctctcataagtatatccccctaatgcagtgaatttgtttaacaaacatttgtttggttcttgctatgtgtcaggcaaggcgccaatccctgtggatacagagaagtgtgcgtcaaagtccctctcctccagagtccacaatctattgaggcagatgaatgagaaaacctacaaagtatgttaggaagcagacaggatgctgggcaaacactgggacacagctcctttccaatattctggatggaaaaacctagttcttacagggctatagtcatggaagagatgcaattttgtattctgttttcctcctacttgtgttttaatcacatttccttctgaggctacatggttgcaccctcatctctcagaaagacttttctttaaataaacagagatccagatagcaaaatgctaccatccaatgtctttgcctatatttatttcattacttcatctgaataatactttttttaaaaaaaaggaagcccagcgtcctatgaccttgtgaaagaagcaaaaaatagcatcatttactcagcagcatattgtacctttgcctattgttttcttacttgtctaattatttaaaaaagaatagctgtggtaaagcactctctcaggcacaaatatgcttctgatttaagaaattattatagaaaaatgctggaagccttgtagtcatctttgctatatttagagggaaaataacgtccctctgcaattaccatttggtatgaagtttaggcactcacatttttcttttcttttttttttaaactaattttttcctctttttctctgggttaacaatgcagggatcatagttgcacaattattaaaaagaggccacttaaattcaactctccatggatacagtgtctgtggcaatgtttaattagagattaaaattgaggaattgaataattgaggttgctaatgaatttgaaaactcagcaaagcaaggagagctgagcgtttttccgacttagcttttctttctctaacccttttctcatttcctactattatcacatttctggccttgactgctgagtttattactacccataaccctggcctaagtggaaacaaaaaagctgtagcctctttgctgagctcctggagacatttggtctattggatttatgacatgttcagaagcttgcagttgcaggaggctgacaatgatgaaaatgagatatgttgggccaccaacgctttctgtaatcaccttaataggtcaacataacaatggatgttgctggtggaaaaaataagaagacggtcctaaatcaaaggcaatttaatatattagaagttctattgctaccccctctagggagactggattatttgggtaccttgcttggtaggcttgcattagcttcaggtgcccaacaatgaaagtaatcccttggttcaccctggaacagaaccagttctttacaaggtgaccctataatagctatccccttggtagatagcacatctcaactctggcctggaggtaattctcaagcagggatttctgcactgggaggaggccagattacaagaccctgaaggtcctttccaactctaaattgctatgattttatgaagatggcatagaaaaaactgcctcactctaagagaaccataccctttgaagcctctttttaacacacaggtaaagttttcaggactatttttatcatttggacaccgaacttcagatgagatattccaagtttcatttagcacaacatatagatggtttaaatctacattcaaggtaaatgtctgtattttatggcccgaagcccccaaactcatgattatttgctattttgccattgctagttaaattgggtcttgatgtttactgcatctctgactgcaataagactgatcactagtggggatagtgcaactgataaaaggaacctgctccaaagcaatgttaacatagcagatatttggtcagaaaatcttttatgaattagaagtcattcctaataacatttccttaaaacttcttagccacacttcttagctcagctgctgatggcttcctactaatgactttaaatacatgtttttgacatcaggaaaagaaataatctgtcttacaaggctgttcttacttataccaagaacaatctgtctcctgctacagtttagcacagctatagcttgggggtagggggtcaaaggaggaagtatgcataatgtacatatttaatcttgtctcgtctatttttatcctatgttcactcaatatttgtagcattctctttgcgtctgtaagcatcaatgctattcctcagagacattaagatcccagagaagagaaactgtaaaaatgttctttgatggtatctaggacaactccaagtatagctaagtatataataaataactgactatccatgatggggatgatgatgatgatgatgatgatgatacagaaatagtgtgtaaaaaaattcatcttcagatgggtatttgtggcaatgcttcagaggggagagacatttcaagagactgggtcattccctggtttggcaaaaagggcgacatgatggttggtgtctatgaagacagctgtgtgtcatcaacagaaggttctcataccacacagctcagcttgcagaggaggaacggggcttgattccatggcttccctacttgaaggcagggcttggcttacttccaataagtcaccttccatggcaaggggagggtgggtgatattttttagtgaaggagatgcttccggggggagctgcaagctgaggggctgcaccaggaatacaggattcctgggagttgatgggaaacttctaaccttcaactgccttcttttctcatttacacaacgctatcctggggtaaagagccctaaataattgcaatgcatcaacttggcagagggctacacattaggtaggtccttccataatgtctttctcattaagagtctaagcccataaggcaatttgtggcatttactgttcatcgctcaggggtcagagggtggggagagggatctttcattttgggccttatcgaacctgtcccgcttgtgacccacaagagcattgcaagcctcatcctgcacagtggcttggtgtgtgattcggtgtgctaaatggcatgtctccattctccaatctgtctggccatgaacccttaacagaacaccagagacctatgtgagatggaattgttgtgtaccgccacagcctgacaacacagagccctatctgccgctgccagttcgggcggatgcctaacgagcacactggggagagcctccagtggggacatgactccccaaagcacttcaggggttcctttgtccgcacccagccatgcaaaattcctggtgcagcacagctaagtgaggatgcacggaggagatgaaacaggctgacaggcagagccattctgtttggggtttgtctacaaaattgtcagttcaggtctccaggtcaaaaatcattttatctgctgaagcagatgctttgtagaacaaaatgccaggccgacttcaaggccgggaggtgtgcagagccccaggctccaatcacactgcagcaggagcacactccagcccatcctgcccctctctgaattccctcactcagagataggctctcttttctctctgtacactccagctccctggaagactttctgacagctccctttctgcgggctgactgctcaagaagcaagatgttcaaagacatggctcccagtctcggaaatccaaacctcacgccttgtgtgactgatgagccacttttcgttgtttgctttcttaaaaataagcattaaaaggtagggaggtattgggagaactggaatgatcagtcttatcaaaagagggaaactgaggcttaaggaacggaagtattagcagcaaggttactcccaaagagacatgttacagcccctaccagatggcaagaaccttgaaccttatttgattgctgcctctgcccagtaactttaatctccctccagcagagaagtggatagggacccccctgccatgaaaaacagcgttgttttttgtttttgtttttgcttcagatctcctttcctttcactgttttttttagcatgtatgggaacattatattcaccaaaaatcaggactagcattaaacccagaagatgtgaactgcacgcattataaggcaaattagatcctgaaagtctgcactgcactcggatccccagcacctcctctgtagcccacagtgcaaggctgcctgtggcttcttcctgggacgtctgctctgcctcctgaaaggatggctttgcctttctgaggtccatgaagggaagtcagagtggcttggctgagccctacattttctttttctgtgtaattccatttgataaagaaaaagcatttagaaaggttcattgtttagatattgaaagacaggagggaagcagacctaggaaggaatccttagtttccttttgttgtacaaggacactgctctcatgcatgtcaacccattcctcatggggcccaccacaccataaatgaatcaggcaataaaggatcccagtggtaccattgtcagaatatctaaattttgaattaaagacttggttaagatatgaaactacctaccttccatttggaaatgtcccttgaactctttccctagacccccactgattggataaggtgagtgaacccgagctccaggtgcctcccaagtccactgtgaagatgccctgaacacgatgtggaacctaggcgagggaggggtctgcattttatcagatcatgatctgtgtcaaatatagttatgagtattttcatcaaagaatatcatagtttccccagcactttgtgaaggctgcgatagagaggaaattgaaaggcagggtcatttccaatggcacacaacacagtgacctcagacaacacagtgagctataagaaaaagatggcttgcagacgccaggccaggcaaagagactttttgctggagggacaggttgagaagcataagagaacttcggcaaccacattctttttaaagtattggagctcttctaccatttgctcaaaaagcgttctgagtaccaactatggcaaggtttggagctaaagtctagagctataaagatcaatgcatcttttcccctagtctaatgggatagacaggccttgaggacaggaaatgagactgaagtgacgagatggacacgaagtcagcaggatcgggcccctgctgccctgcaacctcatctcctcccattctcccctctggctcattttgccccaaccacactgaacttttgagttcccccatcaagtccaggccctttcctcctgagggtcttggcatctgctcaccctctgcctggaatgctcttcccctgggatctgcgtggcttgctcctcactttcttcagatctttactcatacatcaccttttcaacaaaggctttcttgaccacctgtgatgtcacaccgccacccaaaagacaccccccaaattcttccctgctttcttttcctccatagcccttatcagtacctaacatataaatctgttatgtatgttgtttatgatcctgccccctcccgtcagaatgcaagtcctatgaaggcaaatatctgttttgtttactgccgtattttcagtgcctaggcacataatagacccttgataaatatttattaaataaataaatctaggtggatattccaatcggttgctttgacattcatggatgccaagactaagagatttttatgatcattttgtccagccaagactaagagatctttatgatcatttcgtccaaccaaagcaaggactccgaagcaggactgcttgtgttcaaaactggcctccatctctgaccagctgtgtgactttgggcaagtcactttaacctctctgtgctctggttttctcatatgcaatgtggggacaataatagtgacttcttcacagggttgttgtaaaggttaattgtaattattatataaaatacctagaacagggcagggcatagggtaaacgttctagaaacactggctattactattggtattatcaagaaaactgaaagtcacaaaaggtaagtgatttgctcaaaatcacaaattcattcatttaacaagtattaaagggcttcccatacaccagaaactggggattccacagtagattaaatataatagtttctgcttttatggggcctatagtctaggtaggaagataaatgtcgaacaaagactcaggcaaatatatgcagtcatccctcgttattcaaggaggattggttcctggatcctcttgggtatcacaatctgcggacgctcgagtctctgatataaagtagtgtagtatttgcatataacctaagcacatacactttaaatatctaattacttataatacataataaaaatatatgctatgtaaacagttacttaaatttgttatattatttaaagttgttatgttaaatttgtgttattttttattgttgatttgtatttttcaaatattgtctattcacttggttgaatcatctctgaaggtgcagaacccaggcgacacagggggccaactgtaattgcaatctgaatgaccaccatgaagacataggtcaccatgaacatgaagtgtgggagacctaatttctcttctcaggcagggaaggaatggggtcggagagggaggagttcatgggaggtgtggcactaaaacccaggctccggcctgggactctttacattataagtgtgtggccctgggatcaactgtggacttcttcactagcctgagagttcctcaaggcaagagagcaaggacgcattgcactcatccttgcatatctgtagctccacctcaggcacggtgcccagctcccagcatacccacagagtgagagccatgcctattccttcagcacgtgctaagcgccgactctcagggcatggctctgaggatgagagagtgctctgagttgagatacaccgcccacaatacaccccgtgggtaattaacaaccgagaaagggctctgctgaatggagtcgcaacagcacctgtctctggtgtcctccaccctttcagcaggccaggagtctcttgggaagcctaccaaagaagggagaaatgtcctttgctctccataaccctaggggaggcaggatcttgacctcagagatgaccttttgccatcattgtctcagctttcatgaaaacagttgtgcatgaggctgaagcaccgccattataaaaaacttggttaaaatatggattaatccctgggagggtgttatgcaagattcagatatatggtctgtgatatggatatgatatttttttattgcaataataagtttctcaactcctaatggaccctgtattaactgaagatgacagggagcgagggatggaaagcgggcaatttgttaaggttgcagagcagcagttccagggttgtaaaagataaaacatttcagagtcattaaaatcagcctaaattgtctatctgaactcaaagcaacaaacccaacttggccctgagtccatcaccagctatttttttctttacagtgttttgattctcttggactatacacacagctcaatcttctactcccagaaggtccagggctttgaaaagactaatctcaggacttcctggaggaggtggactttgagtgctcaagcagtggaagggaggcagcctttgatggatacacatacctttataaaaaggctttcagatgcaggaagaggcagccaaggtacagtgggctggctggagagaagggatcactgggggtggtcttaaggcctttttggggttggggcctagtgggtagaaaagatcttgaagcttctgattaggactttgtagttgtctgtatgagccaagaggagcataacaaggatttgaggacaaaggtcagactcatgagttagtgggtatttccagtgaagaggctggctactatttgctaagagcttactaaggtccaggctccgtgttgagggattttcataaactaactcactaaattcttacaagaatcccacgaggtaaataatagtgtatacgcatcatatggatgaggaaatcgggcaagtttctccacccctttaggactccacatcacataaccaataaggcagctggactagggttcaaaccccaacaaactaacctacatgaatgtgttagctggaagatgtccctctttattctgatataatgcagtaaactcccatgtgtcaggctccattcacctgctaggggaaacatctctgatggcagggactgccaggtatccttgctctcagatgatgtcagcagcaggaaggcccagcagtgatgctggactagacccctgggcttagcagtgagcaagactgaaagacagatgttctcattgccgggggaaggaaaggtgggctttataacaccctctgcacctgccctgggccacagggactctttctgcattttatcctctgtggaggagaaagtcaccatgaacagaaagggttggcacagaagagagcaggagggaagcaagaagcagccccaaggttcaagggatgacacagagagaaagagagggtggtgctggtgatgacaatgatgactgcatatttctagacatggcccctccaagtaggagacatgggcagaaaggagaccagcaaataaaaagcagccaccatgctgagactcttctttgaaaatggcattgttgtcaaacttagaaaacagtttcccaccctgaataaaacactgacatttgtctaattaaaaaaacctaatggagattctgcagacagagggaagccgccagtgcatctgctggtgaagtctccatatggcccaatccaatgtgtactctgctgcagagacagagcaggactctagaatcgaagctgcccagccattaaatcaccttcacggcctcactggccacggaccaacagggcaggaaagctcagcccagatttctgctgtgcccctcctctctccccgcagcagtaatgatctgacctgtggaccacccctcaggaagtgttagtggcaggaggtgataaggaagagaaggacagtcaggaaggactttcctcttctgggccccagcagatggtgggatgtgtccataagaacggcatccgggcacggtggctcacgcctgtaatcccagcactttgggaggctgaggtgggcggatgacgaggtcaggagatcgagaccatcctggctaacacggtgaaaccctgtctctactaaaaatccaaaaaattagccgggcgcggtggcgggtgcctgtagtcccagctactcgggaggctgaggcaggagaatggggtgaacccgggaggcagagcttgcagtgagccgagatggcaccactgcactccagcctgggcgacagagcgagactctgtctcaaaaaaaaaaaaaaaaaaaaagaacggcaactgggatgactcagtagagactgggaaggaagccctgcagagaagctgccagcccacatactcatggagagccccaaatcgtccttcagacccctggcagtctggaagcctagatgtcgtgaatcaagcctctggcaaggacagcgcagtgaccaaccctcttttcagaaggacaaagtggaatgaaagcacaagccatcaatagcatggtcatctccctggagatgtgcagatacccttcaccttcaagcaggctaaaccggccgagagtggctctgaggacctgcaggtgctgcccacatgtgccctgggctggtcctccctcagctccctctcctgtcttcacctccctgggccatgtctctcaccttttgtggtaattcttcacttctctccacactaattacccctttccatctcacattcctccagctggttcagcacttccgatggctccagtcctaagcacccctcacagtaggcatcaaccaagaacatatcacactcacctacaaaacaagcaacccaccatgagctgtgagatggaaataactcatcttatctattcatctggaatacgatcctgatgaacaggagaagggagaagaacttcaccttccttcaagaggccatgctgggtagcaatggggctcctgcccctgctgttcatcatgtttctggggtctttgtttcaaatgtgaggcacaacagagcatcctgctgtatcagcctaattaccagcctctccttccattcctgctggcatggcaggtgaagtatagcgaagaggaacttggcgtgataatggaacctagtgatgaaatttcttggccactactggccattcatgatcataattaccaatgacgctttatcgtgatgacagaggagggcatgcagagtggtgacacctggggtgcacccatcagtctaagtagtcaagagaggaaatgccttaaggaaccacgagatcccttgaagagactcagctgagcacacgtagttaccagaagtggctgttaggcaagtgaaatgtagaatgttcctctgaccttaactacccaaagattagaacgctgctgttctgtaacacctggagctgaggctggacagttgagcacacatcatccatctttcagtgtcctttctccatgagatagttagggtcaatagtgattgcaggtgacacaaggttttccaaatatggttggggaaggcagtcactcctcaaaatccatttcatttctcttccatagtggcagtattatttagggaaatgagcagctcactggatgagtccattgttctcagggctatttaacctcctcatcactattcagttcagaatggggctagtgaccttttttagactaatgaaatgcaagggaggattgctgaagggtgtctgaccaattatctcactcttaagagagaggatggaaagccacacagtttctccgactgactgtaaacgcagagtgtcttgcccagcttgcagctggcagctatctgatggccatgaaggaggctggcctgggaaaaacgcagtccatgaagaggaaggagctaagacaaagacagaaaaagagacccattgccttcatcaagcggtacctaactctgaccttctggttatgctagtcaacaaaattgcttattgctttagtcaattggagtcagtttctcttatcagaagcccaaagaatgccttccataagaaaaagtgcctcctctcaagtctgcttggaaagagactaccatataagagctgagtgaagaagctttgaagaggcctggcagagtagagtgcaggtggagtctggggaccgcatagcagaggaggggtctgtgtggctgacacctcatcagtgtgcttcagaggaagctcattgctaggcagcacatctgtccatactcatgaacaataggtcaccctttccacctcaaggacaacaagtcagcagcattacggtagactatattttgtttccaactatttgcaggtcagcatcgactcttgcttggctttgtgactttctttggccaatggaatatgagtgaatgtgatgccacatgtgagcaggtgtttgaatgcaagcgtctgatttggcttggccaattcctgccctctgtcatgaggaaggaatgtctcggataggtgctatgcctgtggccagggccctaaaaggaaagggcacgtggagtagggccacagctgacccacagcccacttgtgacatgaaagagggagaaacaaacatttcctgggctaggttactgggattctaacatagaagtatatacaaagcaatactctattcccaggactctatgaagtgatttggaagataaagaatgatgagacatggtttccattctcagagaatttataaacacagcaagcaccagaaagaattacagagagtgcagaatcctggaataccttgcccatacagattgtgaggacactagagttcagaggaaaggaatatactggctgggatggcctacaagaatgggagaatgggtgagtgacagatgacattggatagagttaacagcagacaggtgtcacagcctgagctgaagatttgcagctcaccttgtcagctgatctcatgaaaggagggacattgagaatgcctgggtagcatacgccactttttcttctgtctgccggaggcaaagatgctgagactttcactttcatgtttgaatgaaaatatcttagtgtacaaattatcactttacaattaattatgcagagcaagtaacacacatgagacctcaatattatgacagcttggaaatttactgttttcgaacttaacatgcaacaagtcttgccaaatgtacgttgaaaagtagcacaagattagacaattaacattttaatgttgtatattcacagcacatctgtgggtcagtgtaaacaccacaaacaacttggcagatgatgtcaagtggacacccccctaagactctgaccttaaaaaccaacgctctttaattaggcctttccttccccttctggctttgggagaagagactgttatgaaaaaagacatgattacaccatattggagttcaccaggcatctcaaatactttgggtttgataaaaaacagcagatttcattgctggaatcttcccttcagaatctgtaagcaccatgtggatatcaaggggaatttcatcagtatgtttctgattcctttacacttacatcattaaaagatttttgagggtttttgaagtccaataactctcctgagccattcttcccccactcccagcatatttttcatttcttttcattaaaattaggaaattgaatttcagctctgtattttttttttaaagctcgctgcttgtaaataatggtggctaaggattaaatccccaattctaaacattcgtcctgagatccatcaagctgatgaagatttgtgtatcctcatcgggcccagatctcagacaggagagacgtggtcaactgtgatttgagagatgaattcaggcatcataggcttcctttgcctctctgtagaatccagttttgtccaagcgagacagtatcattgactcacatgaagagtggaactgtagtgttggaagctgaatgagcactaaagtaccactcatctaactctcctgccctcatcaggccaaggctcagctttgtattttcaaaatctctttgtaagttctctcctggtagctgataactgttttagtcacattgtagtcaacccattctttgttatttctgacataaagtgatcttacctttaggtaagagcatttcacattctcttattctcttaacagatctgaacctagtcttgaaatgggtcacataaccatttgcaaatgtaaaaaaaattcttcacaaaggttccagtctgtatataggcttcatgacagcagggcctcatctgctctcttcgtgcaacctcccccagccacagaacagtctccagcacatagtagatgatgcataatatttgttgaatgaaggagtgaataaaattctaatcatatgtaaaacatatacagcctttcacagtgcttccacacctagtgattaatagcgttctaatgataccctgaatgagtagcaaaggtagggtgatccttagattatttataaagcagatgagcccagatatggaataacttaagatcttatggctggtcagtggtaaaactggagtaggtttcagatcacctgagtctcagaatgtgctgttttcatatagaccagtgcttctgaaggttgagttaggcatatatcagagtcacccaaaggatttattaaaacacaaattgctgagccccatcctcaaagtgtcacttctgtaggccaagggtgggccgccagaatctgcatttttaacacgtacccaggtgatgtcagtactgccggccctgggaccacactgtgaggacaactcagaaaggccatagtttacgaactgcaaaatgaaggaatatgagggagagagaaagacacttcttaacatcctccgagactatgtttagggtatcaaactcaactgatcggtacagaaagccaggctgtgtgatttaactgcagaagtctttgctatcccttaaaaagcaaacaaacaaaaaacctgctaatgtagatcacgggacaggaagttccaacctggggatattctaacttagaatgaaggttagctggagtctttctaagtatgaatttaggtttcgaaaagagattttggagctggataaagcattagttacatggtccaaacttctcacatatgcacctgcagaaagaaaggggttagaagggtgatgtgcctagtccagtgtcccagactctcttcatgcctgattcttcagctgtaaggcataatcaaaaggggacaggatgtcccccagcttggttctcctacgactgtttctgcggggacagttggtcaccctatacatgtaaattcttttaacttgtacaccaatgttcattgcagcagtattcataataaccaaaaagtagaagtcacccacgtgtctaacagatgaatgcaaacacaaaatatgatatagtcacacaatggaatatcattcagccataaaaaggaataacattctgatacacagtatgttaaagattcaccttgaaaatattatgctaaatcaaatgaaccagacacagaaggatatatattgtacgattccacttatatgaagtattcagaataggcaaattcataaaaataaaaaatagattaaaggttatcaggactgagacggaaggaagtgggagttattgcttaatgggtacagaatttctgtttacagtgatgaaaaagttctggaaataaatagtggtgatggttgcacaacattgtcaatatagttaatgccactaaaccgtatacttaaaagtggttaaaatgtcaaatttcatgttgtatatattttaccacaataaaaaaattaaaaaaaaacaaggaaaaacctgcaaacaacaaaaatctttccaaaccacgtagcacctccacacctatcctgcctctcttagagcactgctcagttgtaggctgtgtggggagtgagtaatgatcacctggtgcaatctggtttctagtatgagttgcttccactcatactagaaaccatatatgtataccacatactagaaaccatatactagaaaccactcacactagaaaccaatagtgaggtggttgccactatttccattggcaaccaatacttttctgccactccactcattgtctaaccttaggcatggactttagaattgaggtggcgtttctgaagaacgagatggtaaaaacagtggcatttctgttccctcctccaccccagttgcacgctttggtaattgttgaactcgatttcacttggtgtgtgatgacacatcttacagtgatggagcagaatttagatgctgtgactcatctctccaagctgggtttccataagactccacactgatctctggcatgtttactgctgcctgggaaactggttttgtgcattctcagaaatacgagattggcccataatgatatgcatgcctctcagagggaagacagagactcacggtatggcagttgaaggacacacgacttgagggagatggatgttactgaggcaaaagaaatgttcattgcctactcgctcatcatggtgcttccctcccatgtgtgtgtccatttgggcctcagcaacatccccagatgctgggcagatccagtgaattgcaagtaagcaaataaacatgatttaatagtagatgagaagactttgccacaccatggtacctccccctgcatttattttggcaatttggtgccgaatatttacgacagtgctttagaccatccaggtagttttagcgtaaggagtgaagtctttgtaaactaagctgcttgttcctctgacagggtgataagcaagcttgtggtggagggcagttaccggattttaattaactagctgaattattacgtttttgcataaacattcttcaccatcatccactcatgacataggttaggtacatttacacagagaactaaaatgatacattctctgcctcctaggagtttataatctaagaaagggattgcaaatacatagaaaggctattccattcttcatctctgtgacatggcagacattactaatcaaggatagttccccttttcaaaatcttttcctgcattggatgccaggcagccattgtaatcaattgcagggtgtgcaaggccttcctgatgtctgcatgttataaagaatggggagctagctgccaagacattcctatgacaccagatggggaatgtattgttacatgtattttaacaatgtaacaatattgcatagacccaaggaaatatgattttataacgtcatatgttataacatcatatgttataagatatgtattgttacatcatattatattattatttgtattatatatatgtatatatgtattattatgtgtattaatactatattatatataatatgatgtattgctacagacccaaggagatatgattttttaacatcaacttaggttttcatacctttcaagtgataaatacatgcataatttgtagaattaaggcatagtgcttttgtgggtttcgataagcctgacttctcagtgtggatgctcccatgttgtggatgagattgagcgctgtggtaggtgcagccatcactaatgtctttgcccctaagacaggagcaagctgggccccttggttaaacactgattacagccacatactctcctcacttcctcctttctgtagttccagttgagtaattaaaatcacttctgttaaagtagcatggttggctcaacaagccaagggcaagtttacggatctggaggatggaaactactttaaaccttggtagttctggctgcagtgaggaataacaattagaataattgataaccaggtccttgatgtccagtcaccacccaaggcctgcaacacatcagagacaagcctgattctctggctggagtagataacagagctggggttgggctattctggttgcttaagctgcagtggccaaggacatgcttcactttggtgacaccagttgtgcagaagctcttgaactcacacagttgaggtctttgtggtctgggagagaaaccctttccctgatatgtgcacagtaagcatggggctaaataggtgtgcatgactttcagattacatgcaaagaagttttagaggttaagagttccaaagaggacagacaggatttgctggagcaggcctggggtaatacagaatattccagtaacaatagtgtaactgcactactacagtattaagagtaacaatattgttactaaacaataggaggatactactaagcagtaacaatgctactgctaattgtgtgccatttattgaacaatgactacatacctgatatgatgctaaatgtgtttataatgatagcatttaattttatcatttaactatatcatgtaatcttcatatcaaccccatgacgtacttgtcacttgtcattcttcttattgtacagatgaaagttttcaaagatgaagtaattttcccaaagtcaaacagacagggagtggcttggttaagaatctgcccccaaaactcatgctgctcacttccatatattattgctcttgcacaatctgatatgctctcccatggctgactccataaatgcctcttttgtctatatcaccataagatgcatctttagatcccaagaaatctatcgattagacaaagataaatgctcagcaccataatcatgctatcaaatcattgaaccgatgaacgaaaggtggagttaaatctccctcaatgtgaagatccccactgcactgtggaatttagtccatttgatctggatttgggattccagttaaagaaatcttcatgtgaagagatactactgctgctcactgtttcttgccaggtggtgtcagtgctctgtttgcctaaaggataaattcagacatttgattttctgcccatagcatcctatttttcctgatcttacttggctattcctcaggatatgttttaagacagatatgttctttgatctcattttaaacttcctctttggtctctctactttctccctgtcttacagacccctgggcaatcacttttttccccaaccagctcagactccatggtccatcacttcaaccttgtagttacatcctcgtcctaacatcgtaccttcctagaaaaccccgcgcctaggtcactttacaattggccttctctgcctgattccaggatgctgagagctgctagacaaaattacctcaacactcagattggcccccgtgatggttaatgttaggtgtcaacttgactgaattatgcgatacccagatagctggtagagcattatttctgggtgtgtctgtgtgagtgtttcaggaagagactggcacttgcatctctctcgccccctgtgggcacagaccatcaaatcagctaaaggcctggatagaaccacaaggcaggggaagggcacattctctctccctctcccctggaggtggggcacccttcttctcctgcccttggatgtcagcactctaggttctccaacctatagactctgggactcgcaccaggggctcccccagatctcaggccttcagagagttacaccattggcttccctggttctgatgaccttgggcatggactgagccacattgccggctatcctgggtctccaccttgcagaaggtttatcatgggacttctcagcctccataattgtgtgagccaattcacctgataaattccctcatcctgtcttgtatctatctatctatctatctatctatctatctatctatctatctatctatctatcttcctatctatctacctatctgtccatccatcttcctgtgttcctatctattatctatctgtaatctatctatctgtctgtctgtctttctttttctttctatctatatctatcaatctatctatatctgtcttctatctatctatctatctatctatctatctatctatctatcttcctatctatccatccatcttcctgtgttcctatctatctattatctatctgtaatctatctatctgtctgtctttctttctttttctttctatctatatctatcaatctatctatatctgtcttctatctatctatctatctatctatctatctatctatctatctatcttcctatctatccatccacctatcttcctgccttcctatctattatctatctatcatctatctttctgtcatcctatctatctatctatcatctatctccctatctatctatctatcttcctatctatctatccatccgccttcctgtcttcctatcatctgtatatctatatctatctatctatctatctatctatctatctatctatctatcatctatcttcctatctatcttcctatctatctatcttcctatctatctatccatccatcttcctgtcttcctatcatctatctatatctatctatcgatctatctatctgtctgtctatctatctatctatctatctatctatctatctatctatctatctatctatctctatcatcttttggttctgttcctccagtgagccctggctaaccctaacctgcttgtcatgtatgatctccctcctcaactggcccctccatgctgcctccagtccctgtgtgcctctgtggtcagatcatccattctccatgaaggctgaatcaaaccttctccactttataaactttactactgcatctcctcacccctactctcagtagaaggcctcttcctgcttcttaaacgaaacagaagccgacagataagtatttcctccatgtccatctccaaactcatcatcgtgtgcctgatctgtgcccacccttccactttccctgcccttacatgagaagcatgtaacgttccctcccatacaaggtgaatccctccatcctccactggctctgcagacccctttccctcccacttctagggaccttgttctgtcaagtttaccatctccccttcttctcagtagggaaagtctctaaattatgtgcaagtctctcccaccctaaaaacaaataaaaagcagcaggagcagcagcaacaacaacaacaacaacaacaacaacaacctcccttcactccactttcctctgcagcaactgccctattttctcttattcaataccaagccccttgaaagagttccttgcatttcccggactcatttcttacccactcttcccacaatccgcagtgttctggcacccatgtctaccctcttcccagatggttcttgccgaggttgcgaagggcctcatgactctgagtccctgtgaccaccaggcagtctttgcatccctcgagtcggtgcccttgcaccaagcattcgtgccctggctcccatggcagcatgccctcctggttttcctcctccttctctggatgtttctgctcagcttgccttgtggatcttcttcttcttcttctccttctccttctccttctccttcttctcttcttcttcttcttcttcttcttcttcttcttcttcttcttcttctcttcttcttctcttcttcttcttcttcttcttcttcttcttcttcttcttcttcttcttcttcttcttcttcttcttcttcttcttcttctccttctccttctccttctccttctccttcttccttctccttctccttcttccttcttcttcttccttctccttctccttcttccttctccttctccttctccttcttccttcttcttcttcctcttctttcttcttcttcttccttcttcttcttcctcttcctcttcttctccttcttttttttttttttttgagacagagtctcgcactatcgcccaggctggagtgcagtggtatgatctcagctcactgcaatctccacctccagggttcaagtgattctcctgcctcagcctccctagcagctgggattacaggcacctgccaccacgctcagctaattttttgtattttagtagagatggggtttcaccatgttgcccaggctggcctcgaactcttgagctcaggcaatccacccacctcggcctcccaaagtgctaggattacaggcatgagccaccgcacctggcctgcctacttcttacgtgatggtctatcttgagagttctgcccagatcctttttataaccatagaacaggtttctctactgagctccagccctatgtacccgaatatttactggacatctctacttagaggcttcataagtaattccagctcaaatgtgtccaaagtgaaattcattggctttccccccaaaccttcttttcttcacatgatcctgatgtggctcacccgcttgtttaagccagaggctagagcatcatccaaggcttccccatttcccttagcccctatgaccagtcactaacttttaaaaatcttacttctaaatattgttcatctctctattcccagtactcgtcatagcgccttgtagacacttgataagcagtggtcttatggctggtagcccaggcagctcttgatcctgtcccctgggttccttccccctttccctggctcaggccaccatcacctttgacctgaatgcatccacgcaactggttttcccaccttcagttttcccttctagctcgctcactctccacaccacagagagtaatctttcaaagcacaaatgaggtctgtctcattctcttgcttacacccttcagaaagctgtctcccagcacctagcataacaccaggtccttataagtactcaaaaaatatgtgttcaatgaaaaaataattgggatctaaaataaagaggatttccaggcacacgggaagtctaacacccattaatcctgtgccattattgtacttgcccgtttgcaacaaggaacatctttggcttcacacacccgacccacagactgcgcttcagctgctgctgactccctcccagaaggccccagagtagtcttgatttaaaggcagggctgttgggggatttggaagaagtgttaaagaaaaaggagcagctttgctctattaaaacccctgcctttccaagcaaatatggctgctcctgagctcaccctggcttctgccattgcttggccaaggtgattaactggatgcctgctgtgtgctcatccctgccccatcaacaccctcacctcaaccctcctggttagcctctctgatgttgagaatgaaagttgttattagcatgattcactctccaacagcatgaatattcggtgtgactgtggctctgtgtatgtgtgtgtgtgtacatgcttatgtgtgtgtgtgtgtgttgcagtggaggaggttgggataaaattgaaaaaaaaaaaaaacagtcctaggagttatgcccttagggcaaagggaaaaggggtgctcacacacttgtcctagagagagatgtacacttttgcacagcttcctcctcaccataaaaaggtcgggggggggggggggctgttggtcacaggattgtgcaaagccctgcaagggtttggctggtgcacctgctctgctatgtctccacctgccacacaccattgcaaccccctggtaacagaaaggttcccttcccttccccaggctgttggtgccgtgggatctaacatgcatgtgtcctgacaggatgagagagcaggcacacgcatgaggcagcctggtggcagaaggccctgctcttttccaggatgcctgtggtggcggggggagcatggcaatgaagaagggatgggacagtgatcaggaaagcttcatggctgtcctatgatgacataggcctggagacacagaggctgcctgaggccagcttgggggatttacgaactaaatggaagaggctgtcaggttcgagctgagctcagtatgagggctgagcaggagagcagatgtcagggactgggagtttggccagccctgccctctcctccttggcagtatgtcttcctgttgtcaatggccaccagccgtccagcttcattctccactgggtctatgactgccagcatcccggagccacttccagggactgggttaaggtgagaacgttgtggtcacctctgctgcctactcccaccctccctgctcctgcacttctctctggccacaggtgccaggcagcatggctgcactgcaacagcctccctaccagcccaggtaccggccttctccatcctctcctgccaccgcatgtccccaggcactccttcctcctctatctgtgacagtcagagaacagggctttctgccaggttgacatcaacagcaaacagacacccccggatctgagacatctgtgtcctatccagaaacatacctcatcctatgtactgcagtgactcagtcatgggcagagacacctggctgtcttcccatgatgttcttatatgactctaaccaccacgcccctctgcctcgaaccccttacccacacaatcactttgggcctcagcccatcgctccaggagtggaggagatgattggtaagaagaacgctggaggtgcacactgcctggcaacaaaggacaggtgggtggcagacgaaaacttggggcctggcacacctgggtttgaactctggatagaccatctacttgatgtgtgacctctgtgcagcgattcagttccttcttctgtaagatgggaaaagaggatctagccagtgggttgtgagaacgaaagttaacattaagcattcctaacacagtaccccacattgccactgactgtagttatgctcatttgaatatttccctgtcatatggtaatgagcagctctctttggagccacgcaccttcctccctgggctctgccaaggtaggtcacggctctgagagactgcaggaaggcttctcagaggagctggtactatgaggggtgactcggctgggcttctgtctctacacacgtcccttgcctttgcagaagcctctcaccagcacccttcctgccccggtgacttgctgccagagctctgcctggaagtgtgatggaagccacctggcatgagcttgaaaggaactgcaaatctcctatgagcatttcccccctgctctgtggttgggatgcagtgcacggccaagcagcatggaaacctctgacgttgggtggcttctgaatactaaagagggcgcggaaaaaatgaaagcaaaggagaaagatgtcttggtcagaagtttttctaatcgctatggatttttcccccattttagtggatttgagagagggtataggaaaaggaagagaaaaaaatcaaaagcagattattaccccgagctgctcttcctttttatcctgagccatgacagcagctctctgcctgccctgtctgcatgctaacagctaaggcatgatgcaggcaaaatattggcaatcgagctgagattataggttacttggatattgaaaggcagaatcaattaaaataaagctttccagtcactggccaaattagcctctggaatcaaagcctttcttttcattgtccagaaggttctaaggacagctgagatggggttacccaaatgactgaaatgaaaagctcccaactgcagcacacgacacctggggagtaagcacacacacacacacgcacgcacgcacatgcatacatgcacacacatacatgcacacaacacactatgcacttgatacacagtggttactcaatgaatatttgttgagtttatgattttgtgtgtgtacacactcatacttatgtgtcttacccagttatatatacaccattctataattatttcaactttgcaatgctaggagttaactctgccaggcttctgtgagtttgtactaggcttacatttttctttctctctttattataacaagaatacattattttaataaatacaaaaaggaaaggtctcctttgaccactctgcctttggtctacttttacagaaaatgcggacattatggaaaactttatagaaatgtggctttttactaagccatctaacaatagaatagaaaagcaacgaagatttccagtgcttcttccctcctccctctgtcttccacctcctgaatcttcagcagcatgcacagaaaaaccaagcataggaatgtgctttgatatccacccggggctttcccacattctcaaaatctcaagagtagctcttcttagaaggtgtggccttggaatgtggagaggcagcaccatccagacaaggctgtccaggcaggaggtcctgcacatccaccttgcaattcacttaggctttgccactttggggatctacagttttaaatagcttatgatgaaagctcataactttttcatttataagtggagaatttcaatgaggaaacaaataaaaaaaccaatatttgttgagtgctcctgtgcttctccaggctggatgaaggctccaagatggcgtctcacaaggagttcagaatctaatgtgctcaaatcacacaagtcattgccataagtgctaccgtcaatgtatttttaaaaagagcccagaaaagagagattcactctgcataggagcttcactggccttgaggatgtgcaggagtttgctaggtagagaagagatgggatagatcccaccagtgggaagatcaggaacaaagctcagatatctggatgtgcacccagtgtttagggaatggtggatgtggggctagagcagaggtggggaagaaatgaggtggaaaagttgactggggccagatgtccttgggccttgaaatccttcctacttcatcctttaggcaatgggcagcgattcccggacataggtccagaggctgggattgccctgatcagggctggttttggaaagacagctctgaaattagtgtagggaatgaacttgagaaaagaggccctgcaggcggacactgtcatgagctggaggctgaagcctgggaccccgacgtggtggcgaaaatcagggaaaaggcaggactggggctatttcagaagtgttagccatgcttgggggagagcaaggtctcagttaatgcaaaagaccctcaccagcatgactgggtggaaaaggatgttttaatggacataaggaacacagcagatgtagagttttattttttttctttttaaagttggtttgttttgttgattggtttggaggcagaagaggtcacgaaggagagggaagaattaagttaagtttgtggcgcttatgagctatgtggatggtggtatctagtttatttctctgagcttaggtaaaaggttaaggccaaactatgggcttgggagccatgagcaaacccatgattggtcaaactatgagaatgaatggatgaaataaatcaacatggacagaaagagagagtaaaagaaaagagagagaaaaatcagagatagaaagacagaggtcaagttcagatgtacataccccttaggagcttttcaaggacgtcggcagggagctgggtttacagagtggagaggacacatctgccaactgtgactgagcgtggtcagagggaggagaaaaggcacaagagagcaaaacatcttgcaagctaatggagaatagaattttaaggaggacagagaggtcaaagtccccaggaagtcaagtgacaagatgtggtcatagtgtagggatgagtcccagagcctcctcccaggtccaaaatgtagctaatgatccgaatgaaatccagacagggagtcaagacagggaaggtacaggcttgtgggtgctgagggtgtggacaggaagagaggcaggagactcagagtgaaggggagaggccttttgtgtacagaaagaaggaggtcagttccacaaatgctgccgtctggaatgcagaattttctgacttgcctaaaaagatcgaaacaaaacctaagaagcagaaaacaaataaaaataagacaccaaataccaaaagccaaataagaccacgtaaaagcaaacagagcctcctcaagccagagaggcccctgacccagttttgcagcagcaagacccagagttccatccaggaagcaggctgcggcagtgagtcgcccaggcctagaaaccaaaaatccagcctgcctggagtcctcttgggtatgaaagttcctggagaatctattcatggcttccaatttccattcatcaggctgcacatttgcctaagagcgattccacgctaaacataactcagcccagaaaaatgctcctctgcgctctctttccactgctgaatttcagcttggcttaagtaacaccatgtgacataacacaaagaggtgaaatgagagctcataattgcatcagagggctgtgggggagccacccccccccccccacctcaccgattcccaagtacacttgagggaggaggaaggaggggtgtgtaatttgttcatttcttatattttatggaacacttcactttgctttcagcataattatttgttgtacattttgctgattcccatttgtgtgcttaaaaaaaaaaaactcttcactcccccctgcacacttttcttaatgcattaaaattaataactcgtaacagtgacctaatttgctttgagtactgtaactcagggttgttgtatgcgtgtgtattttttttctttccagatctgctaaacccttgacatgttactgtggtaacaggagcaacttgggaagttcatgaatgaacctcattgtgttctcccaagaaagccctctctcccaccattctttgcgatgtttggagctcacccttgcctgttgtgcctatattcaaagcattggaattgggctgctccaggctgtctccaaatccatgctcaatccccatcatctcactgccctactgcggaggtagctgccagtctgcccttaactttcctaaatgctccagggctctgcatcaggagggttctccttctctaagaaaatatactttcttggtttaaatcttctgcccttccctgccatgtctgtctgggccctcagctaaggaagcctgctgaagataggaagtaggtcactggattgcttcatcccctgactaccacctcaatccaagccaccagcttcttccctaattgtctcactgcattctatctgctcccccaaccccctccatatccagtgcagttagaggggtcttactaaatcaggtatctggttgtgttactgtcctgctcagtgatcccaggattgtgtccctacccctgcacacagctgaccaggctcttcagagtctgcagacatagagctgtacttgccccaaggtccattgcctcctctgtacatgttcctcctagctatcctgaacgacctggatttgccaggctatggcacagtcatttttctgcatgctttcacattcggttccctctgccagaattcccctatccatctcccactctcacacaggacgagtgtagacagcaccttctctcagaaagctttgggcagttggataccctacctgtgagttcccacaggcctctatgctcatctcagcatggaacttatgtgcactacctgtgtttgtctgctggtcttgctggcttccccagtaagctctttgagggaaagtcctgtttcttggacactgttgtttcttggacactgttgttatctccagaacctatcgcagtgtctggcacataggatgtactgaaatcaagattgaatgaatgaatgaatggatagactggaatctattacctgcctttcctccctccctccatacattccttctttccttccttcctccctaccccaccctactttcctgtcaatcactccacaagcattcactgctggttatgtgaaagggaaggaggatataaagacggattttattgtcttccaggaacccatagcattgtggcatccagactttgagacaatcttaaatacgttcttctgaaggctcccttaagtaagccctcttggctagtcattctagagaatgaagctgttttatgtccaaatctactttctagtagcaagtataagaatgaggattccaagtcctagttgtctaaataatttaaatatggaatagtggcagatacccatattcattcttccttacagcattctggggaagattatcaccagtttacagacagtagcaatgaggccagaaaggtggactcaatccccttatggcaaagagaaaagatggtgacaaatgatgctagtaactgagggctgccagcacccagggagccccaggacacgtgttgccttctcaccccaataggagtagatggacgaggcatactcgtaccaaggagggcataaggattttatttccacagctacctggagaagaaaattcatcatcaccctcagcagacagcaagaaaagaagagaaagaataagaatgtatcaaggaggcttggtattgattttgaaatcctggctgacaagacaatgatttgagtccatttccattttgtggctgaagcctggtgcattctttgcctctgcctgacctcccagagcagagttcatcaagaatcccctctgctgacactcctatcctgattctcaaacagcctctcgcctgtttgtctccgacaagaaaggacatgcacgtgaaaggagcagtgtggcttcctgtgtctcctctggaagaggagggccctatttcaaggctgatttcaaatagtacattttaaaagtctgcttagcctcacacacatatgagcatcaacattagtgtctttacggaggttttcggcccgcacagaaagggcaaagctcaatgcattcaacccaacaagcagcaggttcccgtcttggacaccgaaagtggggggtcctatttcaagactgatttcaaatagcacattttgaaattctgcttaacctcacacagatatgaccatcaacattagtatcgttatgaaggttttcggcccatacagaaagggcaagtctcaatgcattgaacccaataagcagcaggtccctgtcttggacggtccctgctacagccacccccagcaggctcttcaggccaggaaatgtgcttctgctgtgagtcccagctcttcgcatggccagaatcctaagtaagggcaaaaggcctatgtatttaatttacttgtaagtgaacagcttctatgtgttagaaaaaaataaactcaacctacaaaattgtaattgcttgagatttcacctcctggccacgtttctcttcctatggagttattaaaacccacacaatatgatctaataatttattaataatcaacataaatagataacagctcacatagccataatagccaatgcatgttaaataatgagggattatttaaaagacacttcgctggagagaaggagacatggtagttagaatctgcaattactgctgcagttgcagataagcatgtacacaaggccttcttggctgttcaactggctaccttgtgcccctgttactccatctgcatttggaaggggtggggtatcagccagtccctgcttaacagaaaaagacgtccaaattaattggaagggaacaaaccatttcttcacaggacaaaggaaaaatgctgtgcaattcaatttctctgaaaggagctcaacaatactccatctcctgtcccactatcaaagtccctatcatcaaacctgggcatgtctttctcatggcagtttctttatccttactccttgaaaaataagtgagtgagcctaagttcattgcagcctaatgagggactccctggtcccttctgtcattctagtccctatttgtaagcccttcctccttcaagtcatcacgttatctgccttaggggaacctcctttatactctttgcatgttttaaagaatttcaaattcaatatcagatgcttggcaactagattggaaggaaagcagaaggaaaactgtctttatttgtagattatttcatatgtaaaaaaatcccaaagaatctacaaaaaaatcactagaactaataaatgaagtcagcaagttcacaagatcaatacacaaaattaatttggtttctacacacaagaaatcatccaaaaatggaattaagatatcaattccatttacaatagcataaatagcattaaaataatcaaattctagaaaggagtttaacaaaagaagtgaaatacttgtacaattcccaccaaaaaggaaaaaaaaaaaccaaaaacatggagagaaattaaagaagttctaaataaatggagagacattccattttaatggttaaaaaatgttaagatgacaattcttcccaaatcatctttaggttaaacacaatttctattaaaatctcaacaggcttttttctcccctaaaattgacaatcaagttctaagatttacatggaaatgcaaaggatctggaaaagacaaaaaaaaaaaaaaatgcaaaagaacaaagttggagcatttaaatttcctggttttaaaacatactacaaagttacagtaatccacacagtgtggtgctgacaaaactatagacatatggacatatagatcaatgaagcagaattgagagcccagaattaagctcttatatttagggatttttttaaagaaggtatcaagataattcaatggaagaatagtcttttcaacaaatggttctgaaacaactagacattcacaggcaaaaatatgaacttagaccctggcctcataccacaagcacaaattaaccccaaattgatattgacataaatgtagaagctaaaactacaaaaattttaaaagaaaatatagtagaaaaccactgtgactttgggtttttctatacacaccaaaagcacaatccatagaataacatgaagaatgtgaacttcatcaaaattaaaaatttctgcatttgaaaagacaatattaggaaaatgaaaagaggagccacacactgagagaaaattccatgaatcatatacttgataaataacttgctgtagaacgtataggaaactcttaaaatataataataagtaagtaatgccattaaaaatggatgaaattcaagagtattaacagacagttcataatggaagaaaacatttgcaaaagtcatatctgacaaaggaatgatatccaaaatatacaaagaactcttaaaactcagcaataagaaaatggcaacttgattttaaaaatgagcaaaagacggccaggcgcggagactcatgcctgtaatcccagcactttgggaagccgaggcggacagatcacgaggtcaggacatcgaggctatcctggctaacgcggtgaaaccctgtgtctactaaaaatacaaaaaatagctgggcatggtggcgggtgcctgtagtcccagctactctggaggaatggcatgaacaccggagtcggagcttgcagtgagccggggtgacaccactgcactccagcttccagcttgggccatagagcaagactccgtcttaaaaaaaaaaaaaaaagagcaaaagacaccaccaaagatatacaagcatgtcaaatatgcatatgaaaaaatgcttgtcatgagagaatttcaaattaaaacaacaataagataccactacatacttattataatgaccaaaatccagaacacaggacaagagcaaatgctggcaaggatgtggagcaacaggccctctcattcactgctgctgggaaggcaaaatggcacagccacttggaagacagtgtggcagttaaaaaaaaaaaaaaaagaaaagaaacatactctcactatatgttccagcagttattctccttggtatttatccaaatgagttaaaaatgtaggtccacacaaaaacctgcacacagatgtttatagtattttcattcacggttgccaacacttggaagcaaccaagatgaccttcagcaggtgaatggaaaaataacctgtggtacatccagacaactggaatattatttggtgttaaaaagaactgagctattaagccataaaaggcatagaggaaactgaaatgcttattaccaagtgaaagaagccaatctgaaaaggctacacatactatatgattccaactagatgatattctggaaaagacaacattatagaaataatacaaagattagtggttgccagggtttgtggggaggaagagatgaaaagtagggcacagaggatttttagggcagtgaatctatcctctttgatactacgtggtagatgcaagtcattatacatgtgttcaaacccataacatgtactgcactaagagtgaatcttagtgttaattataaacttcgggtggtaatgatgtgtcaatggaggtccatcagttgtaacaaatgggccactctggctggtgtgagatatcaatactgggggaggctgtgcctttgtcaggagcagggtcatatatgggacctctgtactttctgttcaatctcttgtgagcctaaagctgctctaaaaattaaatctacattttcaaaaatgggcaaaaaatcttcaaaagacatttcaccaaagaagatatacaaatagctaataagcacataaaaaactgcttaacatcattaatcactggggaaatacaaattaaaaccacaatgagataccacttcatacccactagaatggctataataaaaaagacagaaataacagatgttggtaaggatgtaaataaactggaaccctcaatacattgctggtagaaatgttaaatgttacagccactttggaaaatagttcagtagtttcttaaaaacataaatttaccatatgatccagcaattccactcctagatgtctgcccaagagaaatgaaaacatatgtccacacaaagacatgtacacaagtgttcacggcagcattattcataacagcaacaaagtggaaaaaaatctaaatgtccatcgactggtaaaagaatatacaaaatgtggtctatccgtacaataaaatgctattcagcaaaaaaaaaaaaaaaagcaaatgcatattgaatgcatattgatgcatgctactacacggatgcacctcaaaaccatactaagtgaaagcaaccagatacaaaagaccacaaattgtaaaattccattgatacgaaatgtccagaaaagacaaatctctagcaatagagtatagaattgtagttgcccacagcagtgggtgggaatgcagatgatctgcaaatgggcatgagggatcacttgggagagatggaattgttctaaaactagattgtagtgatgtccgaacaactgtgtaaatttactaaaattcattcaattgcaaagttaaaacagtaaatgtgatggtatgtaaattatacctcaataaagctgttaaggaatagcagatgcttattaaggatgtcaggagggtacacgaatgcagagggcacacactaagaacactacctatgattaatttaacataaccccattactggtgaatgtgtctttcaggaatacctcctgctgttgttgtatttatctaggacatagcctcacacttacatcaagcagagacaattgaagccaccaagttcaatccaagcatcatctcactggcagaatgaaacaggataacctccagcttagccagaaagaggatatgacccgtcaactagtactgaaacaaccactgccttccaaatgcctcccatttatctcagtgtgggttaaaaggcctaagcaatatagttatcacttgccagttgactggcctctcctttgtacaagggcttggatagggataataacttacttttgtaaagcacttacaaagtgccttaacatacactagctcatctattcccatagcagctctatcagcagatgtggcaggcgctcttggttgacaggccccgtcattatcgcagctccagtcaaggacacgtgagcatacatttcctggaggagctttggagaaagcttttgccttactgatacaataagacagatactcggtctcttcctcttttccctcctctgtgcctgaaacaaggatgatgccataaaaaaacagcagttggccgggcgtggtggctcatgcctgtaatcccagcactttggaggccaaggcgggtggatcacgaggtcaggagatcaagaccatcctggctaacacagtgaaaccccatctctactaaaaatacaaaaaatcagccgggcgtggtggcaggtgcctgtagtcccagctgctcgggaggctgaggcaggagaatggtgtgaaccaaggaggcggagcttgcagtgagcaggaattgcaccactgcactccagcctgggcgacagagcgagactccgtcccacaaaacaaaaaaccaaaaaaaacccacagcagtcatgttggtactgccaggggagcagtgggtagaaagggccaagagaaccccaaagagtcacagagatgctgcttctgacatgggtaaactgctggaccaactctggcagcatctccctagaagccatgttaagagaaacaaatgaatccctacttgtttataccattgtggttgggttttctgtttgttgttgccaaacctatacctacctggcaaagtaggaattattagtcacacttcacagatgcaaaaagttgtaagtctttgaaaaactctgcaacccatcaaaccaacatcaaaatgccagcaacttgcactcagtttcctgaatttaataacagagttaataacagccacaaccacaaaagccacctattgggttccaagtggtgtcaaggctctaatgacactgggcacttgactggcatattttctctaattcttacaactctgcaggctgagtgttactatctctattttatggatgagcacagtaaggctaagaaaggtcaagtaaattgctcaagatcacataggtagtaagtggtagggccaccattctaaactggcatgtgtcttgcctgctatgaagaaagcttaaaggaataaaacatacttcctaggattaggcaaccagctactctaggtctccactgattaaaaacattatgtataggaaattagcagggatgattgctcgtgggagtcaggttagctagccaaactcataatatttgcttgtgtgttccaactgtcatactctaaactgtaacataaagaaagtttctagacacaattttcttttcactgtttacaaccacttttgtatcttatagaaataaaatagaaaaaacacacactgattacaagatgcacagtacctacgaaaatctctacaggatatgtgagatcagctttcttccagagagtgggtaacaattaaaacaccagtttttgtcagcaccaggcctaaggacagcagcctggaacccagaacaagtaggatgagacaggagtctctaggtagagggtaaagatcagcctaggtacctgccagggaaaaagcttcagtgtgagaaggaagctcctagctgagccccgccctgccaggcacacatagtacggacccgcagtgatgcctgttgttatcaatgtatggatagtattggtagtttctagtagacttgagctgctgtgggggtctgtgcatgttggattggacttagaggagggtggtaaaaaccagttcagagaaatttgtagatgttaattgcaaactgctttctcttcaccagaagcaatctctcccttctgagatgggcaacatcatctatctccatcaggcccaatgggctgctccaccttcgagcgcttaattagtttgtctttctggatgctctgtcctcccccatcaaagacaagtaattggttctcttaaacatggggcatccagaactgatggagaagtcttttcaagggatcatggaactctgtgctagggagaagacaggcctcagattctgtcaggtagggttctagatggtgctgctgagaggctaccttattttcacaagttccaatgctagcagggactctcctggccaccttaagtggcgtttccaggagaaaggctgctcctctggtaggctgcaagcatcacttcgatttgtgaggtaagacaaaaaggacaggtgaactaggaggatcacaccggtacctttgtgaggagcaagcatctccccttccttcagactgggttgtttagacccaaacttgcccttggtcctcccaaatgctgctatttccctctatatgattgagtcagcatttctactttatatgaaactgatattatagcaaatcttatcaccatgaatgtaatgaatcttcctgccaagttatcatcttgtgtctctcagaggtgtgtcttctttcccaaggtcactctgggcaacttgagtgagccacaggttcatacaggggccttgggacaatcattaggagaaacccagtacaaataaaaatctgattagactttacctcctctgacttttcaccacctcctctatcctactctaccaaccttcagactcttctagctacaggctttcccagagcccatctctggggataaaatggactcatttagctcattgaacagatcatcaaatgcccactcccccaagaaaagaagcagtttggaccacaggcaggtcagaatgccctagcacttccacaaacagcctgctctcaaaggattgtcaaacgtgcaacaaatcagtgttctctcatcaaaagcatcataactcatttaacattgagcctatatctttttaaatatatcctttttttctagattggaaaaacaatagttgtttcttttttcttttatttcagcagggttccagataataaaaagatttataattacgccagtagatttacttttgctatgccgccctagattatgaaaaagtataattatatgcaattaaaaaatgaacagtatttcttacccgagtgaagctttaaaagtcattatgaatccattagctcagcagaccttacaaacggccttcactactctggactgcatttaaatttacaacagagagaagtaacttttcctcatttccacggtgtgtgtgtgtgtctgtgggtgcatgcattttcacccttctcagccatacctggaagtggccattcatttttacattctaaggccatgttcttagtattgaacttgaccacacagctcataatgctttagaagcctccagctagaacactgaggaatgacctcagaattcttctacttagccttgtccctacctctttactcctctgtaggcagtaattcttttttcttttctttcttttttttttcttttggtgtaacagtatcgcatgagccaagactgtcatgaaactatttggatactgtactctggttccttcatctcctccatctgcatcagcctaaattgtcctagtgagttcacttatgtctgggttactgtagatttgggttttgctattactagttgtctcacttatccagataattacctagcttgattgaagcttagtctgttgactaccagaaaacaacacatacgggagaattgatctagataattcagacaccattcatgatgttatttcaattgagcattcttgtgtgacaagaactggtaattattgaaaatttcatctgcataaaaatactagatcttacccacaagtccatttcctcttgtctctcagtgttagactcaccctcagcatcatttttggcagtggcccagcagttatagtaaaaacaaacaaacaaaaaaccctccattgtcttttatttaactggccaaaattgccacctgatctctccagtctcactgtatttgtctgatgctgttagagccttctctgtagtggctgcaagtctgctaataatcagaatcacttgggaagcaattagaagtatacagagatgagtcctaacccagactcatgatcagaaattccagaagtggagctcaggaatctgcattttaaaatcactcaccaggtgattctcaggcagccagcctcgcatggtgcataaactgacgttgacattccggcagcctagacaatgggtatactcaggtgaataagagggatggtctcttctctggtcatttttctactcttacctcttcatcctttcttagtcttctgattcaagcctggatgaataaggattcctggaatagtacaaaatacttgcaactctcgcagtcttcccagagtgggctggatgaagggtgctatccccaaatcaggggccgtgccctgggaaggatggtaggcctccagggatctatctcagtgtaactaactcctcagtgggctcaaaactttccctcttgctttctagtttttaggttttctagttctgttgtgccctttattcaatgcaagccatcaacaagttccttaaacataaaactctgtgacactctaaactgcaagacaatgtgacaatgagtatgccagtctgaaaagaacaaaggagcagggttcagaagaactggcctttaccagctctgtcattttccagtggtgtggccttgcagaggtcacttcagttttccaggctttggccaaagaaaggtgggggcaggtggtaccttcccagctcaagtcttctggaatagagcgtacgcccatgaagccctgcacctgttggagcttcatagctgtaatcaaggtattaatctctctgagccttagtttactcattaataaaattggaataatagtattctcaaccatatagttgagtaagaattaagtgcctctaaaacccctagcatcacgcctggcacacggtaaacactgagtatctttaacatgatgtcatcatcatcatcatcatcatgaaaaacatactttctcatgttctaaagggcccaattcatactgcccactgtatcactctgacaaggtaacaaagtgacctcagaaacctggctaacaagagatcaaggcataaccctagccatggattcagggaacagaagctggcccttctgtggaagtcccggctgcccaggtccatgtcgtccctggctcttccagctggagggggtcactcaagcactgtggagtgacagccagacaggaaagcaactgcatttgtcctaggagtcatgtggcatgtgctggatggcgttttgaataacattttaatgaaccaagtccttcagtgtaatgcaacctcagaggtctgaacatgctggccttctcccctgcactctttgtgtggccactccaagagtagatgcgctcccttgaggcgctcccttgagccctggagcttgccgggggcagccaccccttccaggatttctgctttccatgcaatctcccttttccttctctctctgagaacctcaaaaccaagttgtttgtaaactcctctacagccccaaatggctctgttgcaaggctcggctcgttaacatgcaggcagtaaagtatgtcaggagctctgatttgtcatattaaggaggctatatgactgtggagaggaacattaaaagattttattctaagatattccctccaatccccacccactgcagacaaagtctcttgggacaagcctctgcttcagtgctcttgattgcacagatttctgataaatgttttcatcagtgccataggcctgggtgctgctcctgctccactggggccttctctttggggtctcaggattggcttttgaggtgtttctgggccttaagcagctcccatggtaaaacattcaccgtcattctttctctcttctcactcactcaattacagttaaagccctgttccagggaggagtggagggagactccatctccaccacggaacgccttactcctggaactaatcacagcatttctctaccctcctcggaacaatctgataccattatcactgacatcatcaaaagaagttccctttatagattgcattgtacaaatagaattgcctagatgtgatggctttgcccattaggagtgtacaagcatatttacacaacgccatggagcatgggtgaaggatgagcccaggacaagattaaatcagcagactgaacgataaatgaacagtaatgcattcatatcgaatacatctcagagcataagtgccatccggggtagaaggcagggaaagggcatgactgcagggtcaccagggccagaatgactgatgtgaggggtcaagggcaggctttgcctccagggaggcattaaagggccacctcctatagtgaaaggaaggctgccacatttccctatgccccctgagttttagagataccctatttgaatgagagaaaacaaagtgaggaaacggctaatctcaaggtttaggaggtgagggggacatagtatcattcggtttggtctaggtggagacttcttaatttagatattgatgcagttcgggacataccaaaatatgtcaccttggcatttgacaaaacagcagaggcaggaagtttgctctcaccttcccctcgcctttctcccctgaagcaggtggtaagattctcattccaggtgccctccctacccggaagaaaggaagatccttatctctgaagataccaggacacagagaggaatctgaataaatgggccttgctaggttccccagcttaccatcatcagattacaccctttggtcctcctattatatctctccaccactgtccattcctcatcaagtctaagcatagaaatgcacaggtttccctgtatctttgggtcttcattcccttaagaaggctcttgtgtcatgtaagacttatattccatacgtgtgtgtttttctctggttagtctgtcttttgttacaggagcctctgccatgaacccggggataagtgaggaaagaaatttttcctccttcacagtatcaagtgccaggccagggcactttgtccaggcctcactgtgaagaaagagtaatgttcaaggatggcagcaggaaggtgagaggatgaaaccaaatgctcttggagggcatcgggcttggttgccactgagaacttccagaagaggcacagctcaacgcggggtgccagtaaccgtcatgccttcctgtcccagtgggctgacttgagacaaagcacagctgtggtccacgccttgagacttccactgggcaaggaagcccaagtgaggctccccgcacctctgccaccttcccctacacccacacctgcaaacctggggagagtgacaccagccttccccagctcctctctcagtctaggctggagctgactcggagagaattgaattcccttctccattgctcctggggccgctaattcatagctgcattagctttcatttgggtaacagcatgggggattgtcagatattggctctgaccagatttaatctacaggctgtgttctgccctctttccacttgcctttcattcaggaccctaatgaagaggtttatctgattggtttactggagtcctatgtgggatgaatagcttcagcctttgcgcttgcacctctttgctgtccactccaatcaagaacgggggccctcgcaactctctcagttctgaaacaaattaaatctcagtgacagactctatctgcctcgagttctccattatgcttcgctttaggtttgctttggcaatgacaaaactgctttgacatatttgcggattctcaggcccgtgttctcagctcccccacctccacctttctgctgtccaatgtgatttttgtaatggcaaaaccattgcgatccttctcaggcatcccagtgtctatagcttttcagctacatatcagcaacattcagccacaagtgtggctctgacaggctgtggggggcagaggtgggagaatgccagagactggggagtggtttcctaagcctccttcctcaccctccttccagcagttcactcctttaaagagaaatcattctctcccgtgtctccgcaggtcactggaagaatgtggcctggggcccttcagtaccatttaaatctatgcttgcaatttagcaaatctttagatctgttcccccaggctgtggggaaacagatctcaggtttcccctgatgccttcaggggaagctgcaaaactaccttcaccctaatcacctgcctcattagactcacaacagacagatgttccctcctccttgagggcttctaacttaagcctttctcacctaagtttccttataatggcgggaaaagagaggaacagaatcccaggtaggccatcaatcatcctaacgttgacaacaataagcatgttgacggttataaagtctgcgttttccaagcttctgttagtatgctaagagttgccctgttggaattaataattgcaatgatattggtgttgtagtcatcacttgaggcctattaaggtcccttttagttctaaaatactgttcattcattgcctcattcatgcattcaccaaacactgagcatccaccatatatcagagcctttggtcagagttccctggatggaagtcctgtggtgactgctgctccatctgagccccttaaaatctcagagactgagctgggtgttttagaaattcaggtagtcacaaatcctgaccagaatggctgagatttctgagctggaacccagcaccctagaactaaggctcaagccccttgtgagaacaagaaccctaagcttagatgccagaattcaagtttcagtttttccccttaaaatgaccctaaatcccttaaaactgcaaaatgagtggtcatgccccagactgcggcctccagactctgctactagccagccactcttgtcatctggaagggaagatttggttgctacaacatgccaccatactgggagttgcaagacctggtttggtcctcatgcattggatcaccttactcaaaccaccttggcctcagcttcttcattaataaaatgctattagactttatttacacacagttgaaaaaggactaatacaaatgcccataaaatctacagactagactagatgttaagtaaggtgactttccactctaaaactctatacattatttgattcatttatttaacatatcttgagaacatgttttatgtcagttactatgataagagctcataaaatatgtcccaatatccataacaggaaggacattacttcataataagattaaatggctgcaaaaaattcaatgcttggatatcctaataacaggtgtaataataatcactactcttattaattttgtacttatcatatgtcaggcaacagagtgaatgttctacacaggttttgttgcaatttatcttcacgaaacaaccatataagtagatatcattgtacattgttcaaccactatttattgtgtaactagggtgtggtgggccttgaactaggcatttggtatcaccatacagagattgaatgtgcaggcattgagtggttaaataacttcctaggcacactgcttgcaaatggcagaaagaaccagaaatcttatccgctaggctctagaacccaagttcctaactgctaactttcatgcctacatcagcttggttttcatgatcctcaaaatgtcagtcaaagccagtgttttctgaatcaataactccctccctcacagtgtccttttccaacttagctcctctcgtttatgagccaaccatctccatggcagtccccttcactatgaaatagtcgtttgtattctccaggcttcactagttctcattttcaattgccacctgaacactgctactgctattttcttcttgtcttccactctttgctctctccttcacctctcctataactctgcaaaagatctgtgaattggctaagctgaaggactctaccataacctgattccagagaagcaaactgtgaacccttttgaaaacatttgctgcactactcagagcagacgtagtgaccaggaattcaagaccaactttcaatgaagctggaagtgtgcctgtcttggcggatttagaaactggacagccccttcctatcttgaaaccacatttgatttgacagcgtagctaaaaggaaaaggacgaatagtaactgagttgagttttatgtgcacacggaacatataaacacagcttcaagataaagaactttgagtcagattttcacatgtcatgtgtgagaccatgcagcaaacaatagagagatgggatgggatagctgttgcagactgagatgggattaaaaagggatcccatggcttttcacttagctaaaacaatctggaaatgttaacgtcataatgcacagcatcaccttagggagttctccaaaacaatggctggctgttcagactaatcagacattggtataatctttgacctcagtctaaataggtagctctcagaatctgtgtggctgttcatgctgtcaggggccatgatgctggaatgggaggtgaactggaactgtgaagctacttgataaaacatggtgttgggctccttaggcgttaactcagatatcccaattgctgcttggctaccccaaaactccaacgcacctcattatttcataagagatgttaaatacaaattgttcattaaaatacatattattggatgttaaactaccgtgtaattgattttctatccattgcctagtggttaaccctcaataaatgctttttgtaatcaacttaaagtataatacctaccacgcttgatgtctttctcctttgatttaataagaaaccaattctatattattgaaattgtacttgataatgaaaaagttggtcaaatttcaagaatagcataaaaaaaaaacctctttggcctgaacctgtccaactttatagagggatctcagtacaacggagaactcaggggaacctaggtcctgttccaaccatggggtattagctaaggtccaagagagtcaagtgctatgctcagagctaagagaacagcggggtagactagaaatactatgcagggactcttgttcatagtgcaatgcccaaagaactagcatagttcttccccagggttatgagatcaagaaaactatgagggattttaggcttcccaaaaagcataaaaagcagttaagcatttaaaagatctatgggactcagtttccttattcagagcttgaccagtgctcttttttgctttcttcaaaatctggctaggatttccacctcctcagggagtctgccttgactggatggaaatacaaggtgactgacgccatccatagggtaaacaaagtggtacaatggttagttcaactccagcaaggcagacagctggatatggggaggagttcagaagccagggaaagagatgtgagctcaccctcaaagcttctgaagtgtccacataatccccaaccctacagcctccaaaacataatcccatatacatataccatataacatgctgggctaggagaagaatgcctgaaagaaaacatgcactgctccaggaaaagcaccaggcacagagcaagtgtttaaaatgttagccattcttggctttttatattaatgtttattattctacaacatgatttttaatttgcttaaataatctcctgactaatggacattgagaggaatattatacagttatttattcattcatatattgcctcagctttctaaatatgaatttgctgggtctacaggtatgatttctggtgagcttttaagacatggaactcacactcttactagaagtgctgtacagaagcagcgcatgagatcattgtggttgggtgatctcaccatgtggttaccatggcctaggaatctttgtgaggtggtgggtcttctgtcagggggaggtagaaagaagcagcagaatgactctttatcagaactgctctaaagggactttatgtgattagtaggctttggaccctcgcatcctttccagttctgaaatgttctgattcataggcttctggaacacagagatgctcatgcacatgcccctccccatggagggacacaaagatgcatttccgcctggaagcacgacaggctgctaagctttttgcctggatgctctcacccttggagatcagaagctgagcatctctccattcagccatcaacaaaagggagagattgcctgagcagcatgctgttgttagacaaatcggaatcctcttctagaaaggcattctcttctgcatagtgagtgggaagcctgctgtatctaggacacgttcccaaaataaaattcagtggtcaccaactgactcagtgtaggagacttcattctccaagagagaagggctgctaagaatggcaggaaccacccacagatggtctgggtaccagttgcatcaacagatgcatacacaacacagccctttcctctaaagcatccagccaagctcacatcgagttctccactgtgtacattaaaaccaaaataaataatccaagaaaatctgcacgtctgtgtgtttagggttcaagatgaatcaggcaataggccaaaaaggaatgtaagacatttgaccactatttttttcttccttgttttttttaaatggaaacctaagcattagatcactttccacccttaaaatatgcaaggatggccaggcacagtggctcacgcctataatcccagcaatttgggaggccgaggcaggtggatcatgaagtcaggagatagagaacatcctggcccacatggtgaaactctatctctactaaaaatacaaaaatttagccaggcatggtggcgagcactcccagctactcaggaggctgaggcaggagaatcacttgaacctgggagacggagattgcagtgagcagagattgtgccactgcactccagcctggccacagagcaagactccatctgaaaacaaaaacaaaaacaaacaaacaaacaaacaaaaccaaaaaacatgcagggacacccaatgtctacaataccaaggctgacctctacgggcaggcggtaaagatctttcagaatctggccccatttacctaactcattacttatcttggaaatgttacagttcatctggtaacaatggtgtcccattgttcattcttatttttgacttcaggtccctactcatgcctagtgcattacaaaagacatttttcttctccatgtagaaagttacattctccttaatgtggatgccttcaccaactgctgctccctttcttctcccattgtacatcacacagatgaaggaggaggtggagagccacctgtctgcactcctagcctggggattctggaatgctagaacagcttcttaagagtcccatttgcatagagcaccaaagctcctcattagaaaactgatgaagaagattagactgaaaggtcctttgagggaacaaagattaatcctcccaaataaaggggagtttctaagaacaacccagttagagagattatttctgccccaagagggcaaagaacttactcagaggtaggacaaagatcaaagacatgtgttctgttaagaaaaaaaacagtttctggatgtggacagcagacagaaatgttcccaagttcttaacccaatcacatcttccaagcccctttgcaatgtatcgtcagataatcccaggctctggaggttaggatgtggatatcttttggggggccatcatctctctacctgccatgtgggataaggcacacatagtaataaggatagcttcagaaaagaggagcctgcaccttttgctttaagacaaaacagaagaaacagaaaaggcctatcaacctagagacctgagattgaaaagataggcgagtacatccgttgagatgctctgggtatttgataatggactctcatatttttacattttctctaactagaacatatgctttagaggggtagaaaccatgtcttacattttccagtttattgcctgcagcatctggctcactgaaggacacaccgtagatgctcagtaatgtctcactgatcagtgtgagaaggaggtatcaggaggagattatcgggggtatctgctgctggagatggttgtattctgcttaggaatgatacagaatagcagacaatcctgaataggaagaatttattgtgtcagggggacaccagggtataaggctgaggccccaatgagaaatgcatgcctacttcctccttctcttcatggaatgagtaattgaacttcaagtgtcaggcattaagcgaagacagctgtggcaatcattttgttaatatatgagatgctggagccaaggtaaccagaaagagaaccaagcctttgagtgacagaaacaaaggcaggagccaccagtcgctgggtccaactagtcctgcaaagaggcagatgaattggctaaatgctccctggaaaacctttccactttactgaaatctgtagtgatgaacttatttcaagaaaagaagcaattgaccaagggaaagggaaagaagaatggaaattatgctttaaaaaagatccatgatgagccagagttcaaaattacttaggagaaatagatgtgtattcatcatatagatctgtcttggaaaggacagaaaaaaagagaggagatagaggaaaaatgagggcttaagaataaatagagttttggctgggcacggtggcttacgcctctaatcccagcgctttgggaggccgaggccggtggatcacctgaggtcaggagttcgagagcagcctggcctacacagtgagaccctgtctctaccaaaaatacaaaaatcagctgggtgtggtggcacatgcctgtaatcccagctactaggaggctgaggcaggagaatctgttgaacctgggaggtggaggttgctgtgagctgagatcatgccactgcatgccagactgggcgaaagagcaagactgtcttgaaaaaaaaaaagaatattcatatccttcacacattttttgatggggttgtttttttctggtaaatttgtttaagttctttgtagattctagatattagccctttgtcagacgaatagattgcaaaaattttctcccattttttaggttgtctgttcactctgatgatggtttcttttgctatgcagaagctcttaactttaatttgtcagttttggcttttgttgccattgcttttggtgttttagtcatgaagtctttgcccatgcctatgtcctgaatggtattgcctaggttttcttctagggttttcatggtttgggtcttacatttaagtctttaatccatcttgagttaatttttgtatatggtgtaaggaagggatccaaaaccacgatgagataccatctcacgccagttagaatggtgatcatcaaaaagtcaggaaacaacagatgctggagaggatgtggagaaataggaatgcttttacactgttggtgggagtgtaaattagttcaaccattgtggaagacagtgtggcaattcctcaaggatttagaaccagaaataccatttgacccagcaatcccattactgggtatatacccaaaggattataaatcattctactatgaagacacatgcacatgtatgtttattgcagcactgttcacaataacaaagacttggaaccaatccaaatgcccatcagtgatagactgaataaagaaaatgtggcacatatacaccatggaattctatgcagccataaaaaagaatgagttcatgtcctttgcagggatatggatgaaactggaaaccatcattctcagcaaactaacacaggaacagaaaaccaaatatcacatgttctcactcataagtgggtgtcgaacaatgagaacacatggacacagggaggggacatcatacaccggggcttgttgtggggtggggggctaggggagagatagcattaggagaaatacctaacgtagatgaggagtcgatgggtgcagcaaaccatcatggcatgtgtatacctttgtaacaaactgtacattctgcacaagtatcccagaacttaaagtatatatataaaaaagaataactagagttttgttcatcttttcataataaacgtgctgatagttccaaagagaagagcctgcaaaaaagatcatggatgcaaatgtggatcaaatacacacacacacacttgggagagatagagagacagagagagagaacgaccaagtacgatgacaagataaaaaggctgattgctgacagaaaataatcaaatcgttctccaattttttgcaaaagagtaattctgacacatttaaaccacagactagcaggaaagagttttcatgatttctgcctctcagaggtctctcaaacagcttttctgatatactgtttttatataaattctgcagtgacttttccctggtgttattagttgtttgggtttttctctgcctaccacccgcttatttatgttaatctgatttagatcttttcttttcccctttctttctttgctgaggctagatttcacagggcaatctgctgagtgacacaacgacaagatgcacatctgtcagaggtgtgagcctgtgtgtgtgtgcacaggggtgtgtgtgcacatgcgtgtgcatgtgtacatgcggggtctaattctccccagggtcggtctgtgagcgcctctaataccctatgtggtttcttgagatttccaaatgagtgaggtggggggtggtattgaggtattgaggtcatcacttataggtaagtactggaggatgtagcgttagctgctgcctggactcaaggattatagaggaattctgggaagctttcatcaggcctcttaaaaaaaaaaaagccctgcctcacagttgacattttattttatagtcacgttagagttgagttcagacttattttgtgctattatagccgattgattatttatcacttcaatgaagaatttattgatttacttaatattcattgctgataacatgaaggatctgtaaattacaaatcatctgggccctcagaaatgcttaattatgccctgcctttcttgttcctcctgtctatctccctcctccccatcccctcgtcctcctctaggcctttatccaagctgggtagaacagatggcccagaaagcgcaaacccaccttgtctgtgatgaaggtgagagcatcttcccaaaccctacaagatggcttgattcacaacactatatttcaacctaggaagcacccttagaggtcatctagtagaatatcacaggcagttcattttaacagtagtcatatattgagttcctaccgtggtaggcttcatccctgtagatggcctggcttacccttgaacaactttatcagaaagttttttctcatagaaggcagaaatttatctcctggagtgttcacctatcatcatacggcaagcagcagctcttaggtaatgaaagcagaaagaagacgcacctcaaacatactgtgtgggcaacaactctgtctcttgcattccctctccttgtcacatctgaccagtggttcatacagatgtgttacacgtgccctagctcagctgaggctgagaggctggctgaagcaggaagaactgaccctctctctacactggccttgctctgatgatgtttgtgccctgaaggccacatctgcctgagggggtactgctgcaggcgtgtggcttttcactgtgggcttcctaatgcagtaggtttcaagcatgaattaggggaaggggccaacagggtaacgtggtaatgaaggagatggcaaagtgaaaagcaagttgctttaaccctgaaagaaagtatttctctagcaaacagcaatgctttgaaagcaattgacagaaagctggcttaatccttgttctggagatacttacagctgcccgtggtttttaattaatacactgggctccctaacaaaggggaggaggttggagagcattaacagatttactcacccaagccaaggaaagtgctttggaagaaatgccctggccgcccatgggccgggatcttcctagccctcccttccctgcatggcaaggcacgaaggtggtctgatgtggattccagggtgaaggtggtttgtcctccagtgtgtgttggccagggagacttccttgctgcattctatctcactccaccccaatccattctttccttccatcatttgctccctcaaccacacatatttattaagtagctactatacacagaccaggcacagtgtgtgaactgaagaactacatttataccaaaggcttgagctaggtgttttaatgggatctaaaaacgaacatgatgctcgtcctcagaaagcttagctctagtgagagagaagcattcagggctgatgttctgaatggcagtgctgggttcttactgcccgtttccattctgattgtatctgttttgattggtcagcaccactgatgccccagttcttaagtatttttaatattaccctggaaacatgaattgaattacacaacaaaatgcaaaatgttaaacgttctatgaaaaaagggacagggaacaatggggccatgttgccttcagggacccattgctgggctctcagggttgttttctgtcattgagtgacacatatgcccacctgcttgcaagtcctgcatcccattcctaccagcttcctagactctgccgcctctctacttcagtcactcatctctcttgttcattcattcattcattcgttcacttacttactcaaccaatgagcacttgctgaaggccaggcatcgagccgtgcatgggaacacgatgcttcctccccttcccaatgcctcctggacttttcctagagactccgctcagctctccttcttactccttcccatggagggatctttctcctttggttagcgaatctgatgtcagagtcattccatctgacaaagtctctcctcgtctgaaactccctgtctcctcatatcttcatcagtccatttccacatgtctagtcattttaatggcatatggttccagggggaaactccaaatgagggaaaattagcaactgtgcttactgggctaaagaaaatgactggagaggaagttttctttagaaatatccacaagaagcagcagcccaaggagacgtgactccagtaaaaatgatgatttttgttaggggtggtagtcggggtggattatcaatcgcattttctttcccctggaatgtgtcacagtcattaatttgtttaatttatttttgcctcttccctagtgaagcagcccaatccaccgtctgcctacccatcagaacaaattacactttggaaatatccgagtgcttcagttttccattaaatataataagaaaccacaatgcaccgttatggcctgctgactccttgccaaggatctacaagcactttttacaaccgctgccaggcaattctggttgtcacccttggtgacacagaggcgcgaaaacaggtccaggatcaccaggccctgttttaatttgcactcgtgtgcacgcctcttgggttgtgttcttaatctgcttcacatgcacgcgatctgattctgcagcacagttccaaagtcttcatacaggagacacatgtcctgcttctatggtgtctccccactgtgccagagccaatgactgctattgactgatgaattaacagagttcagccctgtgaggacacagctagctcgtggctcatgaaagctggccttccaacttccagcctcttctacacatcacaaggctcaaatgctcatctttcttcttcctctgactctctggctgctcccttataatcagccattgctcaggtcgtgaaaactgctcatgactgcagttcagtctgtcctaaggaacattgctaattgatgattacatttcattttcaggatgttatcttacttgggcaggttggaaattgaaatgtccaggggttacacatatggtatatatggctctttcaagtcagagattaattgttgagtattaatatttaattttttattgcaaaaggcttgtcaaaggctgccacgggaaggtgagagctcagatccatcctacctgatattcagcgtcctcaagaatagagcctctagcactgccagctctgcaatttctaagtcaaagaaggagcagtctagtgagttggactatggcagtctagtgagttcttggatgggagaagtttctaagatgaaggaggcagggttggacgtgttgtagggagtaggtgacctgttgagtcagtgctgacctctgcctggacaggagagagctctaaggtcaggtcaccttaacatctgtgtacacagacagttaggcataggcggagaaccagatgtctggtgtcaacagaactagatgtctgaagacctgggtttggtgccaactttaccattcaccaacaaatcatctcaaggaacttctgttttctcttctgtaaaatggtcagggtgccatctatctcaagggctgctgtgccattcagtcataatactgttcaattgtgtgttactttgcagttttcaaggcacaatgaaaaatggggatcctctatcatcttgaaagccttacagattctgatgaggtcaggtggatcgaaattgtagctttgttgcactataacaaagggttactaaaagagttaaaggagataatgtatgtacaacacagtgcctgacactcaacaaatgttaactgatttcttctagtagttgcagtttaaaaaataataataaaaggatgtctgggagtgtgactatgaaagaataattgtgtaattgtgaccattagttaggcacaaagacaggacattggaaacatggagatgtccccagaggagcccagatcctaagtgagttacatagaattaccctctttctgacattggccaagtgtctataagaggctcctccatttgagcccaactcccatcctctggcccaggggggccctttctcatcagccacattgtgtgatgaggtctaacagagacccacattcaagatcctgagactggccagcctgacattcagccacactcagcacttgggtcagccccatccctacctgggtgtgttcactcactctttcattctatccagggatatgcctgcctctttcactaaatttgatggtatgaagtggtcttcatttgtgaattcatctacagtgcctagtgcagtgtctttcacacatagtttttctgcttaatcatgataacctgtgcacataaaggcactcaaacactcatgcaaagcatccctagcaaagggtggttagtgtggttttggggatatttcctataaattagagcatttctcctactttttaatactttcttagtcttctttgtcccttcttcctcctctaagtgccccttgtgatggttaattttatgtgtcaactcgactgggttataaaattcccagatatttggtcacacattattctgggtgtgtctgtgaggatgtttttggattagattagcattttaattagtagactaagtgaagaagactgctttcctcaatgtggatgggccccattcaatcagttgaaggcttgaataaaaaaaagactgacttctctctctctctctctcccctgaataagagggtactcttcctatctgatagccttgagctgggacaccagtgtttccctgcctacagactctggctagaacattggctgttgtgccagcttgtggactagaacagctcttctgggtctctagctttccaactgcagatctggatatttctcagcctccatacttacacagaccaatttttaaacagtaattctctttctcatctatctgtgtatctatctatctatctagtctatctctgtattatctatctgggataaagacacacatgtgcacgtgcatgcgagtgtgcacacacacatacacacacacacaattggttctatttttttctggaaacccctgactcttatacccctaaatgttgttgttgttgttgttgttttagccagggttctgtcttagcattttcccctcactctgcatgctatacttgaataatcccactttcttcaatggctcccaagaccacacttatgttggaaaattccaaatgtttctcatcactccagatccctcctgaactccaagatacaacctcatatattcagccatcatctcggtattcctccttagatatctcaatgttctcccgaatcagcctgtccaaaggagatggcagcactctctacacaagcctgccttttcctcccctgctcctgatttcacaccttgccctacctttcactcattacccaacctgggggccacctcttctacactctctgaatcccattagtcctccaggatgtggactgtgcctccaggacccctctcacagctaaccccttcccttaacggccattagcactgctatagaccacgtgtcaccattgctcgtactcactgcacatgtttgtataagcctttctacgctggattctgtactccttctgggtaggaatcctcactgatccactgtttattgtttttttaatccctcagttctcagcaatgtacttagccaatattagatacttagcacatgactgacatctgaatgaatgattgaatgaatgaatgacttcccttggaagtccatggggtatagggaaggaggcagagcatatgataagaacttggcctgacgcaggagacaagaaacagaaatagaagtcaatttgtttgccataaataaataaaaggcaaattctccttgattaaatttgaaatgaggaaaacagaaacaagcagttatcttaagagcagggtagtttaatatcctaactacctaccatgggataggacaaactctgctatagaaggtttttgttttggggtttgtcattttcagatatccagccgaggacactgaaccaaacgtagtttttctaaagaggccctaggttatatttaaagttctcccagtgctcactccctgggatcttaagactttgatttaaaagacaagcacagagcaaaactcctgaagatcaattaatctaactcatcaagacggatctgatttgaattgcggttccaggcagcaactagtagtccagagacaagactgctgagttggctgatgggtagagagagcacagcctcaaataccctgcaaaatgccagacagaaggctgacaactaagcaaaaaattcagattttgtagatcttacttttgaagaactccacccctctcttttctttcaactatttatcaatgtatttttttttcacttacatgcacaccttgttttattgtgctttgctttattgttcttcgcagacattgcattttttacagcttgaaggtttgtggcaaccctctgtccagcaaatctattggaaccatttttccaacagcatgtgctcactttgtgtctcacattatggttattatcccaatatttcaaatactttcattattattagggctattatggtgatctgtgatcagtgatctttgatgttaatattgtaattgttttggggtgccacaaacacaccatatgagatggtgagcttaatcaatgagtgtggtgtgtgttctgactgctccctcaaccagccatttctcatctttctccctttcctcaagcctccctattccatgagacacaactatattgaaattaggccaattagcaaccccacaaaggcttctaagtgttcaagtgaaagagtcgcatgtctgtccctttaaatcaaaagctagaaatgactgagcttagtgaggaaatcttgttaaaagctgagataggcctaaagctagacctcttgtgccgaatagtcagccaagttgtgaatgcaatggaaaagctcttgaagtaaattaaaagtgctactccagtgaatacataaatgacaagaaagcaaaacagccttattgctgctatagagaaacttctggtggtctgtatagaagatgaaatcaaccacaacattcttttaagccaacacctaatacagagcaaggccctaactgtcttaaattatatgaaggctgacagagatgaggaagttgcagaagaaatgttggaagctagcacaggttggctcatgaggtttaaggaaagaaaccatctccataacataaaagtttaaggtgaagcagtaagtgctgatgtagaagctgtagcaagatatgcagaagatctagctaagatgcttgataaatgtggctacactcaacaacagactttcactgtagatgaaacaactttttattggaagaaggcaccatctaggtctctcatagctagagaatagaagtcaaggcctggcttcaaagtttcaaaggacaggctgtccctctcattatggactaacataactggtgactttaagttaaagccaatgctcatttatcattttaaaaatcctattgcctgtgcagagtagattggaacaatgaaggctgaaggacagcacatctgcttacaggttagtttactgaatattttaagcccactgttgagaactactgctcagaaaagaagattcctttcaaaatattactgctcattgacacttaacctcgtcacccaagggctgtgatggagatatgcaagattaatgttgttttcttgcctgctaacacaacacccattctgatttctatttcaaatcaaaaagtaattttggctttcaagtctcattatttaaaaatacattttgttgaggctctagctgcctcagatggtgattcctctgatggatatgggcaaagtaaattgaaaacctattggaaaggattcatcattctagatgccattaagaacatgcatgattcatgggaggaggtcaagatagcaatattaataggagtttggaagaagttgattccaatcctcacggatgactttgaggggttcaagatttcagtggaggaagtaactgcagatgtggtggaagcagcaagagaagtagaatttgaagtgaagcctgaagatatgaccgaattgctgcaatcttgtaagattttagtggatgaggagttgcttctcatggatgagcgaagaaagtggtttcttgaggtgaaatgtactctcagtgcagatgctataaacaaagttgaaacgacaacaaaagatttagaatatccaataagcttaggtgataaagcagcagcaggatttgagaggatggacctaaattttaaaagaagttctattgtgggtaaaatgctgtcaaacagcatcacatgatatagagaaatctttcatgaaaggaacattcaaattgatatggccaacttcactgtggtcttattttaagaaattgccacagccactccaactttcagcaaccaccaccctgatcagtcagcagtcgtcaacactaaggcaagaccctccaccagcaaagagattataactcgttaaaggctcagatgattgttagcactttttagcaataaagattttgtaaattaaggtccataaattgctttttagacataatactattaaacacttaatagactatggtatagtgtaaacataacttttatacgcactgggaaacaaaaaaaattgtgcgatttcctttattgcaatgctcacttccttgcagtaatctggaaccaaccttgcaatatatctgaggtattcctgtgtttggaaagatctagccaaataaaaaataaccttttatagcctaaatggctgagagcactgataaaataatggagaagacaggaacagttgtggaagagatctagccttctaacacttagtttcctgaaataaaggaagtgttagccttctcccttgccatccttcaccaaacagaacacacatacacacacacacacacacacacacagacacacacacagacacacacacagattcttgaaagtttggaagcactgatgcttgcaaataggcccattaaaagaagataaatcaactggaaatgcataaaaagtctcatttatcataagacgtgttggacagggttttgagttttacatacatttattctagaaatctgtttatctgtgcaacgtttctgaacaaaatgctttgtgacgaaccatcctctccacttgaatctatatggaaagcaattaagttcaaaccccgaagacaaaacatgataaacacagcaggcatgctattgatttggaatttcacaactgcccttcttccttttggatatcatctccttataccccaaaaggcctcctatacctcctacacttatgaaatgtgtttcttacgtcttcagccaaggcaacttccctgactactccctgaggactacaaacaatgagttacttcaacatgtctggagatgattaacctgaaagtggttaaaagtgccacccctggagtgaatgactttcctcagcccagccaggatatgactccaatgccaaaaatttgcacatgtcccatttccccacctgcacttgtccataacggaagagggatgtgtatttgagcgaggggaggtacagaaaaaattagaaagccactcaacttatccatattacactttcaaatcccttcagtgcaagggacctatctcatgaattttttcattttccatctctagcaattagtgggcaactacaaggtttgagaaagagaaaaacttcatctgtgcacagggcctggctcagtagtttcttaataaatattcaatgaacagctattgaatgactaaatctgtacatacaaagcagaggattccagcccagctgatagactattccagccatattcataatctggggtgaaagcaacacatctgttccatcatgaagagtgttattgattagcatggtcagattggtgtccactgtctgacatctgcagacacaggctgggtggcatgtgggcaacacccccttctcccccatagatagatagttttagctcttcagtgaatataattgtcagtgtgacagactctagtaggagtttgcctagtctgcactttattccatgttgggtaggtcctcctagaacccctcctccaaagaagagaaataagaatctaagatcaggaattctcttagaaacactacaataatctctcctcagcatttctgcacaaatgcccaggggtacacccagcaacctcaccccctgagggcctgccaacagcttgtgctacaaactcctgcaaataggatttattagaacagaatcaagtgacagactcagaacgaaggcagcacagatgaagaagaccctgaggttctatgcagatgttgacttttatcaaggtcaacactgagatttattgacccaagaggtaaatattgatggaggctcaggaggtcaatatttgccccaaggtgaataaatcttcccaatgaccctcaaacagaagtctgtatagagtagactcagttcgaaaatgaattagctgtgacatagattaagatactatttcattagattgtctagggcattggaaagcaatattaatactaagcacttcatgttcaaagtactttccaaacattcattaaagtgcacctccctctagcagatgcataaaagtgttgtactcccaactcaacagatgggatattagagccaagaaaaagttaagtaattttacctaggccacagaaaaagcggctcaagaacagagagataaaatggagataagtgtgagttaggagctctggggatgagcaaaggtctacagaacagtgtcttaattaacattcctggtcaaattaataagtccacttggtttgattactttcatttagttaatttatatcccattgttcacaaatctacttaggctgttcaattgtattgcttatttacagagatgcttttcggcatttacccatgataaactctacctttggacatcggtactcaactcttaagaagtgaagagtgtgttagtggtcactgggaaggaacagattggtttatccatgtatttgcataatcattatcatcacattctaattctcatacaatacctcttctcagtaacaagatgctggtactgagaaaccagtatcctggaaccctattgtgaaagactaacacgtgcgtcattgccatttgaattcacggatccagtgatccctgcttttgcattgtctcaaaactgagctttaaatattataaaattttggttctttgctgatggagaggtcagagccatggataatcgaaacctcagccaaaagaagatcaataaatattatttccttctgactttggagtgcgttattttcccgtgttttacgttggccttgttgtttttctctggagagttaacatcagaaaagagtgagtgcttccagagtgccagcgatgatagccagacaggtgacagaactcgatgtgtgtgggtatcaggtcagcagctttgaggttgtgccatgtaatccacaggtaggtacttgagtggactggcctcaacttgtagaatttagagttttcaaagttacttcaatctactttaaatctttggaaggaacaaatggggtcttgagagtgtgaccatttggttcacttgaaaaggaaacaatttgacttgaagagatgtaaatggttagctgatgccagggtctgaggaaagaatttaggaattttgaccccaagctgcttagatacctcattattttatcctgcaataggattttggaattgtagctgttacccagataagtaagtgataccaatatgatctgatactgttacaaacggtaatttgactgacaataaggtacagacaaatgaaagtgtttacagggtttaatatttaataatgtaaaaggaaaaagtcggcaaaagcaggctggagatgaaaagatctgtatcgagtcagaatttttgccgattgtcagagcagcatgcgtctcctggggacctgaataagcaagctgctgttctgcagaaattgttatcttgggcgtattgattgagtgtgcaccactcaagctgtcagtttctccctcctatccttgctttatattttacatcatggtatcctcctaaactctcacatactgcctggccttcacactttaggccgcagaaccgtggtgtactctcgaaggagacctaggtggtgtgcctgacgtgttagttctgtctgtgaggagcatctcagtgactcttctctagggcatactaatgggctcattctggaggtggctgggtgctttgagtctagagacatgccactggcccttctcttaactagcatggccaagataccaacagacttgctccgtggacagttacttaacctgtatatgcctcggttttctcatctgtaaaatgggaataatgcttaccttacagaactctcaggaagataataaacctaaaacaatcagcacactttctgacacagagctgtcctcagtaaacaagaatgactgttatttattaatgcagtccacagaaatctgtaaattaaataagaaactgtttagattgcagaagacctagccctaaacccagaatcccagaattcttgagcgagaagggcatttgagaggtgatcttatccatctacctgccttctctgtaagcccagagagctgacaatctctttactttcaaaagccattagaaatgactctgaaactttctctgacccggagctcaatgtttgtacaacctgacaatagcttgagtagctcaaacacctctgacacctggagcagagactggaaccctttgtccagctcttcctctttgtgcgtaacactgttctatttctattagcttttcttcagcaattttactttcctcggtgctccttcaccatgcccgcacatccctccaaagagcactgcaagttctaacagcccctggaaccttagagaacaggagagcaccgtgctaatgagaccaaagtcaacaggttgcttcctaccagggaataacttcccacagggaagatctgccttctggcctccaaactgcagcctttcacttcaggagctgccttgcaataataataatgatcacatctaaccttcaggtgcccttttctatatttgaaaaatctccacatctcagctgatcttcacagtaaccccgagaaatgccaccactggacttgttacatccatctcagagacaaagaagcaaccgcagagaaatggccaggatcgtgtcctcagaatgaggcaatgttcactcaagcccaagccttctgaaagtgagccctgggctctttttcttcacattacacagcaaatgaaaatggtagtggttctcaggtgggggcgattttctcccactccctccctgggtacacttggtgatgtctggagatatttttgcttgtcgcagctggggagggggcttgctacaggcacatactgggtagctaaacctcttacaatgcacaagacaacccctcacaacaaagaattaccctgcccaaaatatcaataatgccaaggttgagaaatcttgtcagatttatagtaagaggacaaacaacagaatccagccacctgactaccagccaagccctattttcctgcctatcttactaggccaacttgcttcccccaaagaaacttcatagacatttgcaaaggactttgggatactcagaaaaaagttaatagctaaatgtagagttgttggattttgtaaagctgttggtaaagttattttcattttgcttttcaaattagtttgggagttggtgttcttctttacataattacaagctgacaaacatgcttctgtattttttttaattaacagatatatgtattcaagttctccaaattacatgccacagcttgcatattacaggacagctgccatgctccagatgtaggcaataaccagaacatggtaatggcaaaatgcaaaagaaagaaagggggaagaaaagaagaaaagaaggaaaggctaatgtatcaggacggagaagagcaatttcaatcaatgggtttggattttttacagagatgaataccttagattctcccaaattttcagctcagtttgaacatttgggatgaagctgtctgggtcattcattgctgccatcaaaggctcaccagcgccttgtaaaagcagattacagatgaaatggggcacatataaatgctaacagcgtgctggagaaactattcaaattgctcctgtttacaagtgccctattaaatgtgctcagctcctcctgaagaaagctgctctaagctgggtaaactgctatatttattttgcccatttataacacggcagccccttttggtcactcaatcccaggtgcaggctctgtctggtatccacaaatcaggaactctacaggatggggctctgcagtgagaaaggggcaggggcagtagatgaaagtcccagtcccacacctaccaactagcttactgtgtgactctaggaaaaggactgtacctctctgagactcagttccctcatctgtaaaaaacggggcatgactggacaacctctgaggtcccttcgactctccaggttaggagtggttacatttttgagtatctctgcagatacgggaaaaccctgcctctccttgcatagatgtcagaagtaacacttcaggcgggggcgtctgaggttcgcgtgtgagggaatcaggtgcattgcacagtcatctcctgctcaagacagaggagggcgctcaggggccaatcaaacgacttctaaaccgcgaaaacaggcctggggcaaaagagtccgtagataccgcagtcaaggggcgattcactccatttactgacacaatagacatggagtgcctcccatggacacagggaatgaagggatagacagatgtcctatctttgggaatgctggccttccaaggagagagttgtccactggggaaaacgcctgggcaattccctgcagtgtggcaggtgtgaaggtggaggtaagtttggggtgctatgggaactcagaggagggaaaaaagccactgaggaggtgacacccagcggtatctggaagaatgaacaggtgtgaaccaggggaagagggagtaagaacgtctcctgagggcggaggctgtgggtagcaatggagcatggtgtgttcagagccagccaagcaatcccacaggagaacacaagaaatatccccacggcacagcctacccaagtgaataaggcaggaaagacctgtgagaagtgaaaaggctcgggtgaactgtgatggtagccatgatgcttttccacgcccttgatgacacaggcttatttgaataattttgcagtgggacctggctcacttttgtagatcccttcaaagctggagattggtgccttccgggattctgccattgaaggaaggaaaaaggtagcagacagcctttcccttctcttctcctttctctctactctgcatggaaatgcaaaatgctggagtccaaacacattcataaaataattttgtagggctggtagttagttccagcaaaaccattgaggggaaacaaaggaagttttgtgttaatgtgactagtgtatgactctatctgagttaagacaacgcaatacgaaagaaaatctggctaaaattagccttcttctaccagtcacagccaagctgccctaggttgtcacctagggacggaacaggaaaatgcagcctctctaccactgcccctgccccctcagggatatatcatgcatttgaaaaattctttcttctttcagtttttcgctcttcacagctcagttaattccacttaagacactcttgtttccccgtatttttactcatttcctttggtttcctttttgtttttcttaatttgagctttctcaggaagttctcttcttttccttcttttcttccctttcttttctctctcacattatcttgtttatgaaacactgctctttattaaacactacattaaacacaaataggtaggcataaggttaagtgatagttgtgccaataaacagaagaccctaggtgtgtagcgacattagacaaaaagtaaccagtaccatcaatctttaaaacccctacagtgccctgtcaaccccacagagggtccagaaaaaagtcatgaattgtaccagtatattgtcatctaaggaaatctgatttttattaagtatcaaatcacagaacacgtttgcttttacttttgtgtactcagttaccgaattgctaatgaatttactaatgttgtgatgggattttttctattatatgtaaaatgataaacatacagcatttcaaccacatccctagttaagtaaaattttgtgaattagtgaaggaactccatttaatttagaacattgcttccatgagaacaaggttttcctagtttcaaataagtgatatctaaggacccatagaaacacttgcaaattaggatccaatgaggctcacctgctgccaggtatctacgcagcaggagaaccacaaacagaagcacatggcggtgctatggcttctcccccacccaccagtctcccttacagtagctgcgaggtgcacaggtagttttaggatttaacatgtttagtaaacattgcttttccattttccttttatttattgttccccactctcaacagtgtttgccttccttcccatctcttgtcatttccctcaaagaagcagattcttatttaggtggtttttgactatttacgagtacaaagtattatctacatttctgatgacatgaattccagaaacaaaactgaataaacattatgaaaagggtaatgtttgggaggttaaaccattagtgaaaaatcatcaaggtatgcttctgattcttgaatgaatagaggtgacagaggcaactcattcagtgccccagttttcccagctataacctgagaataatgatctttatctaaaagattgtaatcattacaaattgcttggaaattctgaagagataacagctaggtgtgaaaatgagagttgtagaaaccactgggagctggacagggtttttatgttctgttcggggtgttgtcttcccaggctgtcatttgacctttggcatcattgagtctctctcttactgagttcggcacccataaaaatatgatcacattacattaactcagcagtcctataggagagtgagttcctgtcgtgagagcactgaaaggaaccacagaaatgaaaatatcatcagtccgattcttcactttgggccctatgtaagatattattagggaaggaacttgtcataaatcgtctgtaacccaaattagcaaagggcatcgaagacggtcctctgaatctttcctatagtccattcaaaaagcttgcagggaagaggcaggaaaatcttgcttattttgattcacttgcattgattttccaaataagcctgttctgggtgacttgggctgagtgcttggtacagaaaagatgacaagcaactgaactcaaggaggtaagagcaatgtcagaaaaatccattcagtccaggatagacagattagtgtttgtgaatttacatggccctttatccaattcataactataaacccactgctgcagaagtgacacacaagctcatctgatttctcttgtttggaaagttgaaatctccggatgagttagagggcatgatgcttcagtgcctttttcactggaaaatatcacagggtaaaatgaatttgtacattttccctagacctggtgcctatgcaagagggtctggtagagagagagagagagagagagagagagagagagaggactgtgcatacacatttccacacacactgatctcccccaggaatcagggtaaaagtctccagatgtgtcagggtggatatttgctataccttttggcttcctagattgggggtaaattattccctctatgagtctttgtggaaacaaggactccttcccactctatgcaaaagctgacaaattccaatcttagcttttccagcctcccttgcagctagagtgcaagccaccatgattccgtcactgctaatctgacccactttccaggcccagccacaggacttagtgatgctgagaaaagggtaggccaatattccttccagcagagctggctgctgtggaaagatcaacacagtcacgttactgaaggagcaggcattctgaccacggtctgggatattatttaggccaccacagagcctggctcctcagctcttctgacatgcccaatgttgttttccatttaaatcagccagttggcttctgttgcttgccattaaagaccctgcctgacaccgtgtccgtatttgattgcgtgtatgccacatgtatgtacacacaccttctcttccttccctacatattcttctttccttaccttgatcaatgttatggtgcacctagctaaaaacaactgcagaggaataaaaaggaaaaaaagtcattttttcattttccgccatcgtgcacataaaaagggacagaaaagaacgaacaatgtgctgctctggttgagttgatagccttaaattctactcaccctttcactcaaggaggacgccagccaaagtcaatgggaattatatttgtataactaagggcattgctgaacccagagagactggagaacaatttagcagacaacttattccactgccaactctaagttttgaggaaaaaaaaaaaaaaaaaaaagacagaaattgagtcccgaggccaatctgcatgagcatgttagtcacgggtttctgaataacaggctgaatggccctggcatacaattccactcatttttatgctgagggagtcttcttagggcttctatatcaccaagattacagtcccatattgccaagttcaagctgacccaaccaatgtagacttagcctcaggggccaccattcagttgcatagagagctgcctaaggcatgcattccttctctgtgtgaaggccaagggactgcaggggtcaggggaatcaagtcatgaggggataaggtcaactacttggaagtgatgaagagttctggctgctgctgaaatcattgttcagagcttaggtctagatccatttctgttacagactatcatggtgaccctaagaaagtcacttcacctctctgaatctcaagtcacttgtctgtaaacagaactagcagaaatggcgtgaatttaggagacagaaaactcaacttcagaacttcagttttgttatttacaagtttgtgatcttgggcaagcaactcaatagcatttttatttcagcatctgtaaaacaagaataataatactttttacagagtttggaagaattaagagtaatgatatacacaaagtatgcactacactgcttggcaaggagggactcaataaatgttagttgcattcattcatccattcatcaaatatttattgttgctcccactgtgccaggtactattgaaatcctgggaatatagcaatttatgtgacagataatgtcctttccttcccttgtggtacttgcattttctctccctaccagaagagtgagattcatgttccaagggcaagactagggctcatgttttctttagttgtcctgtgtgctccctgagggcaggtgccacatctagctctgctttctgtgcataggaggtactcattgcacgttaggggttgaattcagttacataagatgcaaaatattgcaaatgccatctccacaagtaaaacatttaaagcactttatgcaacatgcttccacagacttgtccatctctttgtttcaaatgtttactcctcttttctatagagctcatcaccatctttcctttcctatctagacctctctgacttcattatttctgtgctgtagtcaaataatgttttcaataacagtcatgcatcacttaacggagatacgttctgagaaatgcattgttaggggactttgtctttgtgtaagcatcatagagtacacttacaccaacttagatggtgtagcctattacacacctaggctacatggtatagcccgttacacacctaggctacatggtatagcccgttacacacctaggctacatgatatagcccgttacacacctaggctacatggtatagcccattacacacctaggctacatggtatagcccgttacacacctaggctacatggtatagcccgttacacacctaggctacatggtatagcccgttacacacctaggctacatggtatagcctgttacacacctaggctacatggtatagcctgttacacacctaggttacatgtatagcctgttgctccagtctacaaggtttggctctatcacccaagctggagtgcagtggcacgttctcagttcaccacaacttctgcttcccgggctcaagtcttcctcccacctcagcctcctgagtagctgggactacaggtgtgcaccaccatgcctggctaatttttgtatatatttttaaaggcttaatgtgacttatttatttatgtatgtatttatttatgatggagtcttgctctgtcacccaggctggagtgcagtggctaatttttgtattttttgtagaggtggggtttcaccatgttgcctaggctggtctcgaactctggagctcaagcaatctgcctgcctctgtctccgaagtgctgggattacaggtgtgagccactgcgcctggcctcaaaacactattattatcttataagaccaccgtcatatatgcagtcggtccttgaccaacagctatgtggcacctaactgtattgtacttcttcaactgagtggtaagaatgtgaaaatcctggaggtcaccttagttgaggctttcttccaattcagcaaacccctttatgtcatctctgatgcactattatccatcctccatgtcaagacagctgtgaatagagggttgactgcccacaaggcccacttacttcatgttcacaaagctttcattcttgcaaggttctttctcctacccccctgaaatttccttaaataagtatttgctgaccacctactgtgtgccagaaccatattcacaaccaggggtacagaagtgggactaccagtattcctaccctccagtagctgctagtccagtggaagatttgttgattagaattctgctctctccacataaaagaggcttgttatataactgaggacagttatagtgttctcttctaagccagttttctttaagaatgacagtcacctgggatggtagttcaattgcaattttctgggccctcctggaactaattaatcagactctctacaaatctagggactggagcagctagaatcttcaagtttaaaaaagcaccccagttgattctcatgcacaataagcctgaagaactcctaagtcttgcttttctgccttaataatgctaagttcgctaagttcctcccaccttcctcatattacataattcccaggtttttcttttccctccctccctccctcccttcctccctcccttcctccctccctccctccctcccttccttccttccctccgtccccatatccaagctttcagtatatgccccagtttgtaaatggctaaggtgtggctctcaggacagagcatacccattccagatgtgggtcacatcagcagagggtgccatgggggtgttagcatcttccagatgaacacatcgctttctacagaggatgctgagaagcacattatttgtcaccatgccacattgttagctcatattgagatttcaataagataacactcctccaattaagaccctgcaatatacctgacagaggaaaatttgtttatcaaatttgtgaataacacaacatcacaaaggagagacagattatgaaattataatgacatattatttttcttaaatgagatgttagcatcacttgcttttagcaagccaaaggttgcttccagggaccacagattattttctgagtgtttatgaaccgttacattaatctcctgcagatttttttctggagatttatatgtttacctgtccactgtttctgaatctactgtcatctacaattttacttttttaaaaagtgtgacatttttccagactctcctattttgcagtatttcttgactattattcacccagaatggtaccaggatcatattttcaaacggtttcagtgttctgggaagttaattttgttgaatctagtaatcagatttgttttaaacataccataagcatcatcattattatagtgatagttaatatttattgaatttttctatgtgtcagataatatgctgtacttgcagcgtatcatttaatctacttaacaaatctatggcatacatactcttgatatgtctacatcatagaagggtaaaggagaggggaggttactactggcataaggttattacttcacggtggagctaggcacttaatccttgatctgggtgactctaaaccaccaacttgtatgatctcttcctgtcacatcccctatctcaagttttaattccttctcaattcagctgatcgtccctcaactatgaacagcacgataggaaagagagtaccaagagagttaagaagaagttctctgtaactgataaacatcatgctgcatttcccaaggaggactgccctttttattcttcttccttcttgaaacctaaaaaaatctctcttttccttttttctttttctgcaggcttcagctccttctgggtcttagtgtcacttggcacctttgttacaggctcctgcacctcttttgtcctcttcttctgccaggtgccccgcctgccatcttttgtacctttttttcaaaactgagctccttggagagtgtctgcgcagtcaggttggtttcttcggatgctgccgccctttccttcttcatcaggatcattcgtttggtgctgtcaaaacactgaagctgccatctttcttgagccacctttctttttcatcacccagcttttcatattgtttattttctactgcctctggcgatgctcctgatcctccaggatcagggtctggccatgcccagtgtcctgtttttattatgaattcctaagattagcatccactttctttcgagattcccattatattaattcaatcattcctgtattctttcaacaagcatttattgaatgcctactatgcacctgtctatttcatcaggtttataccttgttggcacaatgcctggcacatagtgggtgttcgataaatatttgttgaaaaagtgaaaatgagttagacttgagcccagagtgacagagtcccttattgatttttccccaaccttctgaatgatcaagctgcttgtaaggcaattaaaaagtatgtcaagaacactgtttcagcaggaccagccttccaaccagtgtctggagagctgaagttgtcaaccctggctggaactggctcctgtgcctgatgtatggttgatattttggatcaggaaagagcatcaatttcctgtgtaccacacagtcagaggcatccctgtctcctttttcttggtgtcctcactcagtttctgggcacgacatgtcccactctccattgagtggatttctgtagtacgactctgctgccagtctactgacagcctccttctccagcacggcagcccaccaaaagtgcctccttccaagcctgtggccacaagccccagggataatggtcagcacattgtggcgttggatttttctgctacttaaatttatgatgatgcagggcatgcaggtaatcaattatgcgattctttcagggttgcttctgcccttcctcttctccaacattttctttgaaaggtgaccctgctccacttcctctaccaacattcttcctgtgtcagatctgtcctcccctgtggtgggcgtgttcttcaccttcccttcaaactttagccaattaggtttcctccattcttatgtgtggaacctctggaatgaacctgcattcttttctttgttaacccaacccctggcagcaattatgtcctaaaggaaagtcccctggtaacctcaaacaggttgctccctctatcatccaatatattcttgtgtttacgtgccctggccagaaagctttttggcttccaggtctatgcccagtgcattcagccactgatgctccttggttctggccacgcccagctccgtgtgggtccctgagtggtctacgttctcccatgcttcccaggctttagcacctgctactccctcttctcctcatcccgctctctgcccattttcttagctaatgtccactctgccctggagctttgcttcatggtgggagtttctctgagctctgttcccccaaggtgggctaggcaaccctagtgtctgctcccacaggagctaccatatgtggatgtcccctgggtccctacctctctgcacccgggatgcttattctcttacctggcttccctgttatgccctgtgtccctgaatacattgaggtacacctgcctttctgaaagtttggcaggtttcccagtgtgtactgagaaaacaacaagggttgccagaaatgggaaacataatttcaagggggagaatggcaaatgtacaactctccaacaaaactgaactcccaaacacagtgaaaagcgcaaactctcagacaaacagctattaaggacatagagtccgaattcacccggaacaaaagacccgtctataaccattatttatcactcagcaaacactctctttttgttccattgtcaatgctccacagaccacatctgcctttgggcagaggggaaagagagaaagggagagagaaatgaatagaaatgagagtatgagtttcattttatttatttattttacatataaatcagctaatcggtttaacattcatattaaagttgtaatcacctttgcatacattaaaatacaaactagcacaagtaataggccttaagaacaacattacaatagctattaacatataacagctaccttatcaacttacaacatccctataaaataataactgcatccaggattgatttgcgggaaattcattctcccagagcactgaagcctgactcgaagtctggggaaggtgagagtctggttgttctttggctgacgcagagaggtggctcttggggagtgaaggacaccagaggcggagatagaggcttgagctttcgttttggctctattatccactagagagatgacctggggaaaatgtcttaacctcactaagactcagtttcctcgtcagcaaaatagaaataagggtgtttccttcatagtgtttctgtgaaaacttaaatgaaatcataggagaggacctggcctttgtagcagatgcttaagaaacgtcagcatcttttcaagaaaaccaggtgctcttagagggtgcaagggctggaccagaaggatgctacttagaacataatatggtatctttcccattcattcatttgctcactcattaaacatttgttgagcactgtcagagatgatatgaaaaattttaaaacattagagtttctctccttataggacttaccattgagttgggaaaatatcaagtcaagaacaagctggacagaactgaacacatgaaaggatagaatatacacattatgtcggcagagaagaaagggcagagtgactgtgagtgggaaacaggaaatcactacacagagaggtaacctttgagccaagccttgaaatatgaagcgtatttcagtaaatgatgaggaaaaggatattttaagctaagggaacagcataagcaaggatacaaaggcatggcatatccagggaaaatcaaatattctttttctggtggaagcttgaagagcaaggagggatggagaggaagatgctggaaagagagatggtgccagacagaatgaattgatagaacaaatgcaagtatctacagattgtaggggaccttcaaagctgggtaaggatggaggtgtcagataccaagtgaaggtattggggctttgttttacaggcaaagggtagccagtgggcttgctgagaaggggaggagtaaattgtgtaccctatgaagatacaagtggtaatgaatgacaatggtgaagggtgactgtgagaaaaaaaatcgaggaacttgatagggtgctataatagttttggagaacatgagtagggcaatggaaggaaaaatggaaaggcagtatagatccatgtgaaaggcaatagagattaaaacgtgtcatgacaagagaactaattggttatgggagatgagaaagaggctggtgacttggcatccacactaagtgctgggaatataggatgctctttacggagattaggaccccaattggggagaaaataatgagtttagtttttagaatgttgttttaaaagtgatactgggctacatgtgagagcatcaccgatcaggaaaatcaacaactcacaaatatattttcattgttactctcagaattagccaccagaatgggtgctaggagtgtgaacgtggaaagaaccaagattcagttaggacacaataaaataattttgagatcacttagaaattttcatcctcagtacttagcaatgagagatggtatacttagatctctgtaccgtggactatcattattcaatttaaattgctacaaagtactattcttacatgattggcctgaaagccttgatgctgagttctagatatttgaagcctaataccacaaacgtacctctctggacaaactgtcacctggatttttagacaaaagaaggaaagcatggcccgttggaccacagcaagaccttcttatttttgcaagctattctattttatttgttcttagtgttcagcctgggacctaggcaggctacagatgttactgctgatggctgcagtgaccagtatcaagtgatttcttatgagaccctgaagaaggaggctgatggccattgggcccactgacagcatattgcctaatcgccattattctggaggaaaatgctcaggaggtgttatatgtggtgtagcttaggattccaggcagaagacagtccagtaccttcctaagtcactaaggaagagctaaacacatggtccctgtttcactgaaatgagatctgcctctaccacccgactctatgaagcaaaggcaaggaggtatttcttaatctgagaagacatcttgccttttatggcactgttaaaaccacacatttgggtgtcggaggaggtctcagccacacatgctcagggggcttttatcaatgcacccccatccttggagtaggttcctgagcttggtgcctggggaactggggaaggcccccgtttctaccaaagagggcctctctccaaggtgcctcccagctctaggcctgaggtttctgttgacagtgcctggaggagccatctgagcttctgtagcacacactcccttgcttgggggctctgctgggatgacagcctttaaacacctcattaatattcaaatctattcaagtcatttcaatttgaattctatgcatattatcagatagaacaaatgcaaatatatacaaattcatccatatgaagaaataaataggggaagctctgcataatgggattataatcattctcaggcttgtctctttcttttaattccccagagcccagagatccagacccagcctcaatgctcccacctgcaactgtttaacagcaactaaacctttcctggacacaggttcctcaagggctgaacatttgagaaacctattatcattatcaacctattatcaacaaagatgttatcattgtctactggttgcttctctctctgggcttgttaaggtagagctgtcagagacttgtaaggtgggtgtgggcaaggggttggactcagagacccatctgtaggctcaggggctggccctagcctgggcacattggccttcaggcctaacagcctcaagtcttctatggagtcttgatgcatctggtgggaagacactggggaggggactaagttccctaatttcttaaatcttctcaaacctgagggagacttcataaagcctttaaagtacattaactgaacttcaacacctgggcaacaatgagtggcatctaatgttataatcgtatctctcctttgcagcaagacacctaagttgatcctggagctgccacttctcctttacttccacgtactgtttctacccattcccccagcccaacacctccaggcgtgactcttttctagccagatcctcagccaaatgctagaaacacaatgctgtaagcagacaaggagggaaaaatcaaagtgcaggcagtaagcctcctaccctgcagcaaatcatacatggacaaacgcagggtccattcatcctttctttcacactgttgttgttgctcatctctatttcatctcaactactccaaagacaggaggaggccaaggtctatagtattttaaaggagagttctcatactctagactaataaagccaaagtaaattgctgttaagaatcatttagtgaggtttaactacagcatctaatagatgtgcctgctaatctctcccccatgggacccaatgatagttgcatctagtagtaactccattgattatgtaagcgtaatttgtgccaagtcatagtatgatattataataaccattttgtactaagcacctattatttgataatccccatagatatacatggggaaggtcattttttctaacttataagtagtgaggctacttgtaggtacaatattataataaccattttgtactaagcacctattatttgataatcccaatagatacacacgggggaaggtcattttctctaacttacaagtagtgaggctgaggcacagatttcttacacagagaggtaggataggaaagcctatattttcttctgaaagggagggctcatctaacgtctgcctttggttcttgcggtagacagaataatggccgccaaagatgcccatgtcctaatccctttacaggacaaaagggattttgcagatgtaattaagttaaggtcttgagagagagagattttcctaaattaccctctgtggtctgatataatcacttggttccttatgagaaagaagcaggtggatcagagtcagtagtaggtgaggtgaagatggaagcaagaggttggagtgaagggaggaaggggccacgagccaaggagtgtaggcactctgcctctagaagccagaaaaggccaagaaattgattttccctatagcctccagaaagaaacagccctgcagcacctggatgccagcccgtgagatccattctagacctctgacctccagaagctaagatagtacatttgtgttgttttaagccactacgtctgtggtaacatgttaacagcagcactgggaaacaaatacactccatacatagcctttctcaactgagattcctcctctgaaccagagaaccccgagaataatatgattaactatttttacttctcccaaaagtagtacatatctagtatcattttagatgcataggaaataatttaattcattgcatgtaatggatgccttttatggtattagaggttaattctccccatgagccccactgagaaaacttgcacgcccagaaagccacatggcaccttgtcttgaaaagagactgaggatgctaaccagatctattctgaccttgggcagcagctcagcacatctggagacactgacccagaggaaggcaagtacctcacctctgaatagtgcccttcatagagtttcaaagccctcacaaaaaggtattctctctggagattcacaacaacttcatgagtcaaggaggagaaaaaggctccttccctcttccataccaaggccatgcaccaggcaagtgacagagcctgtagcctgtctagcctctgctctagggcttgtgtcacatgcttggaggatgaggagttgtgatgagtgctctatgccttcaagcaggtcttccttgattgacaggggggcagacggacacttcatggcagatgcagtgcaggggggtcacagcctatggacccagtaaaaggttgccctgggaaaagcttccaggccattctcactggctgctgccaggtgctaagtccttactataatggagttattatgttctctttgttatgcctcatttacaagagagggcctcagtcaagagcagttttcccctagcctctgcacagagacccttgtgccatagttggaatcaaccaccactttttaccaggaactttgtccaagctccccgcacaaattgctctcctgcctctcaatgaagtattcactccaccaagctccatgtgagcccgcaggaagtgcccccaggagcttcctctgccaagaaccctctaagcacatactcttcgggggcaggaacccagggaggagacctggaggagggaaatggaagaaccctgggcttggatttgaactcctgggttttcattttaactttcccacccactacctgtatgactttagagaggccacttaaaataacctggccttattttccttactttttaaaggcaggataagagttgattcagggaggaagaccataattaatgtgaaagtgttctggaactatgaaatactatacacatgcaaggaaggattaaattattatcaccttttccccaaggaggactcggtgctcataggtactcgagttgtacaaggcaataataatgataaatagagcacgttctctgatgaaacactttcatgggtttgcaagtgaaatgctgggcacggaaaggtaggagttgtccagaatccctgacacattatgctcttttcccatgtaagaaatactgattgtatctgactctgcgcccaagtccaacaaagccactgcacggtagatggaggtgagaaggacccagccctggccgccaggaagctcacaatatggaagggaaggcggaccagaaacactccatgtggataaatcatagtaagagccacaaaaggcttcctggggcgctgtggaataaggaaggaagggcatttaaattagattgtggggagagaggtcaaggaaacttccaccaggaggcaaaaggagctgagtctttagggtagaagttatctagactaacctgggggagaggagacggccactccagagggacaggaggcacgagggagcagagcacattcggacaatgtcagcggctccgtgtgttggagtaaaggggcatatgagagggtggggagactttcattctgagactctttgtcctgaaggtgtcgggatgctgtcaaaggaacgtacacccatgagaagatagcgaactctgtgcaaagctgatgatttggttattgtcacagcggagctactgacatagttcaatgatgaaaggaaacttcaaaaccttgagtataaggcatgtgccttcatgacccccctactggatgggagagagttaaagctgttgtttctggacactatatagcctagtgatctcctgaagcctaaaatgagtatctcacaaacacgccagctcacttagtctttctgtttctctgtctctcctctctggcctgtacaatccaccacctgtgcctttcccccttcctctaccatcactacagtactcagccacctggggatgcacacagggtgtacacggcatccactgtgggatgagggggcctttaaatctgtggctggctccccccaagcccctcttggttgctgggttcatcagctcatgcatttggtttcccattggtgagttgggttgaaaaaagaggcccagatgcctagtgatgagaacatttttttttatgaattgaaaaataaaatgacaataagcagctagcagatcccagttcacaatgaagtgaatatcaatacttgtggttgtattgaccttgaatatttttttaaaaatacagagcaagaattctcggggtgcattattatatacattctgaatctcttcactgtacaaaacagaaaatctatcctttatggacaagagcatctctggtgtacagcattgactttaaaatcaactttctaaagtgcaggtagaagaaaatctatggctactcttagagacattcttccctgtcaacatagattatgacattgcttccctgggttccactggggtgggacagggaggaaagccctgctgaaaggaagcactcttgatttctttccagttgtgagaggaaggcaatgatgtcagtgacggattggcatagctgctgtgttccacatcataggtatgaccttatcgtaagtttggcttcttatgcccaggacagatcccgattcctgatgtaacatgaaaacatgagaggcagctcccacgagtcaccttaaattctctggttagaaagtgactttcgactcccttgtagacttactatcagcagtgtccacatggaggtgaaaatgaggggacaccataaggaagcaagactcagccttgatggcacctgtgctccaagctgagcaggcctcaggagcagctggtgggctcggtataacacaggctgctggtcaaaacccttctgatgtagaaggtctggactggggtccaaaaatggggatttctaacaatctccaagttgacctgcagaccacacttgaagaaccacggtgatagagaatctacgaactcagataacccaggaaccatagaaagaccctaatacttccttgatatgtgagataattacctgtcaggaacacgcaaagggagtctacacctagaattaaggggatacactgacccacaaagattccttttccattgcaattgtgagtgagcaaatctagcagagtctatagtacgcataaagtcaacaatgaacaagactaagacaatttaactaaaaaatacaaccgtctatgtattttcaaactttccttggcatgaatacaatggcatggatcttagaatatctgttgataataagagtgaaaggtagatttcctgttattttcacagacaaacaggagaggtaagtgttcagattttctggttggtatgtcttgattctgaccagttccagtattcagctgttttcacctgtaaagtatggatttctctctgcaaaaacctctgtcccaatctgatgaagagaacacccaaaacaaagctcatgcccagagaaaggagcattgatatggatttggaacccaggcatcagctgccaaggctctgttgatatgacggcatgtcccactgaagtaaaaagaaggcatttgaagtattctatgcagagatctatcttccttgcattcctcctctgtattgctctgattcgatctaaaggagctttgaaaacgtcaaagaactttcatgttttgctagtttatcataagtgtctatcttaaaccaatattacaattttaagcatggcctgggtagacatgtgccatcttctaaaatgatttctgacacaaggtaagttgtaccagccgagaccaaagtgaaaagaatcataggctctatgacactcaggctctcctacattctaagagtctttttatttccccctaataaccattattaatcatttcagaaacacgtaatctcctgatatttttactattctagacttgacagaaaaggagggttttgaagttctggaaagtctttttatgtagagtagctccattcttccagcacacagctaccacaaggctcaactctccctaagcagaatgggatttatttatttatttcttaatccactgaagggaagctgggtgatgatgaattcttttaaagaaatcagcatttggctttcaaaatgttaagctatactggaagtgggttgtggaggcagagagcagtcgctagccatggaggaaagcttctcaaattcttactcagcttttgtttgggggaagaggttttcttccatttttatcagctctccgtcccaaatcctacaagctatgaaggaggggacccaccggccagggcaggggtttctgtggcttgctgatggtcacacggctgtcgggacaccagtatttctgaaatccttcctgaagaatttcagaaaaaagaatttcagaaatactggtgcctccacagccgtgtcgagggcacaggtgggcataggcctggaggtggctcctgaatggagcagcagcaagggctgtaaggggtctgcacaagggtgtttgattggcaggtctttgactctccagtcgaatgaccttcaggcaagttaccgaatctgtctaagcctcagtagttttcatcggcaaatgggtctaaggatccctactttattagattgctaggggatggaataagggaatgcatgcaaaactcagcagtgggcctggccacaggcctcagtaccatctccccgtggctggtccccattcagcaatcacaaggcttcgggggtagagaaacatgctgaggccagcacactgaaaccattacaggttttgatttttttttctcaccactctcctccctcctcagttcagctttctattaaggtatcccaaaacactaacgcagctcttggtgaaaggagaaagggaaaaagtggccaaatcaaggggtcgggggacagcagggccaaggtcaaacacctcgttggtataacatcttttaatttgaggaggagctcagtccccattattttcagtaaattctcaaactatgcagctctatgtttcctcttctacccttgtagcatcaactctgcagtttgaagtaaggttttgcaaaacttatgcaaaaagttttcttttctacaagagatgctgaagaagtcacctggaatttgctagtagaactatcagtaaaatgaagacagcaatcctgccttcagcccaactccactgcccagaaaggctggcactgtggggacgaagggggcagtggcagctcaccctgatgcagagagagcggcaagggactctgatggtgagtcagctgagggaagctgctggggtctcagcacaccgtatagaaaatccctccagcaacttcagaaaaactgaatgaaaggccaaaggtaacataaaccgccagctctaccaaccactcaggctgcagaccagacaagggagtggattgttcccatggtggctgcacctttccttcattctattcccgctatcttagttcacgctgcctgtggatcaactcgggatctcagacacatctcgtcacaattatcaagtggcaaaaaaggtgagccgccatccccttggaggtaaagaaaggcatgacgaagtcttagggccaacaggggaacgaagtcttagggccaacagggttcccccggtgtctctcctgcagcatgaaggccattgtttccagggcctgtggccaggatccagttatcttgcctggaaggatgttcaaacagccatggcccgtggtggttttttataatggtgttgttggaaattagtaataccatccagaggtgaaaacagagtagcacctccacagcctgcccaggagatcaggaataatgaagcctcattttagcatctgtttgttttgttttttcagcatttgcggggaatgacaacagaaatattggctccctgaccctggaagggtggaatcactccttgtggaagggaaaacgcctggagcggggcagggggcacaggcctggaggcggctctagggagaggtaggggctctgggctggcggtccccctgctggggaggactcaccttcacatacaggagagaaacatcatccctgtggcagggaaacccgtgtggtgggctgagcttcctcgctccctctctttgaagctctctcaagcccctctgagcatttgcaattgtacccccttagctgctgccacccttcatccggatcccctcaaacactccaccctcacaccctgcagaatcaggagagaggaacccgcctcctgcgagagccgccgccatctgtaacgttgccctcaccacccagaggcgaggaggagagccccccatccctcccgtcccttcccagctcccggcagccactaggctttccccttccccgtcctaagggacctcccgggctctgctctctctgggcaggttcagggctttgcaagcgctgctgctgccaccatcaggctgactgaggcactgcagccttcacctggcgtcagggcccaaaatagtgccccagctcttggtgcggcttcagaagaacagctcctctctgcctccgcagttgcccctcactcaggtgcagcttcctatgtaagaaaaaggcttcagagggcatctccctgaagaaacagaactccttgtgaatgtggggtggaccccagcgtcctctagcaagacgcagaaaaagtgcaggtcctaggatttagggaacgcaaccactgagggattaagtggtggttttgctttctttgccacaaggtcagtgaggcagggaagggtgggaatcactcctcctgccactcccggatgaacgtgctaagcttcctgtgcaatgaaccaaccgggccccagtgttactctgaagctgtcattgctcccagcattgccaagggtgacaggtggactgtcacactgcaccagagccgagtcacctgtgacatttgcaggtgactgacagaaatgggcactgacatgcattaaagaacagaaggacgcgatggtttcctgttgaagctgagcagtgggtggcttggcagaggctgtttctcttggcgttgtctctggtgacccaaagggcattcaaagccttccagaaaggaacaacttcctgcagggcacgtccacacttcacttagtcaggttcttcttctgcctcctgccaggggccctctcagcatctctccatgtgctgatattacaagcactgctggcttctcctctcattacccctcattccattccaatatttccacacttattcacagccttctatgtgcccaatagtgtgctagacaccaggggtgataaaagacttggattttaatcaaccaattaagagaagcaaagtccctgcctttgcttccttcctttttattattattattattattatttgtcagaacagccacaaaaggagctactcaagcagtatgtccttaattactcttcagccccaaagcctggcctgttatttcctctggaaactttgtaccccgaggtaaaactgaatgccagaaagataaagaaactgactcagaaagagtctggaataaaaaagaaattgaactacaatgctgcctccttgttcgaaggtcagacctgggattcggatgcatgattttcataggaaactccctaaaatccttttccagtcctagacactggggattgccacaaattataagactatgacctgtcttatgacaccacagcttaggatactctcctgcattttttagtgttgatgtggaacagctggatgtaccagcatcttgaggaacatcaaggcacatgaataagtgaaccagactgaaaatgactttagtcaagcaaagtaacctctctgggggtatgacagcaataatgcccacttctcattacttctgctgatgaaatgaggtagtgcttgtgaaagccactctgcaacttatgaagctttacacaaatgctagttatcatcaccatcatcatcataagaacataattactgccacgactaacaacaccctcaacaaccaaaagaatttgccaggcacctacaagaaaatttgctggcaaagagcaaatagaatgcatcacctactccctaggaatgtgtcatccaaaataaatagattgttgctaagagataatattcagagaatcttacagttggagaggttttggacgtcatctagtctactctctaacccatttctcaggaattgactcctacattcctgatggcctgaattccaccgtgagtcagaacactctcagcaatgagagactgttcagtgggccagccttagacttgagacttacatatccgcagtcatggaaataacactgtctatttcttgctgaacaatcggggttttgcttcatcattgagcttgtcctgccagcctccaccagttcctgaagagaacaggccaaagtgtggaacatacaggtagatctgatgatattctctactcttaaatggaagggtactcagtgccagagccttgtaaaacatttccaacatcttctgagtagaattgtttcacttgtaaccttggtttccctaaagccagtataacttagcttcctcttgagaacaagaaagacatcatcagcaaaatgtccctaggtttttgtgctcacctgctccagtgctgtttcctcttctggttagcacccatcttcaatgttaggctgcctgcgcctctaactagccaaggggatccacaaactggcaaatctcattcctcaatgcactctttctgctcaagtccagcgtgcagccagcagtcctgcctctgtgtgtttccatgatcttttttcttctcttccacattctttagctaacacatcattctggcattcatctacccaccatccttctgtgcctcctctctggaatgtggactaaccattaaggtcagttccccccatacttattctcttgctcacttcatccatcagctagaaagaacgattaaaaagtatatttccattcaattttacatttttagccccatgtgaaacacaagaaataccaagaagtaaaaataacatgttgatccctaaacccgtgatgtagagaggaccacaaacccataggctactagcaatgtttctcaggtgtttacttaattatctcaatccatcctcaaaagatgtataatggcacccatggccattcacgagttgactcttcccttcccaaccttcctctcccacttccctaacacagcagcactctagccatcatactgcccatggcttctgaacatatcgcattctgttctgccttttgtatttgcatacactgtaaggtatgtaagagactggaaatcgcttttcatgcttcgtttagagaactcttgagcatcctataatatcaagcatgatgtcatctcctctgtgcaaccttttctgatgcctttgctgatccacctgttttcagaacactctgacagctctgaacccatcatattgtaaccttaatcgaagtgtctgctccccaaccagactaagagctctggggcagaaacatggtcttcattatctttgcatcaaaagccccagcacagtgcctactgcataggaggcccacagtgagtgctggctgagtggtcaagggctgagccttagtgtcataaaatggtatttgatcacaaaggaaggagcagcatatttcacccactgagacactagactatgtggagcccctgggggaaaatgtggaatagtgacagcgatgtttgtttgttattgctgcaactcttggcctcagatttcagattccagttgtccaggcataagttaaaaagaatctgcataagttaaaaagaaacttgcaacaacaatccactgaatacaggccaagtgagcagaccatctagataattcagcatgatgcgcacacatcctttcttatactgacatacataggccatccattgcagttttagtttcaattatcaaaaaaaaaaaatcagcctcagataaatctactttgctttgcctatgaagacaggcaaagagtagggtgagagcatagctcccatttgagaaaagtggctgattctggagatatcacactgatttaacattaagtggtgtgtgcgtgtgtgtgtgtgtatgtgttcagtagggggtcaggagggcgtgggaaggcttccagatgccaggaaaaacctgtccaggggatgcaggcaggtgtctgtgtttggctgccccctttgcagttatttccaaggagaagaaggatgacttcctctttccacccttcatgccccaacagaacagctccacacagagcagattcacctatgctggccattatttccatggctttaacttgttaccaagtatgccaaggaatagctgacatttatttaatgttcatagtggtgttgactgtgtacgcactgaaacattgtatgcttatggaagacatttgtttccaagcagcttatgctaaattgcagtgatataaaggaaacacttatccaatattgacatttaccaacttctagaagtatacagccagaatactcatttttaccactgggagaggagaaaaagaattaaaaagcataatggtcctagctccttcagtgagttagaagctatgagtgaatgaaagttaacgtgcagtagggggaggttcaatgggggagaagatcccccaccctcttgtgacccttggctctatggcacagtgtgctttctgagaggactgaagcccttccgtgcttcataataaagctttggcagatggcaggacatagcatcccttccccaaccatgagagaagtattctgatgatctataaggtatctatgttcttacttgacctgcacttctaactgggtaaattctgactttctcttgggaaaagaaaatgacatgcaatgacgtatggaacagtactgtgtctcggtgcagtcgattctcacatcattcctctaactggaaataaaaatcccactctacttggaatacaggatgaagcgattacaacctgggcgcagtatactggctggctttgctgctcactcccttacgaatagctgtgatgggatatgaaatccaagggaactgttagccccccagagcagctgctcccaccgaccctgctccaagagtgctgggatgtccgctggcctcgaggcaagacaagagctccaatcactctgctgcaagcgccaccattaaagtcaagatcactgtggtggggggagttgaagtgtgcattccagcatgctcatgatcttactgaccttctccactgatgaattagaacacccctcttcccaggcacaggacgagttcagtgcctctctgtttcttgatggaccccaataaaaaaacgcctgcactgtttttcacctaaggtcatctcgacaatttacaaggataaggattgtagctgcaaaataatgcctatgcccctctagcccccttagcatcccccatctatatcaagaccataaaaccagtgcttttggccctcctcctcactcctccagtatgggcaattttcttttcctcatccatgtttccaaaacagtttatctttttatctccttggaagaaaagtactccacaaatcaaaggtatcattagtattgttattattttgctattgaaatctcttcaattcgctctggattattcatgtgcttttttgggtctgcaatataatgctgcctaagtcatccccactgggctgaacaaaaaagaaaaactgcatcttcgggcctaatctcctgctccaccccatctcctgctggccctggcttccaccaacacaggcacacaccaggcagggctgcttcttggtaccatgcctagcttgccgctgcctgttccaagccaaatcctcctctgtacacccaagagggggaccccatggtatcctcttagagcaatgtgaaggccttgaccccaccccactcgtcctccccctagggactttcttttccatcctcaataggtctggctggcaactgaggactccctactgggatacagacatgcaaccacccccatttccaacagacatgccccagtttccccacccgaagatttgttaaagaagtggtcccacacccttggcagctgtgtattgaccttctggcacaaaagaactgattcttcttcctctagacaagacgtcatcccacatggggttctggtaggagggagaaacacacattacttccctcatcttttgttttatgacatttctgagtgagtgtaagtgtttccaaagttgctgttcactccccactttgtttgctgattccttctctgcctgtaccccctatgatccctccattctttaggccacctctgatgtgttcaggctctcttccgatgcctccccaaccctgcccctcccaagggaactccttgctagttcaagcctcttgaagtggctcctccttttccatgcttcttgtcatctccatggctcccttcaccctggctggctccctctgttcactctattttacccttctgtctacgagatgcctttctattccctaggagattcagatcaccatgaccctctgccctctgacagctgctgacagccccttttggtgtttccagccaggcaggagagcaagtgggctgcttagattcttcccagtagggagatggtacctcaaatgcatccttagctcagggatgccattaacaggtaaatgcaagttttcacttttaccccaatacagtacagtgtgcatgcaaagccaaaagatctgggttcagcagaattagaaccttcacaaccacagaatcacaaggcaggacaggacgctctaggaatgccagagcaaaatgccagagagtagggaagagaccacctttcttaagagcgagtgtctggagtagaaggcgccaagttcttgccactgtggctcccctgtctatctcccctgtctccgaggtggagatcagagatctccctggaggcagggagtcatcagtcctctaggaccttattccctccaagctacctaagctgtgcatgtgcaggctggatgggatggggcttgaagcttaaggagggcacagaaggaaatagttgtgggtgaactgaaatgataaagaggaaaaaatatagcaagttctaagtttatggatgacaaaagaatcgattattttttcacccaggggcagaacatgtctattctcagcaggaggcaaattgtgctgtgacattatccctctctgaacaaagcatgaccgtcctgacagctgagggaagaggcatccacggcaagggagaagcccacaagcagtacacactggcagctctccattcccttgttgggagccaggcctggggactctggcgggggtggaatcgggaggaatgttatttagccttactactgccaccttaagaaagataaagaaatacttgatctcaatctacatgaaaagcccaaactttcaaagaatagggacccaccatattactgatattaattatacattgatttctgttctctgtctctctaaaaggttataagaaaaagtaaaggtaaacaaacatttgacaaattaggaagaaaaggatggctggaacggactttaagagtttatttgtatcttgagagcactgcttggagcactctctctgcacggggaccaagatactgggagcatggagcttgggaatcttgttcccagaaactcctaagtgccatgcagattcccactgtgagatgtgttggacagcagatggccatgtcatcggagtgccagataaggcactaaaaacaaccctggacatttgttgtctctgagggaaaggccatcccctgggtctcttcacatttcctgggagaggcatcccagcatgcaggaggcaggggtcaagcaggtggctgtgtgagggtgccgggtgggggggtgtaacctcaggcctcattctgggggatcacagtggagccatttagagccatgtgggctagacctcccaggacctgttagacatggatgcgttctatccaataagttgatgaatgcatgacactgggtagaggtggggcacagtacatgagctaagcatatatgtgaggatggtcaaatagaatcctctggggaattcataatgctcaaaacaacatccacataaacaaatttccacagatcaaggcaaaagataaccatatcacattgcagtgaagtccataaaacaccttcccacttgatggctggaccccttgattcccatagtcggacactgtctattcaagaagcacaccatgtacagggatgcagggtatctgaccagccatgtccacttgggtctcctcatttttgtttagacctgttttccagcctctggaccaggtatctaccatttggtagggtggacagtgatggccaagctcagaacactccaggagcacaaggcattaagaactgcatgatgttatggtttcttcctagcgctctcaggactcggggtagataaaacagagcatttaacctccataggtaaatatttaaagattcacatgaagcagtcaagaaacagctccagaccaagaaagaaataagcacaacagaagatgtacactgtaatgattcagacggccagggaggtacttagacacctatagccttcttatgccaatctacataagtatcacggatcaagcttctaactacacaaaaggctgattaaagcatgcactggtcccatgcaaatgtgagtttgtgtgtttacggggggttggttggaagattccctccttctcaggggttctatatcaaaacttcctgagtgaactggtaagaagcaaagacgaatgggagtgtgtgtgtgtgtgtgtgtgtgtgtgtgtgtgtgtgtgtgctcataagcaagcacatacacatccaagaaagagggtaatcttaccaaatggtaatataactgaacctgtctctataccagtgttctgagagagttcttattcattcagcctgaaactctggggaaggcaatttatcttcctgctgctgtagggagccttggtgagaagcacacaaccatatgaatacatgagtgtgtgtgtgtgtgtgtgtgtacatacattatcattatacacaggcattagtatgcacatacaaatatgaagaaggagccccttcggtttcatcaggaggaccagaagcaaagtttgaactgcacagataaggagaaagtctgcagtgaccacaagcacgggtggaagagcagaagaaggaagccaggtttttgcttatatttggcttctccccgacaggggagaaacagaagacatgctgtttgcttgcaaagccagccacccatggcagtgctttgctttctcgaaaacttttacccttcatttaatcaacagatggacgtgctctgttgtggattttttctgagtcttgcacctctaagagctgtgttggctggcacaaatgcagcctcagatggcagaggtgcattggcattccaaaagagcgggaaggagcccatgtacttgcccctccaaactcaattccacaggtgacttttgatgcctttggccaactaggcactcacattccctctcccgaatttccctctcctttctgcaccactaccagccccagggctcccagtggcaaggagcctagaggtggcaaagttctttccggagagtccacctgcttctctgcccctgctaggctgcagaaaggaaaccatcagcaccacgggcgaaatttcattttataccctgaattcagtgctgtgtaggattcagaattcaacctaatttagggaactcgatgacgttcaatgaaactctttacaagcttttcccaaccactgcaaattaccccccacaatacattctgtaattgcaacccccttttcaacggtgcaaaccacacacattcgcttttgaatacacttgtgcaagtcaaaccctattcaagctgaaatatccacctaaaccaagctctccctccctgccgtctccttccctggcctgggtctgaaggagaggaggtgcccagaagttcagagcggcataaccacagagatactacctaattaacataccagaagcataaagaactcatttgcattggagagtttgagctggatattgacaagtgagaggagaaagtcattcccctcccctcccataccccttctttccaaaggaaaataaacagtaccattttgttgcattcgcaaaggcgaagaggcaatgccagagcatctcagcccggcaccgagagacgcatccatcagtccgagttcccgaagcctgcccacgttcctgcccacagcctcccgcgccctgacaacccagccgactttcttccaactccagcagcgcaggggtcctaccttgactgaagaggaagaagcagacgaagagcagatcgagctggaagggtttcattccttagcgcagcgaaggaaagccggcggggtaacttggctgtggttagtttctcttccttggcggctctcggtgctcagcctccgccggtcctctcgggttcgcgcctaccatctgtccgtccgtgggtccctccgggtggcttcggtctctttgtgcctctgggtatctgcagccagccgacacaaactgcctgttcttagccgcctcgggaagccgggattgtcagcaatgtccccactcggagaagatccattctctggctcttggcatcccaggcacacggcttcctcaggcgggctcctcccacagtgagcgagcgagctagtgacgagtgacagaaggactcctttcactgaag
